United States Patent 12,642,819 (COMPOSITIONS AND METHODS FOR TREATING INFLAMMATORY BOWEL DISEASE) - sequence listing, part 53

SEQ ID NO: 21 - DNA, 2266574 bp, Bifidobacterium bifidum
  modified_base (110105)..(110197): a, c, t, g, unknown or other
  modified_base (1142290)..(1142388): a, c, t, g, unknown or other
  modified_base (1349263)..(1349359): a, c, t, g, unknown or other
  modified_base (1561231)..(1561328): a, c, t, g, unknown or other
  modified_base (2188452)..(2188543): a, c, t, g, unknown or other
  modified_base (2218860)..(2218956): a, c, t, g, unknown or other
  modified_base (2252430)..(2252468): a, c, t, g, unknown or other
  modified_base (2262915)..(2262982): a, c, t, g, unknown or other
aacatgcgaactccaatccggacaccaaagcgtccaacttttcatccgcaccccctactcgtcgtttcggcgcgcacataacgacgcaattgcagccaattcgtagttgtcaggccttctcgcattgcgatcggctttataggtgagtcttgcgacaacaaaaaccggcccccgcaggagccggttgaagaaacgatagcgcgccgccgtcagtagttgctgttggccttccagtaggcgtaggcgccggtgatggagccgtagcgctggttgcagtagttcacgaaccacttgaactgcgtctggtagttggtgcgccaatccgcacccgcggatgccatcttgttgccggggagcgcctgcggcagaccgtatgcgcccgagctcgggttcgtggcgttcgtctgccagccggactcatgattgatgatgaagttggcggcggtgaagtcggcctcggtgtaaccgttcgccagcagccagtcatgcgcccacttctgcttctcgccggaggggacggtgtcaccgagtgtgttcgcggccgcctcttcggcggaaccggtgccgaccaagatcaccttgtcgacaggggctttcttgacgtacttggcgaagacggtggacgagatgaccttgcccgcggagcgagtgaccatgctggtggtctgcagcacgccttcctgaccttcggtctgcaccttctgctgaccctgcggcaggctggtggtctccttcttgaccgtgttgaacgcgatggcggtctccgaggtctcggcctgcgtgtcggcacgcgagatggagatgaccgtggactcgtccaccttcgtggtcagggccggcgtgacgctgtcttccggctccaacgtgatgttgcccgcgtccagtacggatttgacatcggtgaaattgtcgcccagcacgaagcgggacttgccgttgatcttcaccgtcacatagctggtgttggcgtcggcgccacgcagatccgcacggttgttgcttcgcgagacgctgcttccggcgaggtcggcggccgagtattcgttgaccgtggttccgcggccacgaccgatgtagaagtttcgggagacgatgccggccgcaaccaccatgacgatcgccgcggcgatcgctacgatgcggatccactggcgtttgcttagcgacagcagcgttggtgcattggttttgcgatggctggccattatgctccttgaatgacggacaatcctcggcgaatccggccgtcaatcacgacgggcgggtgatgcgtcgacgctggtgggcgccgcaccggagtacacaccaaatccaagtttagaccactatgacgatcttgtgaaatcttggagccggcggattccgcattccgcccgcgcccgtggcaccttcgcctggccgccggcgcacgaacgcggaatccgccgggaatcgtcggttattcggcggaagcggacgaatcctgcgcggcggcggaaacgtccagcgccttcgcctgcgcgatcaggtcgtcaaggtcttcggcgcgcagcgcgccggcctgcttgaagatgatctggccctgcttcgcgatcatcagcgtgggcactgcctggatgccggccgcgctggccagatcctggttcgcgtcgatgtcgaccttgccgaagacgatgtcggggttctcctcactcgcggcctcgaacgtggggccgaacgcgcggcacgggccgcaccatgtggcccagaaatccacgaacaccaggttgttgtcggtgatggtcttctcgaagtcctgtgcattgagctgaacggttgccatgatcgtttcctccctcgttgtcatggtgatgttcccatccgttgtcgtcccccagcatcccagcaccactcaacaaactacgccgacggacgaatgcggacgcccgcatcgcgcgttttccgtgattcacatcgcattcaggaatccttgtcgaaatcgacacgttgtcgtcacgcgagttgggcgataattaagaccatgccagttttgaatgacgaagtacctgacgagggcgatttcgacgccggccgccggcgcggcgaattcgatgacatcacgcccgaggatttcatccgcgggtccggtcacggcaatccgcccggctggctcggtccggccgacatcagtcgtgcccgtcggcagctgccgatcgcttatgtggagatcgtcccgattcgcactgacgacctgggcagggtctcccggatcggctccttgctgcacgtctcggacgacggatccatagagcgcacgctgatcaccggccgcgtgctgttccatgagagcatccgcgaggccatcgcgcgcaacgtcgccaaggatctgggcgacatagcgctgccgatgctgccgcagagcctgcagccgttcaccgtagccgagttcttcccgacgccgggactaagcgagtattacgatccgcggcagcatgcgataacgctgtgctatgtggtgccgatcgccggtgactgcaagccgcaggacgagacactggacgtcgagtgggtcgatccgcgcggtgagatgatggagacgttcatccggcagatgacgaacggacatggccgtatagtccgtcaggcgttggcctggctggatttgtgacgtgccgtctctccgtccggccggtccgcgagaggacgcgggccggccggacggcggcatgatcggtgggaatggggcgcggacggcggccgacgacagtggccgacaccgggcgatgaaacgatgacgatataggagcgcaacgatgatgacgctgagcaatacggtatacgcgacgggggaagggacaccgctggtgctggtgcacgcattccccgttgaccaccgcatgtgggacgactgcgcggagcagattgcccggcaggcgcgggagacgggcgacccgtcggtgacggtgtgggcgccggacatgccgggcgccgggaccggtccgattcccgagccggccgacagcgggcgggtggcggccgacggggcgctcacggacgcgctcgacctgatggccgacgcctatgtcgatctggtgcgtgccgccggctacgacaaggccgtatgggccggactgtcgatgggcggatacgtggtgctggacatccagcgccgccatccggacatggtcgcgggactcgcgctgtgcgacacgaaagcgggcgccgatggccccgaggcccgcgcgaaccggctggcgtgcgcgagcgaatgcgaggcgacgcaaaccgtgaagccggtcatgcatttcgccgatgcgacgccgtccgattcaagcttcaagcagtccgatgagggcagggcgctgttcgcccgctggattggcgagcagacgccgcagggcgtgggttggcgtcagcgcatggccgccggcaggcctgacctcagcgatcagctgccgctcgtcaccgctcccgcggcggtgctgtgcggcgacaaggacccgttcagccccaggccggcgatgcgggcgctcgccgatgcgatgaccggcacgtcgccgagtttcacggtcatcgaggattgcgggcatttcagcgcggtcgagcatcccgatcaggtggcgagcgcgttgctcgatctggtgcgacgcgtgcatctgcgcgactgattgcgggcgcagtcggccggacacggcatccgcggtgcggtggggccggtggcgccggcggtgtgacctgccgtgacgatgattgacgatggatacatgaggagtgtgaagtgatgttttcaccattggcattgacccagacgttgccgttcctgccgctggcgcagggcgacatcgattatcaggtcgcccggcgcggagatccggacctgttcgacacgctgttcgccgaccccgtcaccaaggtcatcctggtgcggggcggcctgctggccgtgccgcgcggtcagggcaatgccgtcaactatgcctccgcgaacatgaggctgagcacgctgccgggcgcgtacgcgggctccgccctggctgtccaccccgaagtggtgccgatattcctgggatcgtatggcgcgctgcgcaacgagcatgtggtggcgttcgacatcactcggatgtcgacccccggcgcggcctcggcgattccttcgccgtcgctcggcgccgacgcggcgtttgatgccgacggcaatgctcccggtgcggtcgcgcctgacagactggacatgctggaacaggccgtggaacggttcgactgggtggatctgcgcgggttcgccgcgcacgccaacgcccgcgaggccggacaggccacgaccgcggtgaccctgagcatatggtacgccgggcagcggttctgcccctcctgcggggctccggtcaaggcggcgatgggtggatggtcgcagcggtgcacgaacgcgggcgacgggaaccgtctgctgttcccccgcatcgagcccgctgtcatcaccgcgatcgtggacagtcaggaccggctgctcttgcagcacaacagcgcctggcgcaatccgctgctgtactccgtttcggcgggattcgtcgaggcgggggagaaccttgagcacgcggcacggcgcgaggccaaggaggagaccggcatcgacctgggcgaggtgcgctatctcggctcccagccgtggccgttccccgcgtccctgatgatggcgttcaaggcgcaggcgttgagcaccgacatcctggtggacggcgaggagacggagaccgcgcgctgggtgacccgtgacgaatacaccatcgaattgtcggagggccgtatggaagctcccggcaaatccacaatcgcccggtacatgattgaggagtggtacggccgcgaactgtgacatgcgccgcacgacaatgattcgtatgtctgccgggtgttatagtgaagccagagagtcgaagtaaaggaacaggaatggctaacgaatacacgggagacgataatcaggaagatgagcgcacgcaggcagtcttcccgctggatgatcagatgaacatcccgcctctgaacatgcccgcccttcatgacgggtcgacgtttgacgctgagccttccggtctggcgggtctggtccaggagactcaggcgaagcggcaggcggatgcggcctccgcacagacgcaggagtcgcaggagactcaggctttcgacccgttggccgagctggacgatgaggccgctcctgagccgcagcccgccgcacctgcgacttcatcctttgccccgcagcgtcccgccgcggacgacgtcgcgaccgtcgccttcgccgcggtcgccatgaacccggccgatgacgccgcgctgggcaagggcgtgtccgcggccaagacgaagaacccgaagcgcggcatgatcatcgcgttcagcatcatcggcgcactgctggtgctgctggtggccgcattcttcggcacgaactggtatttccaggaccgcgtcgccccgggtgtccgattcggcaacgtcagcgtcatgggcaagaccgaaagcgagctcaccggcatcgtcaaccaggccgtgtccgattcggccatcaccgtcaccgattccgagggcaacaatgtcaaggcgggcctcgacaaactcggcgtgaccgtcaacgtcaagcagaccgtgcgcaacctgctggacgcgaaatccggcaacatgttcacccgcatcaacccgttcgccaagcaggacgtccggctgtccgccacgaccgacaactacaagctgagcacctacctgaccgagcagctcgtcgaggagcaggatcgcgcggtcgcctcgaacatcagctacgacgccaactccaagaagttcatcgtcacggaaggcaacgagggcaaggaagccgacccgtcggacgtgatcgcggccgtcaagaaggcggtctcccagcccggcgaagcacaaaaactgagcgttatgtactccgacgtcgccatgcccatcaccgtcgaaaccgccacgagcgcggcgaacgacgccaacaagcgactgacgtcgtcgctggtcatcggcaactccaagggcaagacgttcacgcttcccgccgatgagatagccaagtggatccaggtcaagcccgacatccagaagggcaccatcacgctggcatacgatcaggacgccatcaagacatacctgtcgcagaacctcgccaagaaactcgaccaggacatggtcgtcgagaagaacatcaccaacaccgacggtaccgtgctgaccgtgacgcagaagggcgtcgacggcgtggccgtccaaagcaccgacgagaccgccgcgcaggtgctcgacgcgctgaacgccggcaggggcgcggagctcacagccacggtgaaggtgaccggccacaagaccgaaagccgcaaggtggactacacgtcgcccaacggcgaccctcacatggtcatcaatctcagcgagcagaaagtgtacgcctacaagggctcgaccctggtgaagactttcatcgtctccaccggcaagccatccacgccgaccgacaacggcacgttcttcgtgcacaccaagtaccagtcgcagaccatgcgcggcgaaggctacgtcacgccgaacgtgccatgggtcacatactacaaccagggcgaaggcttccacggcgcaccgtggaacaccgcgggcatcgccagcggcactccgaagtcgcacggatgcaccaacatgcacgtcgaggacgccaagtgggtgtatgacttcctgccgatcggcgccatggtgcagatcgtggggaccacgccgacctccgctgtgcgctgattttcaggcgattgcgctgactataccgctgatgccggccccgccgatcattgtttccgatcggcggggccggctgcgttttcggggcctctccggccggctcagggtcagccccatcgataagcgctgtgcggtacactgggggcatgagtgacgagaacgcaatcgacaacccgttgaaccttgacatccccgatcacctgcagtattcggaagagcacgtgtgggtggacgattcggtgtccccggccatcgtcggcatcaccgcgtacgccgagcagcagcttggcgagctggtcttcatcgacctgccggacgagggcacgcgcgtggaggccggcgacgaggtccttgagctcgaatcggccaaggccgtcgaaccgctggtctgcccggtcgccggtaccatccgctatgtcaaccatgacgccgcggacgacccctccgtcgtcaacaacgacccgtacggcgaaggatggctgctgaagatcgagctggacgatgacgagccggaactgctcgacgccgaatcctacgcgaagatcgcccagtgaccggcaccgccgtcggcgaccgacaacgcaagccggcgatggccgacggtgacgaaggtgcatgacgacgacatatccgacggatatatttgacatacagctaacgtgataacggatggcggaacccatgagcatcgcacacgacaacacaccacgccggggcggagcgcgccctctcggcgggcgggatgacgggctgcggcatgacggcccgatacatgacggatcggatccggacaacgcggctcacgacccgtccgggcagaccggctccccgcaggacgacatgctcaccgtgccgattcccgcacgcccggtcgtcaccacgttcgacgccgcgtcgcggcacgagcgcatcgaggtgcagccggtactggtgcgccgcatgcgccgggccgtcaccggcacgttcggattgtgggtgcgactgtccaccgccgtcgcgcgcaagctcgactggttcccgcgcgtggacccgtacgtcggctatggcaccgaggtctactctaggctgatctgccgcaccgtgtacgcgcccaagcacagcaacgccggcacactgacgcgcggcatcaaaggcatgctggcgattcccgcgtcccgcgtgcaggtgcgtatcagcatagacgggacgccgctggaaaccgtgcagatcggcgaatccgagcgatatgacgaattcaatcccgtgcgagatctcggcagcgaatacgcggtgtccgacgaaagcggatacctcgatctggtggccgagcatcagctggagaccggcgttcaccgcgtcacctatcgcgtgaaggggcggccggaggtctcggcgagcctgttcaccatcccctccagcgcgaaggtcggcatcatctccgacgtggacgacaccgttatggtcacgcaggcgccgatattgtggaaggccgcatacaacctgctgttcctgaaccccaagaagcgcaactccgtgccgggcatgagcgtgctgttcaccaaactgcaggacatgttccccgacgcgccgttcttctacctgtcgacgtccccctggaacgtggaaggatcgatccggcatttcatctcgtatcacggcttccccgaagggccgctgctgttgcgcgacctcgacccgcgcccgaagacgttcgtgccgtccggtccgcagcacaagctggagttcgccgaacagctcatggcggacttccccgacatgcggttcatcctgatcggcgatgacgggcagaaggacccgaccacgtatgcgaccatcgctcggcgataccccggccgtgtgctggcgatcggcatacggcagctgtcgccccgcgaggccacgggtctgtcgtcgatgatgggcatgacctcgacgcagccgatgcccgtcaccgacgtgccggtgttcaccggcaccactggttcgaacatcatgaagaccatgctgccgtacctcaagcagaaactcggacgaacggacctggcggagtgacttcccgaagagcgaagttcgccgctgtctcaagtcgggccgtataatcacgagcatgacagacgaaacgaacggcggcgtcgccgcttgccgacctcccatcgcccggcgtgaaccggtgaagcgcgtgttccacggggacgccgtgattgacccgtatgaatggatgcgagacaagcagtcacccgaggtgcgcgactatgtggccgcgcagaacgcgtactgtgacgcccgcatggcggggctggcggggctgcgcggcacgctgttcgacgagttgaaggcgcatgtgcaggagaccgacatgtcggtgccggtgcgcatggacggatactggtatttcgcgcgtacccgcgaaggcagccagtacgccgtgcagtgccggttgccggtgcgcggcgaggacgattggacgcctccggaagtcgggggagccggcgatgagggcgggagcgccgtcggagccggttcgctgccgggcgagcaggtggtgtttgatgcgaaccgcgaggccgaggggcatgatttcttcgcgctgggcggcctgtccgtcagcaaggacggccgatggatgctgtacggcgtcgatacgcgaggtgacgagcggtacgacttccgcattcgtgatcttgacacgggcgatgagctgccagagcgccttgagggcatcggcgcggcatgcttcacgccggacgcgcggtgggtgttctacgtgacgcttgatgatgcctggcggccgtgcgaggtgcgccggcaccgcgtcggctcgccggtcgagcaggacgaagtcgtcttccacgaggacgacgagcggttctgggtcggggtcggcatgagtttcgacgagcacagcatcgtgatctgctccgcgtccaaaacttcgtccgaagtgtggatgctgtcgaccgcgacgccggaaggcgagttctcggtgttcatcgcgcgcaaggacgacgtggaatatgacgtgagcttcgcatgcttcgaaggtgccggggctgacggggccgatattccggttgccgtggtgtaccacaatgctcaggatccgaacttcgagatcgacgtgatcgacatgcgaacccatcagccgccgtatacgctgggagaaggcgtgcgcgtggcggtcggctcgccatacgggtgcgcgcgcggcgacgacatgaaggcgggcgcgggcgcgaagccggccgggacggcctactcgaatcccgccaacccccggatattgcagggggcgcacgggctggccattgagggcatcgccatccaccggcatttcgtgacgctcgcgtaccgcacggacgggttgccgcacgtggcggcgatgaccaagacgcaggcggccgaagacttcctcgccgggcgtccatggtcgttccgcgagctgatgccgccggcgctggacggcgactgggacgtgcccgggcgggccgatgacggtgcagccgaggccgcgggcggaacgctgccgggagccacccatcgtctgtactccatcggaacgggcggaaacccctcgtatgatgcgccgcgcatgcggtacacgttctccagctacacgcggccgggcgaactgcatgagtatgatccggcgaccgggcatgacgagctgctcaagcgggcgcgggtgctgggcgacttcgatccgcgcgagtacatggagcgtcgggtgtgggtcaccgctcgtgacggcgagcgcatacccgtgtcactggtgtggcggcgcggccatgagccggccgctgacggcgcgatgttcatcaccgggtacggtgcttatgagatcagttcggaccccggcttctcagtcgctcgcctgagcctgctcgaccgcggcgtgctgtacgccgtgccgcacgtgcgcggcggcggcgagatgggacgcgcctggtatgagcaggggcggcgcctgaacaagcggcacacgttcgaggacttcatcgacgtgaccgccgcgctgcaggacgcagggttggccgatgcgcgtcggacggtggcgtacggcggctccgccggcggcctgctgatgggtgcgattgcgaacatggcgccgcaactgtatgcgggcatcgaggcggatgtgccgttcgtggatgcgctgacgtcgatcctcgatccgtcgctgccgctgaccgtcaccgagtgggacgagtggggcgatccgctgcacgacgcggacgtctaccggtacatgaaatcgtattcgccatacgaaaacgcgccggagggcgcgggcggcgaggccggtgcgggcgcggcgtccacgcggtctttgcagaggcaatcgttgcggccgttcccgcgtatcttcgccaccacgtcgatgaacgatacgcgcgtgctgtacgtcgagccgctcaagtgggtgtcccgactgcaagccgccggcatcgatgcgatcatcaagatcgaagtcgaggccggtcatggcgggacctcgggccgctacaagcagtggcgcgaagtcagctacgaaaacgcctggtgcctctccgtcatgggcctgacccgctagccgcggccgacgtccgtccctgattgcggggcttccatatcgcgcccccgcctgcaaggggatatgtttttggggcccgcgggtggggatcatatggttgttccggcattcggactttgctgtgccggatagtggaatgaatgatggttcctgtgccataccacgtcaaaaacaccgttttttcgcgtggtgtggtacaggaccttgccgcagaatcggttttaatcggttacatgcgctgttgtggtacaagaggaatatcaaagatccttgcaaaatggccgatttcgctgtgaagcccggaatcggccatatcgggcgtgtaccacaccacggtcaaaatagcgtttttcggcattctgtggcacagaccatgccgcacagaccatgcgcgaagatcacgtcgcctccaccgtctgtccactagacggactgggcgcattgttttcgagcacggccacataccctgttggctatggcaaagaagtatacaatcgccgttatccccggcgatggcattggcaaggaagtcaccccctgggctcagaaggcgctggaaaaggccgctgagggagtggctgatttcgaatacgagaatttcgacctgggtgcggagcgttatctgtgtgatggcgcgatcctgccggacgaggagctggagcgcatcaagaagaccgatgcgatcctgctcggtgctgtcggtgacccgcgcatcaaggccggcatcctggagcgtggtctgctgctgaagctgcgtttcgcgctcgaccagtacgtgaacctgcgtccgtccaagctgtacaagggcgtcacctcgccgctcgcaaaccccggcgacatcgatttcgtcgtggtgcgtgagggtaccgagggactgtactgcggtgccggcggagcggttcgtcgcgacactcctgccgaggtcgccaccgaggtctctatcaacaccgcgtacggcgtggagcgcgtggtgcggtacgcctatgagctggcgatgaagcgtcgcaggcacatcacgctggtgcacaagaagaacgtgctcgtcaacgccggcgacatgtggcagcgcatcgtcgaccgtgtcggcgaagagtacccggaggtcacgcacgactaccagcacatcgatgcggccacgattttcctcgtgtccgatccgtcgcgcttcgacgtgatcctgaccgacaacctcttcggtgacatcctcaccgacgaggcaggtgccgttgttggcggcgtcggatattccgcgtccggctgcatcaacgcgagcaacgagtatccgtcgatgttcgagccgattcacggttccgcgcccgacatcgccggtcagggcaaggcgaatccgaccgcggccatcctgtcggccgcgatgctgctgcgccatcttggcttcgacgatgccgcggcccgcatcgacacggcggtcgaggctgatatcgaggagctgggctccaccgttcgctccaccgatcaggtcggcgaggatattctcgctcgcctgtaacgcggcggtggcgtgaaccaccccagtctcgctttgctcgacagcccgccagcgggggcctatatctcggtcccgctggcgggctgtcgagcaaagcgagacttcgtgtatcggggtttgagacgaccacgcagacagattcggcgtgtaacgtgtatcgggtggatatcgaaagtcgtggggaatgcaagcgcccgggcggcaagctggtcggggtgacagtggcgtgcgcgccggataacggccacgtcgtcggctgtcgcgtggacggtgattttttcgttgaaggtgacgatgccgcggtcgacaggtatctgcgccgtctgaatgcggcgcttctcgatatagcgcagcgtgatataacacagtgcgatacgccgcccgatgatccggataccgtctcctatcttgaacgcatcgcacgcgatgagcatgtatccgttaccggcgcgaatgcggaaacgatactgaccgcgttgcgccgcgcgctgtcggcttgcggccgggacgccgcgcgaccggcatcctcgcgcctcgcttcgcccgcctccgtgacggcgcatgacgcgcgcaggcgtgcaacgccgtccgccgcatcggctgttccgacctcgtctgtcacaattacgccggcggcctcggcgcctcaagcgtcccgcggtctcacaccgccgacattccccggcgagtggcacgaccgctggcatcggctcgcgccgaaaatcgtcgtggacaagccccgcaggccgcaggaacagatggatgtcgacgtgcaatggtcccgtgaggtggccgcgggggagcgccctgccactatccggttctggcagtgggcgtccccggccgtggtggtcggccggttccagtcgattccggacgaagtgcacgaagacgtcgccgcgaaggagggtttcacggtcgtacggcgctgcacgggcggcggcgcgatgttcatcgagcccggcaacacgatcacgtactcgctgtacgcgccgcgctggttcgccgcggacctggacatcgaggaatcgtaccgtctgtgcgacatgtggctgatcgccgcgctgcgtggcctcggcctcgacgtcggcttctccggtctcaacgacatcgcctccagccatggcaagatcggcggcgcggcccagcgcaggttcccgcccatcggctccggccccggttcgatactccaccacgtgacgctcgcctacgatatcgatgccgtgaagatgacccgcgtgctgaacatctccggagagaagatgtccgacaaggccgtgaaatcggccgtgaagcgagtggacccgatgcgggcccagaccggtctgagccgcgacgggctgattgcgcgtctggcggactgtctgacgcaaccggacgatcccggtgcaaattaggctacaatatgacagaaccgaccgaagacagagacgcgacgggttggattccgtcgcgaggacgccgatgcggatgcggtggcggatggtgcgccgtcgtcgcgatatcgcaggggctccgtgtcgaggtgccggtatgtcggaaacgtgaccaggaggcgtcatgagggcaatcgggccgaattcgttccccgaagaggacaacgagctgttgcatacgccgttgttcaagcaggtgtcgccggagcaggccaatgagctgattccctacctgcacgaggccgtattcgacaagggcgactatatcttccgcgagggcgacagggaccaccgcatgtatctgctggagcgcggccgcgtcaagctgatccgcgaatccaaggacaggcgcgtgcagctgctgtcgatccacgcgcacggcgaactgctcggtgagattcccgtattcgacccgtccggcggcccccgtaccgccacggccgtggcgatgacccacggcacgcacgtggcatggctggagcatgacgcgttgttcgcgtggctcaacgagcacccgcgcgtcgccatcgacatgctgcaggtgctggcgaatcgcatgcgcggcaacaacgagcgcatatccgaccttgtgttcatggatgtgcccgcccgcctggcaaagacactgctcaacctcggcgcgcggttcggcgagccggtggaagccgggctgaaggtgccgcatgacctgacgcaggaggagctcgcccagttggtcggttcttcgcgcgagacggtgaacaaggcgctgatggatttcgcgaaccgtcggtggatcgcgcgcgagggccggtcgatcatcatctaccagccgggcatgctgattcggcgctcgcaacggtgacggctgcgccgagcgcggtgaacgcccggcgttccagcggccgttggagaatgattcggcttgtttccggtcgttttacagtcttctgaccggtttgtgagtaccctgtgagggattgggaatcagtcgttcggatgacgtgcccggtagagacgcccctctagaatggcaaccatgcccaagaagaaatccctgaccgcaaaacgtgtgttgtcgctgttcctcgcgtatgtgctgctctgtctcgccggaggcgtcgtcaccagcgcgttcttccttcccgccgtgttcgcatcgaacaacgtggtgcgtgccatcgtgccgtcgctgcaggtggagggcatcgatttcaacgtgaccgacctgccgcagcagtcgcgtctgtatgcgtcggacggtacgacgcagatcggtacgttctatgcgcagaaccgtatcgtcgtgccattgaagaagatttccaagccgatgcgccaggcggtggtctcgcgtgaggaccgtcgtttcttccggcatgccggcgtggatatccagggcgtgatgcgtgcgttcgtggcgacctacgtgaagaagggcgccactcagggcggttcctcgctgacccagcagtacgtcaagaacgtgctgctgctgcaggcgcaggaggacaacgatccgatcgccgaataccatgcatccgaggagaccgtggcgcgtaagctgcgcgaaatgctcatcgccgtgcagatggagaagacgtattcgaaactggagattctgcagggctacctcaacatcgcgcagttcggccgtggcatttacggcgtggaaatggccgcgcgacgatacttcagcaccacggccgacaagcttgacatcgtgcaggcggccaccatcgccgcaatcacgaagaacccggcggccttcgacccctcggtggagagcaaccagaaggcctcacagagggagcgcaacatcgtgcttgacctgatgtatcaggaaaagtacatcagccaaaagcagcgtgacgaggccaaggcgaagccgctgaaggacacgctgaaactgcaggatgcgcaggcggggtgcagcgcgtccggcgacgcggcgttcttctgcgactacgtcaccaagaagatcctcaactcgaaggagttcggcaagaccatcgaagagcgcaagaagctgctgtatgagggcggcctcgacatctacacgacgatggacgtcaatgcgaactctgcggcgatgaaggccgcgcgtgcggccatcccggcggacgacgcgagcaagatggaagtgatgatggcggccatcaagcccggcaccggcgaggtgcttggcttcggcatcaacaagatatacgacacgtcgccggaagcgaacaacgatccggccagaaccgccatgaacttcgccgtggaccagatagacggcggcggtagcggcttcccggtcggctccacatggaagccgatcaacctggtggcctggatgcgcaaggggcactcgatcaacgaggtgctgccggctccgggcgtcgtgaacctataccgtgacattcccggcttccgcggcgtcaatacctgggacgtgaagaactccggcggcacgcccggatacgcggaatccccgctcgacggtctggtcaactcgcacaacaccacgcaggccgccatggcgaaggtcatcggcctcgaacccatcgcgcaggccgccgaggacatgggcttccatcaggcgtccaagcagaagatgaacatgcatctgaaggacgacaccgcgaacggcggcgcctatcaggccccgctggtcatcggtggtacggtgtccgccgcaccgctgaccatggcgaacgtgtacgcgaccatcgccgcgaagggcgtcgaatgcacgcccatcgccatcaagaaggtcaccgacgccaccggtgccgagcttgacgtgcccaaggcgaactgccatcaggccgtcgacccggatatcgccgaaaccgtcgcctacgcgatgaaccagggcgtcgtgcgccccaacggccaggcgaggaccgcccagctcgccaacaaccgcaagacgttcgccaagaccggtaccaacgagaacacgtacatgctgacaggcggattcgtgccgcagatcgccgcgttcgtcgccgtgggcaacgccgacggcaacagcgacttcgacaacaagaccattaacggcgtataccaccgcacatggttcggttcctatatcgcgaccccgacgtggaagaacttcatggacacgtatctcaccgcgatcaatgcgcccaacgtcgattacggcacgccgtcaagcaagtacgcggcgacctcgaattcgacctcgaaatcgtcaaggtcgagtaccaacacgacagacgggacgaccagcggaaccggcggaacgggcgataccagcggccagtacacgcagacgcagaacgacacgaccaccggcggcaatcagaccgagggcggccagaccaccggcgggcagtgacgggcggtggttcggcagctgagccggtgagctgagccggcgggccgatgcaccgaaagcggcggttcgccgcgtgaggcaggggccgtatgagcatgaacgctcatacggcccctgcccgatttccgacgcattgtgcaggcggagaacatcggtgcacgagtcgtgcttgagtctgtgcgcggtgagatgattagaccggtggttgcctcgccgtggtttggaagcatcccgacttcccggctcgcggattgggagccatgcgaattgtcgaggaaaggacgaccatgaacgctgaggggaagaagaaggccaagggcggcaaagggggagtgcagctgttccagccgatgacgttgcgcggcgttaccatgcgcaaccgcatctggctgccgccgatggacacgtattcggcggtggcgcgggacggcaagcccacgccgttccattaccagcattatgtgtcccgcgcgatgggcggattcggcatgatcatcgccgaggccaccgcggtgacggccgacgggcgtatctcgccgcgcgatgtgggactgtggaacgacgatcaggtcgccgcctggcattggatcgtcgacggcatcaagcaggccggcgcggtggcggccgtgcagctcaaccatgccggacgcaaggggtcgaccggctgcttcggcgtcggtttcgaggggaagagtgtgcccgaggatgccggcggatggcgtacggtcgcgccgagcccgatcgcgtactgtgggctcaccgatccgcgcgcgttgagcgtcgaagagattcacggtctggtttcggcgttccgggatgccgcgcagcgtgcggtgcgggccggtttcgaggcgattgagattcatgcggcgcatgggtatctgatctcgcagttccttgacccgctgtgcaacgagcgcgcggacgagtacggcggcgatatccacggccgcatgcggttcctgctggaggtcgccgatgcgattcgcgaggtgattcccgacacggtgccgctgctggtgcgcatttcggccacggactgggccgcgggcggctgggatctcgatcagacggtcgataccgcgtgcgtgctgaagcagcacggcgtggacctgatggatgtgtccaccggcggcatcatcgccgacgtgagcattccggtcaaggccaactaccaggtgccgttctccgatcaggtgcgcgaacgcgccgcaataccgaccaccaccgtcggcctgatcaccaagccgaagcaggcggagaagattctgcgtgcggggcaggccgatgcggtcgagatcggccgtgccgcgctgcgtgacccgtactggccgctgcgcgccgccgccaagctcggcgtgcccgtctccaaggcaccctaccagccgcagtacatccgcggcgccttccctgaggactgagcggcagataaacgtagaccacctccagtcatgctacgcatgactggaggtggtctacggctgtgtcgatcaggcgtcgatgccgacggcgtcgctgatgtgttcgaagccgtcgcgcttgaggagcgccgcgaggccgcgcttgagtacggtgatctgctgcggtccgcggtacatcagtgcgctgatgaacatgaccaggctggcgccgttgcgaatcttgcgatatgcctgctgcggggtgaacacaccgccgatgccggcgatggcgaaacgctcgccgtattcacggtagacctgcgcgatgcgctcctcgctggccaccgtgcacgggccgccggacaggccgccctcccactgctgcggaatctccaggccggtgcggtccttctggaggttggcgatgctcagcccctgcacgttgtgctcggcaagcacgtcgagcaggtccttgaactcgggccacgtcttgttgagcggcatcttgaccagcgtcggctgcgggcgttcgatcttgtcgagctcggtgaacaggcggtcgagcgcgtccgggtcggcggtgaacggctcgccggcatgggtgttcgggcatgacacgttgacctcgaccatggcgctgcgtccggccgcgcggcgcatggagatgcagtagtcctcgatgccttcgtccaggtcgccgcacttgtcgtcgttggtgcgtgcgatggagacggacacctgcatcgtcttcgcgttcgtccacgcctgctccgcgcggtcgatcaccttgtcggacccgtcgttggcaaggcccacgtgcaccatcatcgaatcgtattccggaagacggtggaaccacggcttcggattgccggcgctggcgcgggaggtcgtggagccgaccgtctcgaagccgaagccgacgttgtccatgagcaccggcatgtcgcagttcttgtcgaggccggcggacaggccgaacgggttggcgaagtcgacgcccatcactgtggtctccagcacggggtcggtgtagtcgagcatctcgcgaagcagccacatgagcggcgggatgcgtttggtgacgttgcagaactcgatcatctggtcgtgcgccacatcgggggtgtggttgaagacgaaattgggtttgatgatgttcttgtaaccgaaagtgaacaggtcggtggttgctttgttcaccgcgtcgtgccagaagttttccgaaacataagccatgccctccattgtgtcacgcacgcgaaaaaacggcaacgatgcggttgcgtgggtgcggtcggatccggcgggtgggggagagtgcggtaaaagtgatgttttgttcgtttttatggaagtaatgtgcgcaacacgcatgtcaaacattacgaaatgcacatattggtttggtttatgcgcgaacatgtgcgataatgttcacatgatatcctcacaacgtcaacatctgatactgagccgtctgcgtacgcgcggcgcagtgcgcatcacggcgttgtctaaggagctcggcgtttccgcgatgaccattcgacgtgacatcgccgatctctctgacaaaggtctgctgaaacgcgtgcatggcggtgccgtcagcaccagcgcattgctcagcgagccgctgttctctgtaaagtcgcagatggacattggtctcaaggacgccatcgcacgtgaagcggtgcaatatgtggcccccggcgatgtgatcgccataggaggcggcaccacggcctacgtgttcgcgcagcatctgctggaaagccagcaggcgtcgggcatcaccatcctcaccaactcgattccggtcgccgagctcgtgcaggcgttggaatccaaggatgtggaggtgatcgtaacgggcggcgtcaccacgcggtcgaactcgctggtcgggccgatcgccgacaaggtcatcgcgtcgctgcgcgtcaacaccgtgtttctcggcacccattccgtgtcgattccccgtggcttcctcatgccgaactcgctggaggcggccaccgacatggcgatgatgggcatcgccgaccgtacggtcatcctgaccgaccacaccaagtggagctgtacatcactatcgttgttcgcccggttcgaccaggtggacacggtcatcaccgacgatggcctcgaccacgagtccatcgccaagacaagggatttggtaaaggaactcgttctggcgcaccagagcgaacacaccgaagaaagtgagtgacaccatggcagaaatcaccaactacaccccgggagagtatgcgaaggagcatatccgcatcacaccgaccacgctggccgacggacgcgacttcttctatctcgacgacgatccggaatacgtctccggcgccaagacccgcgagctcaaggacccgcgcccgctggactaccgcttcgccccgcacctggacgccgacggcaacgaagtgccgtacgccgccccgcagatgcgccgcgacccgctgaccggcgactggatcccgatggccaccgcccgcatgaaccgcccgatcaccgccggccccggcgccaccgccaagggcaacccgctggccgcgcgcaagcccggcgacccgtaccaggacggcgaggtgccggacaccgactacaacgtcgtcgtgttcgagaaccgtttcccgtcgatggtgcgtgtgcccggtgtctccgaagacgtcacctacgtcgacggcaacccgctgtgggagaagaagctcgccgccggccgctgcgaggtcatctgcttcgacccgaacgaggacggcctgccggccgacctgccggtgtcccgcctgcgcacggttgttgaggcatgggccttccgtaccgccgagatctccaagatggaaggcatcgagcagatcttcccgttcgagaaccacggtgccgagatcggcgtctccctcgcccacccgcacggacaggtctactgctacccgttcatcgccccgaagatggagaaggaactccagcacaccgaggcctaccacgagaagaccggcggcaacctgctcaaggacatcatgaacgccgagctcgaagccgaggagcgcgtcgtgatgcgcaaccacagctgggtcgcctacgtgccggccgccgcccgctggccccttgaggttcatgtggctccggtgcgcgacgtgctcaccctcgaccagctcaacgaccaggagcgctgggacctcgcctcgatgtactcgcaccttctgaagcgcggcaacgctttcttcgacaagggcgacggcaagggcatggacctgccgtacatcgccgcctggcaccaggccccgatccacgacgcgcgtcgcgagaactaccgcctgaacctgcagttcttctcgttccgccgtgccgccaacaagatcaagtacctcgccggctccgagtccggcatggccgcctggatctccgacaccaccccggagctcatcgccaagcgcttccatgagcttggacagatcgacatctccgactgacaacgttctatgggggagtctggccgaaccgggctccccctagcaatatccactgcatatatagccatcacacagaagaaagagcaccaatgactgctgttgaattcattgagccgttgtcccgcgaggatggtgtctcacgggcgacaaagctgttcgtcgatacgtatgccaccgcgcccgagggcgtgtgggccgctcccggccgcgtgaacctgatcggcgagcacaccgattacaacgcgggcctgtgcctgccgatcgcgctgccgcaccgcacgttcatcgcgctcaagccgcgcgaggacaccaaagtccgcgtcgtctccgacgtggcgcccgacaaggttgccgaggccgacctcgacggcctcaaagcccgtggcgtggacggctggtccgcctacccgaccggcgtggcctgggcccttcgcgaggccggtttctcgcaggtcaagggcttcgacgccgcgttcgtgtcctgcgtgccgctgggatcgggcctgagctcgtccgccgccatgacctgctcgaccgcgctggccctggacgacgtgtatggtctcggctacggctcctccgacgcgggccgcgtgacgctgatcaacgccgcgatcaagtccgagaacgacatggccggcgcctccaccggcggcctcgaccagaacgcctcgatgcgctgcaccgaaggccacgcgctgctgctcgactgccgtccggagctcaccccgctggagaacgtctcccagcaggccttcgacctcgacaagtacggtctggagctgctggtggtcgacacccaggcgccgcaccagctcaacgacggccagtacgcccagcgtcgcgccacctgcgaggaggccgcccgcattctcggtgtcgccaatctgcgcgtcgccgccgatggcatctccaaggccgacgaccagttccaggcgctcaaggagacgctggatgccctgcccgacgtgacgatgaagaagcgcgtgcgccacgtcgtcaccgagatcgagcgcgtgcgctccttcgtgcgtgcgttcgcccagggtgacatcgaggccgccggccgtctgttcaacgcctctcatgattcgctcgccgcggattacgaggtcaccgtgcccgagctggatgtcgcggtggatgtggcccgcaagaatggcgcctacggtgcgcgcatgaccggcggcggcttcggcggctccatcatcgcgctcgtcgacaagggtcgcagccaggaagtcgcgcagaagatcgccgacgagttcgaggctcgtggcttccatgcgccgcgcgccctgccggcggttgccgcgcccagcgccagtcgcgaggcctgattatcgcagcgaacggttctcaataagaaacgtgcgaggattcctcacaaaagcgcacatatgaacaatcggcggaagcccggaattccggacttccgccgattgttttgttcgtttcgcgcgcgatgaggctcgcacctttcttattgagaaccgttcgctgcgacaaccaaaaaagagagcggatttcgccgctcccttttttatctatctcagatcacttctcgtaatcctcgtccttgctttccttgatcaggaacagggcgatcagggcgagcaaggacatcacggcgaggtaccagccgacggactcgacggcgccggtcgacttgaccagtgcggtggagatggccggggcgaacgcaccgccgaggatggcggcgaggttgtagctcaggccggcgccggagtaacgcacgtgagtcgggaacagctcgggcaggtaggcgccgcaggggccgaacaggccgcccatcagcgcgaagccgacgcacaggaacagcatcacggtcaggacgttgtgctgcagggactgcatggcgaacagactgaacaccagcgtcgcgagcgtggtggagatcagcacggtcttgcggccgagcttgtcggagtagatgcaggtcacgaagatgaagatcgcgaagaacaccacggaaaccatctgcatggccaggtattcgttctggctgaagggtggcttcatgaccttgacggcgtagctcagcgaccacgtgcccagcacgtagaacagcgagtatgtgatgcccatggcgaaggtgccgagaagcacttccttccagtatggcagcagcgagcgcagcgggtgcttcaccacgcggtcctgctcgactgccttgcggaagatcggggtctcggtcatgcgcagacgcacgtacaggccgatgatgacgagcactgcggagcacaggaacgggatacgccagccccaggcctgcatggccgtggatccgagcgtggagtcgagcagcaggttcaggccgtaggcgcagaagaagccgatcggggcgccgaggttcgggaaggagccgtacagggcgcgcttgttggccggggcgttctcggtagcgaccagcgcggcaccggaccattcgccggcgaggcccacgccctggcaggcgcggcagatgcacaggatgacgatggacaaggcgcccagctgctcatagccgggcagcaggccgacgacgaacgtggagatacccatcgtcatcagggcgacgaccagtgtggtcttgcggccgatcttgtcgccgaagtggccgaacagcatggagccgaacgggcgggcgaggaacgagacggcgaacgtcaggaacgcgtacatcgtgcccagcgccggattggccttcgatgcggccgggaagaaaatagtgccgaaatagctggcggctgcgatggaatagcagtagttgtcgtagaactcgatggcggtgccgaccatggaggcggcgatgatctcgggaaccgagtccttcttcaccgcgccggccttggacacggccgcggtagcagtagcagacatgaaagtctaacccctctaattcattcaatctctgatacgagccgacgccgcgaccgattgtgcggtgcgtggtcgatatgctcgcgggtagcggggtgcgtgggcgtcgtcgcccgagcttgtggccccagcgatgcgctcacacaccgctgtgcttgatgtaaaggtgtagtcgacttatgaaagcgatggtaatactgctcacattgtggacgattgtctgtttgcgcctggatgatccccgcgtgaacaatgccgacgtcggattcggccgatggcctgcggacacgcccaaatggacggttcggcagtatttcacgcccgctccatatacttgacactacttgcagtaatcggtttcgagcgggggagtcccatgaacaaggcaatcatcaccgtcgtcggccaggacacggtcggcatcatcgcgcgcgtgtgcacgtacctgtccgatcacaaggtcaacgtgctggatatctcacagaccatcatcgacggcttcttcaacatgatgatgatcgtcgactactccggcgcggacaacgagttcggcgtgatcgtcgaggacctggacaagctcggcgagcagatcggcgtgcgcatccgctgccagcgcgaggagatcttcacgaagatgcaccgcgtctgagtctcgaaaggaacgaatcatgctgaatatcatggaggtccgtgagaccaaccagatgatcgagcaggagaagcttgacgtgcgcaccatcacgatgggcatctcgctgcttgactgcgcggcggacagcgtcgacaaggtgtgcgacaacatctacgacaagatcactacctacgccaaggacctggtcgccaccggcgaggcgatcgagcgggactacggcatcccgatcgtcaacaagcgcatcaccgtcaccccgatctcgctggtcggcgcgagctcatgcaagagcgaggacgatttcgtcaagatcgcgcacgcgctcgatcgtgccgccaagaaagtcggcgtcgacctgatcggcggctattccgcactggtgtcgaagtccatgacccccgccgaggagctgctgatccgctcgctgcccaaggcgctgagcgagaccgacatcgtctgctcgtccgtcaacgtcggctccaccaagaccggcatcgacatgaacgccgtcgaactgctcggccacatcatcaaggacatcgccgcgcgcaccgccgacaacgactcctacggatgcgtcaagttcgtcgccttctgcaacgtgcccgacgacaacccgttcatggcgggcggtttccacggcgtgaccgaaggcgatgcggtcatcaacgtcggcgtgtctggccccggcgtggtgtctcgcgcgctcgacgcggcggtcggccgtgatttcgagttcctgtgcgagacaatcaagcgcaccgcgttcaagatcacgcgcgtcggccagctcgtggcgcaggaggcctcgcgccgcctcggcatcccgttcggcatcatcgacctgtcgttggctccgacgcccgcggtcggcgattcggtcggcgaagtgctggagaagatcggcctggagcaggtcggcgctcccggcaccacggcggcgttggcaatgctcaacgaccaggtcaagaagggcggcatcatggcgtcgagctacgtcggcggtctgtccggcgcgttcatccccgtctccgaggacaagaacatgatcgacgcggcggcatccggctgcctgacgctggagaagctggaggccatgacctgcgtgtgctcggtcggccttgacatgatcgccatccccggcgacaccagcgccgccacgatctccggcatgatcgccgacgaggccgccatcggcatggtaaaccagaagaccaccgccgtgcgcgtgatccccgtggcgggcaagggcgttggcgagatggccaacttcggcggtctgatgggctacgctccgatcatgccggtgaaccagacgagctgcgaggcgttcgtgacccgcggcggccgtatcccggccccgatccacagcttcaagaactgacgggctgcgcggcgctcctcggtgagccggtgtcgcagcgatatcgctgagctgatagtgccgatatctcaagcggccgtttccgcatgtgcgcgggaacggccgctttcattattatccccatccaagccgcctgacgttttcttcccctccccgtcgccgattccagcagtggagtactgatgaatatcggcggggaatttgctgggcatcaggttactgtgcatacacttgcagcgtaggggaatagagaaaaacgacgttgaatttatgatgtcggcagaaggcgcatgacgtgcatcagacacaagcatcatccgatttggcctcatccggcatagggcatccgtcccgttctccgctgccgtgccgtccgtgcctccgtgtcgcctgcgccgtctgctgacgggtagtgcggttccgttgctggccgtcggttgtgcgtacctactgattcctgcgttcggccacgcgatttggtatgacggatctattcggtggcgctcacctcgcacgggtggagcggcatatggaatctgggctcgcttgacgtgcatccgatcggctactacatgctgctcaatctggtgcggctcgtgttcggcgaacatgtggtggcgtaccgtctgatgtcggcggcggcatcatgtgcactggtcgtcgccggatacgcgatgagcgccgggactggggagcgcgcgccgcacggctgttcgcggcgttggcgtgcttcgccccgccgttcatgcgcatggcgttccagattcgcatgtactcatgggcggtgctggccgtcgcgatgtgcttcctgttcgcgatgcgcatctgcatcaaggcgcgcggcagtgggcccgtgcgcgtgaacgagtggatcggattcgcgctgttctccctcgccggcgcgtacctgcattactatgcggtgctcgtcgtgaccatcatcaatgcgatcgtgctcgccgtcgtatgcgcacgcgccgtggatcgcgcagatgctgtcgcaggtgcgcagtgtgtcgtcggggtattggattcatttcgagttcccaatgacgttgatccggctgatcgattatccgctgatgggcgagggtgcgcggaacatctatgatccggcgacgatatgcctgccgactatatcgtgaaggccgtcggcgggaacgtgcaccgcaatgccgtcatcgtctcagacagtccccgcatacttggcgtgctcgccgcatccgggcgccgggatattccgctgcgctacgcgttgtggactgaagacgcatggtgggatcagcgggctttgccggcgtatctggaccgggttcgcgtctgccacagctgggatatggccgtgcagtctgataccaggcaagtcgttgtgattcgctcgttgccggccggccctgcgggagaggccagaccgggcaatggcgaggtcaaattgggtggattcatgagaggcctttccggccgcaagagcctgcgcaaacatcgtgtgttcgtgcggccgtatgaccatgagacgtgggccttgtgggtcttcgacgtgcatcggtagatgttgtcgtcacgccgccttgctgactttgccctgtaccaggcgcggctctgacatggtcgtgggctcggctggggttcgcagatggccgggcgtgatttatggagcggtctcgtcctcgattgtgtgccacaccagggcgaaaatgggtgttttgagcctagtgtggcacaatttgtgccacagaatgagatgtaagcgcttagaatccatgtcgtggcagttggctgtttcgcgatattgttggaaaatggccgaaaccgtatgccgtagataattgatgccgaaatcgcctgtgccataccaaggcaaaaatgggtgtttttgccctggtatggcacgcaatccgcgacttgtctcatggatcgagacaagatatatcggatattgattcaagcggtgagtggaatggttgcgctgtttaaaccacgcctccgagggcttcatgccgaccgggaaatgcatcgtgacgtggaaatcgtcatggattgcgaggtataaggggctacacatacgctaacaacgcgtcactgtgcgtgggcagcgtcactgtgcgtgtgcccacgcacagtgacgtaccggcaaacccttgatattgcaatgtttttcaggaatcgtcactgagtgtgcgtccacgcacagtgacgacttccacgcacagtgacgcacttcgtgctcgcgcactgccggcaattgtgattttgcctcgcgaggctcatggtttcctcgctcgcgcctgtcggcgttcgctcggcgtcgctactcggaagcccactgggcttcctccctacgctccgcccttgaaccctagttggcgccaggcttcgtagatggcgatggaggcgcagttggtgaggttcaggctgcgcaggctcgggcgcatcggcagtcgcacctgctcggccacgtgcgggccggccatgatgtccatcgggtcgggaatgtcgcccggctccggcccgaacagcagaatgtcggtcggcttgtactcgacctcggtatacagtttcgtcgcatgtgcggtgaacgcgatgatgcgcgaatccggcatcgactcgaccagattgtcgaagttcggatgcaacaccacgtgagccatgtcatgatagtcaagcccggcacgacgcagcttggtatcgcgaagattgaaccccagcggctccaccagatgcaggatggtgccggtcaccgcacacaggcgaatcgccgacccggtattgccggggatgcgcggactgtaatagcacagatgcggcgtgaccgtctccgtcgcggcagccttctcggccgacagcatcgcgtccacaacgctgatcggattgccgtgcgcgtcggtcaccagctcgtcgggaccataattcgacttgcggtagccgtactcgaacatcttctcgaccttcgcctcggcctcttccgcacccttggtttcgctcatcatcccgccttgtctctgccggttgtcttcgaccttcgagcttaaaacagcccatacccgtaacagctgctcgaaggagagaccatgagacaattattccgccgtatcacgaccatatccgccacatgcgcgttggccgtttcggttgcagccgcagtcgcggtggccgccgaacccaccacaggcaacatacttaccggcaaactgcccacgaccaacagcacgcatctgatcggcgacggcgacaccggattcggcccgaccgacagcaacatcaccaaaatcatcgccggagaagagaacggcagcgcggaaaacaacggatacgccagctgggacgacgtatacctgcaatatgatttcggcgagccgagagagatacactccatcaacctgtaccgcaatgggtatgagaacgcgctgaacacgttcaagcgcatcaaggtcgaagtgtcctccaacgaggacttctccgacgcgaacgtgctgttcggcaccgccgacgtcgaggaaaccgccgcgaccaagctcgccgcgcagaccatcaacctgaccacgcccgtcaccgcgcggtacgtgcgcatctggcagaagggccattgcatccagaacacgaactcctcatggaagggatacagcaacggcgtgggcttgcgcgaaatcgaggtcatcgccaagctcaaggacggcgagaccctgccggacgcgcaggagacgcgcaacatcgcgctcggcaagttgccgtatgtgtacggcctcgccccgaccaacatcgcggcgatcagcgacggcaagcaggacgacaactacgccgtgcacaacagcaccggcgagcggcggctgcagttcgaatacaagaaccgctgccgcatccacgagggctcaagccgggcacctatccgctggcccgcataggcgtgtcgtcgacgcccacgtcggccggcaaggacgtcgacggcatgcattcgcgaccgatgttcccgattctggagacgcaggtcggcgacggctgggtcggcgacatcgactacacgaagcaggacacgaagcaggacagcaatttcctcgtcgactgggtgcgcgtgtaccaatccgaggggcagccggtgacgcgtttcgacgacctggacggcgccgagagcggcgtgtaccggatcgcccccgcctcacggaccgaggggctgaccgcagtgagcaacggcgacgccgcctggcagaacaagaacaacttctactacggcggacagccgcggtatgagaccagccgttcccatgccgtgcccctgatgcagggccgattcgccctgcgcttgcgggcccacaaacactctgccgaatccgggcgaatgcttttacccgcagcgagcgacccgttgcaggtaaggttgtgccgccgaatcggcgaaatcgcgcggcgccgtgatgatgtagcggtcgccgtgcacaatggagcgatgccagagatacggaacgatacgccggccgaacctgtgggcgagtgcgctgtgcctcgcgtgcgggcgctgctgtccgcatggtgggaggccaacgcccgcgacctgccgtggcgattcgggcgcgcgacgccttggggcgtgctggtgagcgaggtgatgagccagcagacccagatgagtcgggtggtgccgtactggactgactggatgcgcgtgtggccggacgtcaccgcgctcgcgggggcctccacggcggaggtcatcaccgcgtgggggcggcttggctacccgcgccgggcgttgcggctgcaggagtgcgcccgcgtggtgttcgagcaataccacggccggcttccgcaaacctacgacgagctgaccgcgttgccgggcatcggcgactacaccgcctcggcggtgctgagcttcgccttcggcgtgcgcatcgcggtggtggacaccaacatccgccgggtgctgtcgcgcgtattcctcggagtcgaatcgcgcgggggagcggccagtccggccgagcgggcgctcgccggcagggtccttccgcaggatgatgagacggacgttcgtgatgccatcgaagccgcgaatgcccgcgagacggtgaatgcccccgaatccgcaatccgcgagatgacacagcgcagcactcgcccgtcggtcatatggaaccagtccgtgatggagctcggcgcgctggtgtgcacggccaagaacccgctgtgtgaccagtgcccgatcggtgagcattgcgcgttcctcgcggcgggccgccccgggctgggagagcgacgcacccgcccgcgccagcgtttccaaggcaccgaccgtcaggtgcgcggcatcatcctcgacgcgctgcgcgctgagccaatcctcgcccgcgaacgcctggaatccctgtggccggatcacgtccagctcgacaaatgcatcgcctccctcgacgacgatggcctggtcgacatgctcccggatggttcgttgcggttaccccaataagtgcgctctcaaaactcgcagatagaggggtttatccccgaaaacccctctatctgcgagttttgagagcgtgcctgaggtagactggacggcatgcccactcagcccacccgtcagccgcgacccggttcgcggcaaaagccgcgcaagcgcgtcgtcagcccgcaacgacgggcgatgtaccgtcgtcgccgtgcggtcgcgctggtcgttgtgctggccgcggtctcgctggtggtgttctgcgtgtacagtctcggccgcggcgtggcggatggcgtgagcctgctgcgtcccacaccgatcgcgcgtgaatcggtgccggcgccgaagaagaccagcggcgtcaatgattgtggcgcgtccgatgtgaagctgtcgctgacggcggcttcccaaggcgttccgatgggaggttccctggacttcacggcgagcatcagctatgaaggcacgtcgagctgcctgctggatctgtcggatgtggtgctgacggtgtcgtccggcgaccagacgatatacagttcggactcctgccccgctgacccgaaccgtcagctgctggcgaagaccagcgacatgaacaggacgtcgcagaagatgatatggggcgcctcccgcacgggggaccagtgcgtggaggatcagagcaaactgccgaaggtggaccgtggcacatataccgcgcagttgagtctgaagaacgcgcccaaggcggtcagcgatccggtcaccatccaggtgcagtgacggtcaggtgtggcgacggccctgagcgggccgctcgccgcgggctcggcggttgccgcgtccggccgcagcgtgcggcgtgtcgcgcatgtgatgtatgttgcgccgacggctgatttgtgctaaaacttggaatttgcgtaagtgcatgtcatatagcgggcatgtcgacaaagatgaaacgcccgcgattcggcatatggtggccatctgcggcgtttccgggaacatatcgataacgacattagcgagcgataaggaacgtccattggctgacactcaagctacgacgaataccaccaccatcatcgcacgcgccgaccagcatgacattgatctgcacaaggcgtcggaccgtgtgaatttcggctccatccgcgagcccatccccgtgccctacctgctgggcgtgcagaccgacagcttcgactggctgatcggcaacgagcgttggaagaagcgcgtcgaggaggacgaggcgaacggcaccgacaccgttccccacatgtccggccttgacgaggtcttcaacgagatctccccgatcgagaacttcgcgcagaccatgagcctgacgttctccgagccgtacttcgaggagccccgccacaccgtgcaggagtgcaaggagaaggactacacctactcggcgccgctgtacgtcaacgccgaattcgagaacggcgacaccggcgagatcaagtcccagaccgtgttcatgggcgactttccgctgcagaccccgcacggcaccttcatcatcggcggcaccgagcgagtgatcgtctcccagctcgtgcgctccccgggcgtctacttcgaccgcagccgggaccgcgccaccggcaaggagatcttcggcgcgaagatcatcccgagccgcggcgcatggctggagttcgagatcgacaagcgtgacgtgctcggcgtgcgtgtcgaccgcaagcgcaagcagtccgcgatcgtcttcctgatggccatcggcatgaccaagcccgagatccgcgatgcgttcgaaggctactcgctcgtgctcgacgcgctggagaaggagaccatcgagacgcaggacgaggccctgaccgacctgtaccgcaagatccgcccgtccgacaccgccaccccggaggccggacgcaacctgctcgactccttctacttcaacaccaagcgctacgacctggcccgcgtcggccgctacaagatcgaccgcaagcttggcctggagcacgagatcaacgaccgctccctgagccgcgacgacatcatcgccaccctgaagtacctggtcaccctgcacgacggcggcaagaccttcccgggcaagcgcaacggcgaggatgtcgacctgcacgtggacgtggacgatatcgatcacttcggaaaccgtcgtatccgccaggtcggcgagctgatccagaaccagctgcgcaccggcctgagccgtatggagcgcgtcgtgcgcgagcgcatgaccacgcaggacgccgaggccatcaccccgcagtccctgatcaacatccgccccgtgaacgcgaccatcaaggagttcttcggaacctcccagctgtcccagttcatggaccagaacaacccgctggccggcgtgaccaacaagcgccgtctgtccgccctgggccccggcggcctgtcgcgcgaccgcgcatcgatggaagtgcgagacgtgcacgcctcccacttcggccgtatgtgcccgatcgagtcccctgaaggcccgaacatcggtctgatcggctcgctggcgacgttcggccgcgtgaacccgttcggtttcatcgaaacgccgtatcgcaaggtcgtcgacggccagatcaccgatgaagtggtgcacatgaccgctgatcaggaagtcggccacgtcatcgcccaggtgaaccaggagatcgacgagaacggtcggttcgtcaacagccaggcccttgcccgtaaggacgaggaagaggcggtcgatgtcccggtcagcgaagtcgacctgatggacgtgtcgccgcgtcagatggtctcgatcggctcctccctgatcccgttcctggagcacgacgagggccaccgagcgctgatgggtaccaacatgcagcgtcaggccgtgccgctgatcgagtccgagcgcccgctggtgggcaccggctccgaatggcgcgtcgcctacgattccggtgacgtcatcatcgccgacaagccgggcgtggtcacctacgtgtccgccgacatcatccgcgtgatgaacgacgacggcaccaccagctcctacaagctgtccaagttccagcgttccaaccagaccacctgctacaaccagcgcccgatcatcaaggacggcgagcgcgtcgaggccggcaccgtgctggctgacggccctgccatccagaagggtgacctggccctcggcaagaacctgctcatcgcgttcatgccgtggaacggctacaactacgaggacgccgtgatcatctcgcagcgcctcgtgcaggacgacaccctgagctccatccacatcgaggagtacgagatcgatgcccgcgagaccaagctgggcgccgaggagatcacccgcgatctgccgaacgtcggcgaggacgcggtggccaacctcgacgagcgaggcatcatccgcatcggcgccgaggtcgaggccggcgacatcctcgtcggcaaggtcactccgaagggcgagaccgagctgaccccggaggagcgcctgctgcgcgccatcttcggagagaagtcccgcgaggtgcgcgacacgtcgctgcgcgtgccccacggcgagaccggtactgtcatcgcggtcaaggagatcacccgcgaggacgccgaggaggacggcgacgagctgcccaacggcgtcaaccagatgatccgcgtgtacatcgcgcaacaccgcaagatcaccgtgggcgacaagctgtccggccgccacggcaacaagggctgcatctcgcgcatcctgcccgaggaggacatgccgttcctggcggacggcaccccggtcgacatcatgctcaacccgctgggcgtgccttcgcgaatgaacctcggccaggtgctggaactgcacctcggctggatcgcgcactccggctgggacatcagcctcgaccccgatctggaggccgagtggaagaagtacgtgcccaagggcgccgaaaagggcgctccgaacacgccggtcgccacgcccgtcttcgacggcgtgcgccccgacgtcatcaagggcctgctcaagtccaccctgccgaaccgcgacggcgaccagatggtcggcgaggacggcaaggcgcgcctgttcgacggtcgcaccggcgaaccgttcccgaagccgatctccgtgggctacatgtacatgctgaagctgcaccacttggtcgacgacaagatccacgcccgttccaccggcccatactcgatgatcacccagcagccgctgggcggtaaggctcagttcggtggccagcgcttcggcgagatggaggtgtgggcccttgaggcctacggtgccgcctacacgctgcacgagatgatgaccaccaagtccgacgacgtggacggccgcgtgcgcgtctacggtgccatcgtcaagggcgagaacctcccgccggcaggcatccccgaatcgttcaaggtgctcctgaaggaaatgcagtccctgtccctgaacgtcgaagtgctcaacgccgaaggcgtcgccatcgacatgaaggacgaggacgacgatccctcctccagcgctgacctgggcttcaacatcggcgcacgccccgacgccgccgccaaggaagaccagaaggccccggaacccgaataccagtgattccccacgggtcgtccggcccgcggccgcgcagcgaacgcgcggcgcggcgggccggacgacccggacgaaacgtgattgaacatcaatttcaaagacaggacaatacagagtgctggacgtcaacgcatttgacaaactgaggatcggcctggccaccgccgacgacatccgcaattggagccacggcgaggtcaagaagccggaaaccattaactaccgtaccctgaagcccgagaaggacggtctgttcggcgagcagatcttcggacccacccgcgactgggagtgcgcctgcggcaagtacaagcgcgtgcgcttcaagggcatcatctgcgaacggtgcggcgtggaggtcaccaagtcccgcgtgcgccgcgagcgcatgggccacatcgagctggccgcccccgtcacccacatctggttcttcaagggcgtgccgagccgtctcggctacctgctggacatcgctccgaaggacctggagaaggtcatctacttcgcggcctacatggtcacgagcgtggatgaggagcagcgccacaacgacctgcccgacctgcaggacgagttcgataccgagatcggcaacatggccaagcgccgtgacaacgagatcgagaaccgcgcccgcaaggtcgaggaggatctcgcccagcttgaggccgaaggcgagggcaggggccccgcacgcaccaagctgcgcaacggcgccgagcgcgacatggccgccatccgccagcgttacgacgatcagatccagcgtctgaacgccgtgttcgaccgcttcaagagcctgaagccgggcgacttggaaggcgacgtggacctgtggcgcgagatgcaggaccgctacggcgactacttcgagggttgtatgggtgcagaagccatccagaagcgcctgcaggacttcgacctggaggccgcctccaagcagctgcgcgaggagatcgactccggctccggccagcgcaaggcccgcgccctcaagcgcctgaaggtcgtcaacgccttcctgaccaccggcaacaagccggaggccatggtgctgaccgtcatcccggtcatcccgccggacctgcgcccgatggtgcagctcgacggtggccgcttcgcgacctccgatctcaacgacctctaccgtcgcgtgatcaaccgcaacaaccgtctgaagcgcctgatcgagctcaacgcgcccgagatcatgctgaacaacgagaagcgcatgctgcaggaagccgttgactccctgttcgacaacggccgccgcggccgtcccgtcaccggcgcctcgaaccgcccgctcaagtccctttcggacatgctcaagggcaagcagggccgcttccgtcagaacctgctgggtaagcgagtcgactactccggccgttccgtgatcgtcgtcggcccgtcgctgcgtatgcaccagtgcggtctgccgaagccgatggcgctggagctgttcaagccgttcgtcatcaagcgtctggtcgacatgaacttcgcgcagaacatgaagagcgccaagcgtctcgtcgaccgcggcgactccgaggtgtggggcgtactcgaagaggtcatatccgagcatcccgtgctgctcaaccgtgcgcctacgctgcaccgtctgggcatccaggcgttcgagccgatcctggtcgaaggcaaggccatccacctgccgccgctcgcctgcgccgcgttcaacgccgacttcgacggcgaccagatggctgtccacctcccgctgagcgccgaggcacaggccgaggcccgctcgctgatgctcgcttccgacaacatcctcaagcccgccgacggccacgtcgtttccatgcctagccaggacatgatcctcggcctgtactacctgacgaccgtcatggacggcgccaagggtcagggccgcgtgttctcctcatacgctgaggcgcagatggcgctcgacctgcacgagatcgacatgcaggccgaagtgctgatccgcctgccgaaggacttcgtgctgccgaccggctgggagccccgcgagatcaccgtcgtggatccggaaccgggcagccccgacgtcgtcaaggaagagcgcttccacgacggcagcgtgctgttcgctacctccatgggccgcatcctcttcaacgagacgctgcccgtcgactacccgttcgtcaacgagcaggccaagaagaagaagctggccaagatcgtcgacgacatctccacccggtactccaccgcccaggtggccgcctcgctggatgcgctcaaggatctcggcttcacccgcgcaccttggtccggcgtgaccttcgcgttctccgacgtcgtcgagccgccggagcgtaacgagctggtcgcccagtccgaggaggaggtcgccaagatcaacgagcagtacgacctcggtttctacaccgaagaggaccgccgccaggcgatcatcgacgtgtggaccaagtgcggtgaggaagtctccaaggccatcgagaagaacttcgacccgaagaacaacctctcgatcatcgtcgagtccggtgcacgaggcaacatgacccagatcaaccagatttccggcgtgcgtggtctggtgaacaacccgaagggcgagatcattccgcgaccggtcgagtcgaactaccgccgcggactgtccgtgctggagtacttcatctccgagcacggcgctcgtaagggtctggccgataccgcactgcgtaccgcagagtctggctacctgacccgtcgtctggtggacgtctcgcaggacgtgattgtgcgcgaggaggattgcggcaccaagcgcggtctgaccatgcgcgtcgccgaccgcgacgagaacggcaacctgacgctcgtcaaggccgccgacggtggcccctactcccgtctgcttgcggccgacgtcatcgacccggccgacggcacgaccgtgctgtacaagcgcgacgacgccctgtcgatggacgtgctcaacgacctggtcgcgcacggcgtcgaagaggtgcaggcgcgttccgtcctgacctgcgagtccaagcgcggcgtgtgcgccaagtgctacggctggtcgctggccaccaacacgctggtggacgtcggcgaggccgtcggcatcgtcgctgcccagtccatcggcgagcctggtactcagctgacgctgcgttccttccactccggtggtgtggccgccgcgtccgatatcacccagggtcttccccgtgtcaccgagcttttcgaagcccgtaccccgaagggtgaggcgccgatcgccgagttcgccggcgtggtcaaggtggagaacaccgatcacggccgtcagatcacgctgacgccggacgacacgagcgtcgaaccgatcgtctacaccgacacccgtcgcgcgccgatgctggtcaagaacggcgatcacgtggccgccggcgaccagctggtcgaaggttccgtcgatccgaagaagatcctgcgcatcctcggcccgcgtgccgcccaggtcaacatcgtgaacgaagtgcacaccgtgtaccgttcccagggtgtggatatccacgacaagcacatcgaggtcatcgtgcaccagatgctgcgccgcgtcaccgtgatcgattccggtgacaccccgctgctgcctggcgagctcgtcgaccaggcgcgcttcaaggccgccaacaaggagaccatcaagaacggtggcaagccggccgccgctcgtccggagctcatgggcatcaccaaggcctcgctggcaaccgactcgtggctgtccgccgcctccttccaggagacgacgcgcgtgctcaccgaagccgccctgagccagaaggtcgatgacctcaagggcctcaaggagaacgtcatcatcggtaagctcatcccggccggtactggcctcgcccgctaccagaacgccgtggtggagcccgacaaggccatccgtgacacgatctacccgaacttcgggctgggcgcggacatggacggctcgcagaccgacttctccgatgccgacctgtccgatgtggacttctccaacatcgacttcggtgacctgaagctcggcgacgacttcaatcctgacgatttcatcgatgatcagggcgggaacgacttcggcgccgactccggcaacgatctcgtctgagtcctagctctgtcctagctctgtgaaagcggggcccggaaccattgcggtggttccgggccccgctttgtcatatgcgaagcgcgggaatgtctacgggagaatgcatagacgcgaaatactctgtgaaacatcccgtgaaacattctgggtgcgtatcgtcgaatcgattgcatccggtcagagtcccgttttccgtcgttggatgggactctcgccggatggtatttcacatgatggacagtgcaatgtcgctactggcgctcggtgagttggaagaactggtctccgatacgcagcgtggcgggggcgtcgagttcgcgcggcttgcccttgagcacctgcgcttcctgcccgtcgcggatgatgtaggtgccgttgagggaaccgtagtcctcgatccacagcgtgccgttctgatcgatgctgatcgcggcatgattgcgcgatgtggtacgcgtcggatcctcgaccttctcggccttggcgccttcgggcacgtccatggacggcttgcgtccgagcagcgtgctcttgtcgatgacgatggtctggccggtggcgtcgttgtgcaggatgtatatcttccgcggcgccttggcggtgaaggacgacgacagcaccgtgctgtcccagtcctcgatatcgccgtcggacgagcccttggccgcatggctggcggtggaggatgagacgggggatggttccgccgctgcggaagagactgcggcaggcttgtctaccggatcgtctgcgtaccagcccagctcgggtgccgggggatagggaatcgttgccatgtcagcggctcctttcactgacgtgtggcgagggcggcgttgaccgcggggtcgttcagctgggcgagccagtcgaccagtgccgggtaggtgctggggttacgcgcgatgcaggggcgcaattccggcgcgtactgcgcgatcttggcgatgagctcctgatctgtggtctccagcgccatctgagccgtgtacccgtatggattggtggcttggggctcctgctgcgccgcgtactgcgccgccgtgtactggtcctgtgacggctgctgctgcgcggccgatgccgcatacgaatctgcggaatattggtccgcgctgtacgaatctgcggaatactggtccgcagcggcggaagcagcggcggagtcggcggcgacatcctgcgccggctgcgcgtcggccacggggccgtcctcggcggtgacgcccatctgtgcaagcgtctgccgcgcgcgctcatcgccgaacgttgccagccaacgcttcaatcccggatagcagcgcgggttcactgccacattagcgccgaattccgggttttcataggcgattttcgccagcaagaccggatcggcattgggatcctgcactgttgcgacggccttgtcataatcaaccatcgtgacctctttccttgatgttcagatttggttggccggtttctggatgcgtatggtgtcaagcgtctcgtcactgaccgtttcgagatcctcctgctgcgcgagcctactggcatgccacaccttctgcccagcatactcgcccgttatgtccagaacaattacggtgacattatccgtaccgcccgcttccagagcgatgcggatcagttcgtcgacggcggtctgcgggtccgcgcatgccgcagcagtggcggcgatggcggcgtcatcgacttcgccgtgcaggccgtccgagcagatgatgaacctgccggtcggtcggaccgcgaagaagtccgggttgatgccgtccgggtcgccgatgcactgggtgatgatgttgcgcgggatgatgacggcatcttccggcagcatctcaccggagtcgatggcctcctgacggcgggagtggtcgcgcgtgatgcgacacagcgtggaggcgtcccactggccgtcgctgtcggcatccatatgatatgtgcgcgagtcgccgatattgatgacgtaccagtccatgtcggggttgatgtcgagcgccacatcgccgggcgcgtcccgttcgattcgccctggcgcgatcagtccggtcaccgtggtgccggacacgccaccgagctcctggccgatggcgagcacgtcggcctgggcgaggtcgatcgtacgcccgatggtcgtgcggctccggctgaaacgtgacgccagtgtctcgaaacgatccaccgcggcgctgctggcccgttgcccgccgacgccgccgcccatgccgtcacagacgaggaacacgccgtcgtcgatgatgaacgaatcctgattggcgcgtcgcctcaggccgatgttgctgtccgctgccacgtgaatttgcatgtcgttcatgactgtcggcctttctgtgaggagggttgccgtgcggatggttgttgcgtggcgggcttctggccagcgggctgttgcgtggaggatttccgcttgacgggccgctgtttggcgggttgccgcccgtctggcttcctcttgtctccgtgccgccatgtacgaatacttgacagtatacgaacgttatggaaaactccgcgcaatgacaggcgggttcgcagcctgcgcatgaaggactgcgaggcgagcatgagcttgcgggtcgtcagtacggaacgccagtaggcgcttgcctgttcgggcgtgaccggctggccggagaacgccgcgtaatcggcttgttgtcccagcgcaatcagtggggcaccgtcgatgttgagctgccgtgcgatggcctgcgcctggtcgcggcgcgtgccggtgacgggtatgccgctctgcccggcgagcgcgtgcacggcctgccagccggaggtgatgcgctgccgcgcgtcgccgtgccggcgcaggcgggccagggcgacggtcttgagtgcgaggatcagcagacagatcagcagcggtatccataccgggctgccgtagatggcgactttcgccgcgatgcgtccgatggtgctccagatggatgccgccggctcatcggtggcatcctcgccggccagcgccgatttgccgtgtgcctgctcctcgtcgcgcagcgggtcggtgagcggcacgggaggctgtcggaccagcgtctgcgggttgggtggggtgaggttctggttgtcgtcgggtatcttcgtctctttaggcgtcggatagaacgcgacccagccgtagccttcgagattgatctccacccatgcttcgatgtcgttgccggtgaatttgacggtcgaggtgccgttgaccgtttcggtgcggtcgttgctgatgtcgccgtcgtcgttcttgggcaggaagcccatgaccacgcgggatggcaggccgagttcgcgggccatcagcgccatggcggaggcatactgctcgctgtcgccgaccatcgcggatccagcgagcagcgcgttgatgcgatagctgccatgtccgggcagcgacggatagtcgccggtcaggccgtgcgagaaccaaccagaatccttgagctgcgcgaccagcgcctgcgcctgcgcgccggccgtgtcctcgccgcccgccaccgacgaggcgaacttgcccactgagtcaggcacgtccttggtgcccggctggttggtgaccgccgcgttggccttggtgatctccttgtcggtgggtgtgggggcgatgatgccgctttccgtataggtcatgccggtggacagcccggccgggatgatggccgactgcgtgctctcgttgtagtagaagagcgtgtggtcggcggaggatcgggattcgccgccgccgtttccgttggcgccaccggtctttcccgctgacgtgacgtcgacgctgctcgccgctcctgccagcggcagccatttgtcgctcagacccttgtcgatggtgaacgtggcggtgaacttcttgccgtccaccgtattggggatgcgggtgccgacgcgtcggtagtcggatgagtccgaggcttcggtggagtcggacaggttccacacgttgccgtcgaactggtccatcaccgcgagcctgaccggcgtgccctcgggcagattcgtgaccgtgagcagcgtgtcatccttgtggtccttgacgtaggagcgcaggccgctgagcgggcttgcgtaatcgtacgggctgagcggcggatcgtagtagtcgcgcaggatcagacgtgactgcccgatgcccatgcatgcgcccacgcccaggccggccgccagcagcaggatgatcgtggcgctgatccagcgtcccagttccagaagttgccatcgccacgacagccagacgatcatgatgaggccgatgagaacgccggaggctatgggctggaaaccggtctgcgtgcccaacagggcgcagaccaccagttcgatggcgatcggcagcaggctcagcacgctgagctgccgtttgtcgccgatggcgaacacgccggcgaggaatgacagccataggcatatcgtccatgccgccatcaggctgccatcgccggaaccggtcggcggcggtacggcgataaggtatttgaacgcgccgaaggtgctgacgaacccctgtgacagcgtttccacagagggaatcacatggctgatggcggtgtcgttcagcgcgatgaccgggccgatgacgccctgcgcaacgatcaggaacacgatctgccaccacaggcgcagcgcgggtgcggtccctgcataggcgatgagggcgccgagcagggtggccggtacagcggcgacggcccacatggcggctgatccgtacacgtcgagaagattggatgcggcaatcagcgacgtcagcgcgatgacggccacgctgatgaggttcgtgccccaggagcggcgtccgacgcgggcgagcggcagacggttgccgccgcgtgtcagccagatcactgaatgggtggattccgcccatgagccggtggtggtgcccgtgccggtcacggtcgagccgagaccggagaacggacgcctggtctgcccgacctggccgggcagggcgtccacggctgacgtggcggagtccgagccgagtgagctgtcgatcacatcgttcatgcgagcacctccatgatgagcggcaggtcgtcaagcgagccgacggtggccagcgtgaagtccgtgaaatgcttgattgcgcgcacgtcgcccggcgaggtctgcagcacgaggcacgtggcggatttcggcagcgcgagcaccatgcgcttgatatggtcgagctgcttgagcgagccgacggtgaagaagtagaacgagctgtcgggcgagtgtcgcagcgtgctctccaccagattcgggttgtcgtcggtccgcggggtgatggcgctgcaatcgtccaggaaccccatcgggaatttcggcgtgtcatgcgcgctgccggcatgcgtctgcagcggacggtcctgtttgaggcactgcacgcccagcgaggcgtgcacgctcacggccatctcgaactcctcttgactgacgtaatcctgcgggttcacgtcgagcgtcatactcgtgtcggtccgccgcgtcgcctcgtactggcggatcatcagcgtgccggtcttcgccgagctgagccagtgcacgttgcgcacgtcgtcgcccggctcgtattcgcgcagcccgtagaagtcgaggtcgtcgtcgacgatctgaccgctgggctggccttccagatcccgtgcgacgccggcgttgagcgtgttgagccgcacgatgttcggatggatatagacggtgatgcgttcggccagcgccttctcgtggcgcaccagcccgaacgggtctcccttgcggatgttcaacggtccgacggtcaggacggcgcgggagacggtggtgaactcgatatcggtctgcttggactggcccggcgccagcatggggatgccgaaccgctcgtgagcctcgcccaacggcaggtcgccgcgtgcggtcgtggtgagggtgcgcccgggattgtcgatgtccacggtcacatggacgtcgtcgccgacggtgacgcggcggcgcgacacggcgatggacgccttgaacccggtattgccaagcgagagcacgatggcgcagaggatcatcatcagcgccaccgcggcgatggcgagcagctcatgccagcgaaccaacgggaatccggccgcgcatacgatgccgatgacgaccacggtccagcccagtggggatatgaacgaggtgaagaatcgcctgaccgcgcgcttgcagcggcgccacaggcgtgccgagctaagccgtcgcctgtgacgcgccgacttgcccgatgcctgttggtctcgctcgttccgtggtttcggcttgcgcggtttccgcggcttctgcggccttgcttcggatgatgaactgtcgttgtgcctgcgcatggaacgcctttcacgcgccgagcgacggcgccggcacggtctccagcatccggctgatggcctcgtccgtcgtcagaccggcgaaggtggcttcggcggtgagcttgatgcggtgcgacagcacggcgaccgccagatccttgacatcgtccggcaccacgtatccgcgcccgtcggaggccgcccagatgcgcgcgcagcgggtcagcgccaacgcgcctcgcatggacgagccgatggcgatgttctcgtcatgacgggtcgcctcgacgatgcgcacgatgtattcgaggatgttgtcgtcgatgtggatgcgctctccgatgccgcgcagcgcgaggatgtcatcgccggcaagcacgggggagacggtctgcgcgcggtcgcggatgttgacctgccgcaggaggtcgacgcttacctgatggccggggtacccgaccgacgtcttgatgaggaaacggtccatctgggcttcgggcagcttgtatgtgccgagctgttcgatcgggttctgcgtggcgatcacgatgaacggctgcggcacgtcgtgtgtgacgccgtccacggtgaccttctgttcctccatgacctccagcagtgcggactgggtcttcggcgaggctcggttgatctcgtcggcgagcacgatggacgcgaacaccgggccctcgcggaactcgaactcgccgtgcttctggtcgtagaaggtgatgccgaccacgtcggacggcagcaggtcgggcgtgaactggatgcgcttgaacgacgcgctgatcgagctcgcgatgcctcgtgccagctgagtcttgccggtgcctgggttgtcttcgagcaggacatggccaccgacgagcagggcggtcaggcatagacggatcggatgtgccttgccgaccacgacggtggagacgttcgcgagcagcgcgtcgaacgcctgcttgaagtaggcgatgtcgtcggcgctggccggggtctgcgggttggtgttcgcggcggccgggttcgcggtcactgggcgcgcggctgccgccacgggagtattcgcggttctggctttgggaaaggcgacgttcggaatcttggccgcgggtgcggtggtcgggtactgtatggagctcagctgcgtcgcatcgagatcgacgccggtcttggtcgggccgttgttcgtggtgttgtcgccggtgtcactgacgggcgagacggcctcgccgtccgtcttgttctgcaccggggactgcgccgacttgttctgtacgctcttggcttgtgacggcttggcttgtgccgactttttgcctcggattgccttgccggcagcagcacctccgcggcgcttcggcaacgtaggaatggccacggtcggtgccccctgcgacttgtcggcctcaccaaccgcggcaccgcccctggcatgcggtgtctcggaaatcacggtgccgtcggacaacaccgtctcatcggagacctcagtcccatcgccgctcgctgatgagatggaccgcgctactgtgctcttttccgcgttgccttccgcggtgtcgtttttctcggctgcgttttccccggcactgtttttcactgtgctcggtgcggctgcattcgtcgtggcctcggcggactgagccgtgttgccggacgacaggacggtcttgtccgacaacaccgtcctgtcggacagttgcgtggcgtcgtcgagttcgttgctctcgctcatcgtgatactccttgatgtgtgtggtggacggtgttgtcgtatcggttgatggatggttgataaatcatggtcggtttgaggccagtgtgctgatggatggcatggaaccgaacgaccggcgtcggatgcggctcgggtctacgccttccgtgaccgttccggatccctctgccggtttgcgcattccttggacttccctgatgtcgtcggcggtgttcagtgcggagtcggcaccggtcacgctgatgtaccaatacagcttttccgtgtcgatcctgaacgatgagatatcgatgtacccttgcttcgaagctgtgctccatgtgacgttccaatcactttcaccggtcggcttgccgctggtagtggagaacgcgacaaggaccgttgccggctgaccgtagaggttcacgctgccgccggacaccgtgatgcggttacggtctgtcgtgctccacgccagcgtaggcggttcgatcttcgctggggtcttgtatacaaggcccttaccgtcaaatatgatggcttcgctggagtgccccttgaacgactgcgtagctgatacagtgccgcaggtttcccacgggttgatgcggtaagttgcggcggctgaatcgccgttgcctctgtactcctgaccgttggcgaaaatggagagtccgtcatgctcgccattaccgccaactgacacggagcactcgttacctttgagcgtcacctgcaggtttttcggaggctgtatcttgtactgcggcgtcaccttgttcgagtcagccgaagctggtttggcgccgctttgctgcgggttcacggtcgccttgacactgagctcctcataccactgatcgcggctgatcgtatcggtgaaggtgtgggtgccgcagggggacgacatggagattgcgccgctcagttccacgctggaacatcccgcgttgtgcatgttgccgagcgtcaacgtggccttcaatgtattgccctttattaccgataggctgaccgtcggcgcgtccgggtcgccccagggcgtcgccgcgttgctggcggcactgggctggccttcgccggcacggttctttcctttgacggtggcggtgtatgaggtgccatcgccggtggcgctgttgtcgattgggaacactagggaattgccggaggtctccttggtgacggaaccgccgcccgaaccggtcagcgtcaccgtgtagctgtccggcttcgtaccgacataatccggaacatcccacttgaccgtcacacgctggtagccggcctcggtggtgaccttcttcggtggatcgggcaccttgtcgggcatggctttgaccgaggtagacggcttcgaccagccgacctcgttcttcgccttgacggtgaacgagtattccttgccgttggtcagcccggtgatctggcaggtggtgaccgcgccgcacgacttgctgccgccgtcccaatcgacctcgtagtcggtgatcgggctgccgttggccgcgcctgcggtccacgagaggttcaccgaaccgtcagccggctgcccggagacaggggagagcagcggcgcgccgggcttgtccaccacggagacggtgatggtggcggtcacctgtcggtcgcgcgaacgggtgccgtcctgcacggtgacgagcacggtgttcgaggatgcgccgatatcggttccggcggtgatgctgatgttgccgttcgaagagcagttcacggtcagcttcgccgaatcgtcggacttgcagctgacggcggtcagcgacgaatccgggaacggattgtaggcgtcggagaacaggtccacccgttcggtcgaaccggccttgagcttcaccgtcttcgcgccgatacgggcaagcgggcggttcgactgcaccacgcgggcggtcatgccggccttgaccgtgccgcccgaatagatgatggtcacggggatgctggccagcgatcccacggtagcgtccttgggggcgctgacggtcaactggccggaggcgctgacgcgcgcggtgatgccgcccgattcgctgccgccggaatatgtgtactgcttctcatcttcgtatgtgccagcgggggagtgggtcagcgcggtcaggtcgatgatcttcgcatcctcacctgccaccacgtcgatcgtggacgacgagaaggtcggcggtggcacttcgcggccgatgaccgtgatcggcagggtcagcactgcggagttgatgatctgcgtcttgtcgttgcccttgccgtccgccgcggtgaacgtgatcgaggcgggaccgctgtaatccttcggcgcggtgaatttcagcgtcgtgtcgttcacgtagaggtcgccgccatccgatttggtggcgctgaccgattcgggggactgcacgtaagcggtcttgccggcgcccacacgcacatagtcggcgatgttgatggtgatggtctcgcgcgagttcaccttcagcggcggcgccttcggacgcagcgtcggcgggaacacgccgtatgcgggcacttggatgaacgcggtggaggtgatgccgtacgtcgtgttcgttaccgtgtacggcaccgaacgggcctcgtcggtcagatccacggagatgacggtcgacttctcgccgcccttgaccttcgcgtggtcggtggcggacgggtcgacgccgaccttcagttcgttcgcggtgccggacgggttggcgatccactgcgagacatcgacctcgacggtccgcttgtcgatggtcgcggcggatggtacgcggtagtcataggcggtgggcggctcgatggtcgcattcgggtcgacgttgaccgtcaacgtcgcggtgtcgctcaggccggccttatcggcgaccgtgtgcatgatgtagaacgttcccgcctggtcgggcgtggtgaacgagatcatgttgtccttcacgctcgccccggagataccctgtgactccagtttcttcgaaacggtcagatcggtgttgtccccggaaatgtcgttgagcgtcaccggcaccgtggccgccgtgtgcgggcgcagcgtgatctcgtcgtcccgcgcgtacacgccggagtcggacgcgccctggaacacgcccaccctgacctgtgcctgtgcgcgctggccggtccaatcctccaccgcgtaggagaacgtgtcggtgcctgacgagtcctcgtacgcctcgtagatcatgtagttcgcgccgacctcggtgatgcgtcccagttgcggggccttgttgcccaggccgagcagctggtcgtcgtcgccgtccacgtcgatgccggtcagtgtaattggtatgcgcactttctgacccgcggccacctgcgcctcgacgtcctgcggagtgggggcggccttgttcttggcgtccttctgatgcacggtgatggtgattgtgccggaggccgagttgccgagattgtccttgacggtgtaggtcaccgggaacacgcccgtctgtttggaagcctgataacgcacggtgtcgccggaaacgaacaccagtcccttgaacgtgtccttgtcgtactgcagcttctgctgcagcgtcaccgtggtgccgtcggaatgcgagacatggtcgagcacgttcaccgacacgatgccgtcggtgcgcacctgcgtgttgacgttcgacgccttgggcgcggagttgccggcggtcagtgccggcggctgcagcactatcgtgccggtggatgagccggccgcgttggcgacggtgtacgtgatctccacgggcttggtcggcacctgccgtgcggtcagatacacgcgcttgtggctcaccaggccggtcttgatgcccagcgacgggtcggcatcgaccgacgtgaccgacagcacgccgcccatcggatccacgtcgttggcgagcggttcgacgatggcggtgttgttcgaaccgagcagcgccacatcgttggctgcgactggcttggcggatttgcccgcggccggctgcacctcaagacgtgcgaggccggtggacgggatggagccttgggtgacggtgtaaggcacgtaatacgtgcccgtggcggtggccttgaatgtgaaggacaggtccgccgcgttcatggtcgcgctggttttcgcgggcggttccacggtggacagctgcgcgggctgcgccgatgtgccatgcacgtacggcttgaggttgaccgtggtctcggtgttcggtgtggtctgcttgaccacggcgtcgatggtcgccggcagcgtgtttgccgggcggatggagaagtacacgagtccggtgccggtgttctgcccgtcggagacggtgacctgcacgcccacttgccccgaggtggcggaaccggtgttgaacacgagctgcccgtctgcgcgggtggagacgacgacctggtcgctgttctgcgggaccgccgacaccaatgtcatcggatcgccgtcgggatcctggaaactgccgagtgcgttcgtcgtgtacgtggcaccctgctccacgtcgtattcgggcggcgtgtcggcctgcttgggagcgtgattggcggacgagccggtcagcgtgaccgtcaccttggccgtcgaggtctggccgcgcccgtcgctgatgtcataggtgaacgtcaccgtgccggccgaggccgccgaggcgtccagctgcaggtaccggccgtcgtacaccggcgatacggtcatatcgccgcccgccggggccccgactttggtgatctgcagcacggagcagtctgtctgctcgtcgttgcgcagcacgtcgaggatctgttgtccgcccgcgcgggcgccgatctcgtcgtcctgcgccttgatctgcccggattgcgcggaacaggtcttgttgaagttgcgctggttgttggcggactggtcgttctgcttctgctgggcggtctgctcggtctggatggtgttccactgtatcttgatgaccttggtggagtccgaagggttccacacgttgccgtcgaccacgtcgttgagtacggtcaggcggtggttggtgcggaacaccaaatccgacgtggtgctgaccgattgcagcgagccgaattccgggttgctgacgttcggcgagcatacacgcacgtaattgttcgcgctttgcgcccacgcggccgacacgcagccgtcggtggagaccggtttggctgcgtctccggcaccgccggaggtgagcgtgttgactttcttctctcccttgcccagttcgaccaggtacaggccgttcttgccggcggccgcgacccaggactcctgacggccgtccgtgtcggggtactgcagcgtcaacgggctgttggcgccggtgtcggcgctgcccttgtgccagtacagtctgccctcggatgtgacgaccgcggtgccgtccaccacggtgaaatcgtcggcggatacggtcttcccttcggtgagggagctaccctgcacggccttgcctgtcggatcctgcatcgtgagcacggtaccgtcggagggccggtatccgtacacggtgccgtcatgggtgaccgcgatcttgcctccggtgcccagccgcatggacgggtcgctggtggcggggttgacggaattgaggtcggagctgcgaccgacccacacgttgccgtttttcgtgttcaggaaggcgatggtgccgccgccggtcaccgcggtcgtgtctcccttggtctccgtcctgccggtggtacccagcgtggcggaggagatgccggtggccttcgcgccttcggtgagcaccgtgtcgctgtcgtgctggacgatgtcgaaacgggctgcagacgaggccaccgccgaatccggttccttgagcttgacgttgaagcgggccgccttgcggttcttgagcgaggtgacccaaacggtgccgtcgtcgagatgcacgtgttggcgggtgatggagctcacccagatggcgccggcgatgatgccgatcagcatgacgagcgcgatgacgggcatcgcccaacggtgcgcgtcaggcgagaccaggcggcgcatggaggagcggaacgcccgctcgcgttggcgctggttaggctgcttgctcatggcatcctcttctctctcgtttgctcgcttctcgtgcaatgccgtgccgcatggtgcagtccttcatatagtgcgttcctattgcctcaccgcgcatgcgatggccggatcctgggacatctgcttgtcgctgcgcacgatcttcacttcgatgcaggtctgtttgtcggtcacgtcatgcagctcgactttgcggtcggccacgatgttggtgctggtactggggccggaagtggcagaattgccctgtaccggcgaccatgcgtacatgtcgccgtccttgggctgcgggttcgtccaggtgaacgtgacggtggtgccgtcgtaggttccgttcaggttttcgagcgtcggcaccacttcggctcccgtgatgtcgtcgggattgccgtccgttccgttggagtcgccggtggcgcccggcgtggagaccgatgtgcggttgcgcgtcgcggtgtcatccatgtgcggcattacgacgaagacgaacgtcaggacgaccgccgtcagcgcagccacgaccacggccgtgatggacagcggcttcttccacgcaccggtgggagcgtccattcgcgtcacgttcgcggggccgggcgcgacgcggcgcttgccggtcatgctgctgggatattcggggacgccttccacggtgacgggcgtggcatggccgtagtaagcctgttgcacctgctgcatcgcgcgggcgaattccagcgccgtgccgtaacggttgtccgggttcttgtcgagccccctgacgagtacacgttcgacgtccgcgggcacatcagggcggccgattggcggcaggcggcgactgacgatgacctgcgcgagttcctgctgcgtatgcgcctgataaccatgctcatacggcgaacggccggtcagtgtggcgtacagggtcgccgccaaggagtagatgtcggcggcttcggtgccgccgctgcgtccggtcagcacttccggcgcggcccatggcacggagaaaccggtctgggttcccgcctgatacacattcgtggagatgccgaaatcggcgagcaccggcagtccctgcggggtgatgaggatgttcgcgggcttgatgtcgcggtgcaggatgcctttgcagtgcgcggtgaacagggcgctgcaaagtttgatgcccaggtcgagcatctggtcggcggtgagtggtcgcttgcggatcagctccttataggagccgccgggcgcgtattccagcacgatgtagccaagtccggtgctggtcacgccggcgtcgtggatggaaaggatgtaggggtgcgcggaaagctccgccatgtagttcgcctcattgcggaatcgggcggctgcgcgggggtcgagggtggcgctgctgaccttgatggcgacgtcgcggctggggacgcgctgatggtaccggtatacgctggctgtggcgccggtgccgagtggctggatgaaatcatagccggatatccgcggcggtgttggctgtgccggcatttggctatccccccttacgacatctcttcttcttactctattccgaggtgttcccacgcacaacccttgatggggagcgctgaggagtgctcgccgcaggcaggagctgccgtgcgatgacgcagttagtccagaataaaactgatataaaaaacggaacatatggttcggttttcgattgttggcatatgatggaggaactgtctgacggacgacggggccggcgacgggaatggaggtgccatgaaggcggttgaagcactgcttgagggggaatccggcaaggcgctgctggtggttggtgctccttgcgtgggcaagagcacgctggcccgtgatgccttgatggccgggctgcgacggttcggcgaatccggagcgataatgacggtatccgggcgtcagatcgccgatgtgataggcgatcaggtgattcgcgagctgggggcgacctcccaggcgcgaccggtcacgacgctgtcggccatcgcgttccggctgatcaccgtcatgcgttcgaggtcgggcgagccgctgccgaggttgctgaacggcgccgagcaggatgcgctgctgcgttcggtgtgctccgtccatgtggctcatgtgcgggcgggggatccatgcggcacgtgctcgttgctgcgcgaatactacgccagggatgattgggacggcgtgctggccgatgccgtggccgggaacgacggcgagggtggtgatgcggattccggcgtaggcgtcaatgccgccttcgtcatgcagctgcgcgacatgttggcccgcatggatgagctgggcgtctccgaggatcgtgaaggaacggccctgtcggcgttgaggcattggtcgccgcgcgtcgagcgtttgcatgtgcagtggcgtctcgcgttcgcgttgcgccgcgaatacgagaccgcggtgagtcgtatgtacccgggcgagtatcggttggactcgtcgcgtctgctggtcgagggggccaaggcggtcgggatggtcggcgatgacgatctgccgcgtctgctggtcgtcgatgactgtcaggacctcaccttcgccgggttcacgttcctgaaggcgctgcgcggtgcggggacgcggctgctgctggtcggcaatccggacgaggccgtgcagacattccgcgggtcatatccggaatacctgttcgaccagattcgtcgtcagcttggcgccgacatggttcgtctgccggctggcggtgccggaaatggccgagttgaggagcgtgcggtggaccacgtcgacggtcatacgtatcgcgatctggtcgcatcccgtatctccctgtccatccgatccacgcaggacgagacggttcctctgccgcagaggccgggcaaattgccgcagctgccggcgagtctgccgattgtcgcattgccccaggccgatccgctgccgggcgatggcagtctgaaaaccgcgctgtaccgctcggccgacgaagagacggaagacgtcgtatggcgcatcaagcaagcccacatccttgaaggacgcaactggaacgacatggctgtcatcgcgcacgacaacgccaccgtgcgcacgatcggcgaacggctgcgtcatgacggcgtgcctgtacggtattcatcggtcacacgaccgttgaaggacgagccgttcgtgcagggattgttcgcgctgctcgaattggcgatgctcaggaaccagacggtgcccgcgctgggcatgaatctgcagcagaccgcactgtatgtgcgctctcgggttgccacggtgatgggatgcccgctggtcagcgtcggcggcggacgggatcatgagggatacccggccaggctggagccggtggacgccgccatgaacgcgttggcatcactcggcaagatcgtcacgtgcgaggacatatgcaagggggatgcgtccgacgatgtgcctggcggtgccgccgacgatgcggggaagaccggggacgctggaattgctggtgacaccgctcgaatgcatgccttgggcaggctcatgcacggatgggagcaatggcgcgaatgggccgtctccgggcgcgatcggaagaccatcaccgacgacacgatcatcgatgtcaaagcaccgcaaggcgacgaactccagttcggcgtcgatgccatgtacctgttgctggaattcgcggatgacgcgcatgcgatgcatggcggtgtcgccggtctaggcggtacaggtgacgttgtcgacgatgccggttccgctgtcggggcgggcacgaagggcgcgtccggtataaccgccgatgacgtgctcgccgccgttcaggaggtgtgcgggcggggagacccgcattcccgcgtgtttgcccacctgtggaatctggtggggacggtggcccaaggcctgagacaactgccggcgaaggaaccacagtatgcgttgtccgtggcttggaacgcgtgcgacgtcgcctcccgttggcagcgcgaggccctgaacaacacggatgccggacgtgccgccaacgaccgtctggatacggccatgcggctgttcgactatgcatccggctcggccgcaagccgggatctgcccgaattctttgcgcaggtgagggcgatgcgcatcgaagcggattccctggccaaagtggcccccatcgacgaggccgtgacgctgaccacgccggcgggctcctcggggagacactggccgttggtgtggattccggccatccagcaaggcatatggccgaacctggcagcccgaaacacgatgttcggtggtgaggatctggctgatgtcatgctgtatggaggactgtccgatgattccggagagcatggcgacaacaaactggaatccgtgctgtatgcggagcagaaaagcctgctggtcgcgctgacccgcgcatcggagcaggtcacggcaagtgcggtgtacaacgacgatctgaccccgtctgacttcctgtacggatacataccggaacgattcaaccgcgaacggcatgcgtcggccgaagggcgggaatatacccaggtcggtgaagccggacggctccaaggtctggacgccgatcctcgcggcctggtcgccgccgcccgcgtggcgctcgccgtacacccacgaggttccaaggaatctcaagatgccgtggatgcgctgcgactgctggcaaacaatggtgtcgaagccgctgacatcacgcgttggccgttcctcgacgaggtcgaggatgcgtcttccggctcccgcacggtgggatcgcgggcggcggctccggaaccggacaaggccgcggagggaaccggccaatcatcggtgccgcggatcgcaacattgtcgccatccgccgtggacagcatctggggatgtcccgtctgttggatgatggaaaaccggttcactggtccgcgcgccggcagtgtggcgacctcgttcggctcgctgatccacgccgtcgccgaaaccgccagcaacgagggcctggacgcggcggactggcgcgatgacctgccgattccggaacgcgtcagcacggtacgggaccgtatgatcgccatctatgaggagctgcgcgacgatccgacggccaacaccaacccggccgatcaatacaacgcgacgcgcaaggacaataccgcgcatgacgtactgggccacatcgccagctacttcgtcatgtccaacaccgacgaatacccggtaaacaacgtcaagaacttccagatcggtacattggaaagcgcacaatgcgagcgttcgttcattgcggtattcagcttggacgacattcttgccgcctataacgcgatggacggcgtcgacccgatcggccgcgatgaactcgccgccatcatgggatcgctggttggcgggtggcccgaagccatgaacgaccggctgaccgtgcgtctgtccgggcgcatcgaccgtatggagaccagaatcatgcccgacgggaagcgtcacgttcgcctgatcgactacaagaccgggaaggtgccttcgaccaaggccatattcaacgatcttcagctggtctgctaccaactgggactcgcattcccggaaaacgggccgcgcggagccgaagcgctgcaagtcatgccggacatcgcgcaaagtggtctgttccatgtcgcacagaaggatgcacccgcgacatccggaaccagcaacgcgcaggagggaatgtaccagccggcgctgttcgccgatggcagtctgaacacgtcatcgttcatgccgcggaaccgctacaagaccctcgataagctttcggatgctcccgatttgattgaagagcctccgaccggtgtaagcgcagcggcatggcgacagttcctcggcatgcgcggcacgcaggccgtatggtcgctctccatgatcgcgagagtgttctacgccgccgcggcgagtcggtcgacccatatacaggcaaggccgaaaccggatcatctccagtattgccgcatgaaagcggcatgcccggcatgcgccggcgaaatcaacaccgtcttcgaaacgaggcagtcatgaacgcaccacgatttaccgacagccccgagcaggcaaaagtcgtcaacgcgcccaccggcgatgacgtgctcgtcgtggccggagcgggcagcggcaagacctatacgatgacccgccgcatcatcaacctcatcgcacagggcgtgccggccgagcgcatcctcggcctcacattcacgcgcaaggccgcgtcggaactgctgtcgcgcgtgtccgccgccgtgctggcggacgggggagacgagcgctttgcgaaccgggcgttcctcaagccggaggtgtcgacgtacgatgcgttcttccagaccatcgtgcggcaatacggcctgcttgtcggcttcgaccagaacacgcagccgctcagccaggccggtgccatacagctggcgaccaccgttgtcggccgtcacatggacatcctcttcgagcaggatctcggggcgttcaagaccgtggtgaatggggtactggggttgtcgcatgccataggcaacgccatgatcggtggcagcacaacaacgatggacgaggccatcggccgtgtgcgggcttgggaccaggcattcctcgcgcaactcgatatcgccattggcgatacgccggttcctgacgaagcgccgaaggccaaggttccgacaaaaaacaagaaggacacggaggagaccttcgcggccaaacaggaggaataccgggcgcaacttcgtgacatatgcgtgtacaagtgtgcacagctgcgcgacgtgacccggcgtcgggagacgctgctgacgctcgtcgaggaatacgagcaggaaaagcgggttcagaacatggcggaattcagcgatttcaccattgccgcctaccagctcgtcgcgcgattcccctccatcggggagcggtaccgtcgccgttacacgcatgtgctgcttgacgaataccaggacacctccaccacgcaggcgatgctcctcgccaccctgttccacccccagtcggctgatgccgatgctgataggtcttcctcccgctggcgggaggcggcgcgcagcgccggagggtggtccaaggatggcgtcgggctgtcgcgatccgcggtgaacgcggtgggagacccgttccagtcgatctatgcgtggcgtggtgccagtcccggagcgttccgcatgttccaaaaggacttcggcatgccctccgacgcgaaaccatacccgctcagcgtcacgcgacgcaacacctgcatcgtgctcagagccgccaacaacctcaccgagccgctgcgcataccgccacggcgggccggcagctccctgatgcgcgaagtggacgtcgcgaacctgtccgcgatggacaacgccgcggaaggtacgatcggcgtgctgggatttgccaccttcggccaggaagccgatgccgtggcacgcttcgccaaacaggccatcgcacggtaccggaaggacgacgccgccacggccgcctccgataccccgcatgtggcggtgctgttccgaggcaagacgcacatggcgcaattcgcccaagaactcgaacgggcgggcctgacgacgttggtcgtcggctactccgcgctgctggagaggccggaggtccaggatctgatcgcattgctgcatgcgaccgccgaccacaccgattcagcgtcgttgatgaggctgctggctacgccgcgattcggtttgggatccgaatcgctcacccgcctcgccggcatggccgaagatctcgacagccaatgccgctaccgtgcactggtcgaatccggcatcataggttcaggttccgatggcgctcgtgccgatgatggtcatgatgaggcaatagtctccacgtccattgattccggtctcgtttcggaagcggatggcggctccgacatcgcgacgttcgccgactcgcaggtgaaggccatcgttaagcaataccgggatcgagtgccgcatgcagtgttcctcatcgacatgatgatgcgggatgacctgccgtcgctgctgtcgcgtcgcggcggattcgacgagacgacatcacgccgtatcatacaggcgggcgaagtactgcagcgtgtgcatgccgtgactaatcacccgctgaaggaagtgattgacgccgcggtgcgggccttgaacctcgacatcgacacaatcgtcgcccaggcggtcaaaaacccctcccagccggtgaaccccacgcaggcgcgttcgcctctgcagtcggtcgccgcactggtcgacacctatacgcaggaaatcgtcgaaggcgtgaatccgactttacgtggattcatgtcatgggttgactcgcttggccagatagaggaggataccgcggcggtgcccgacactcctgcggacgtggtgctgatgaccatccatcaggccaagggattggaatgggacgccgtcgccgtggtgtccatgcaatcaggagtgttccccagcaatcagggcggtttgcatgtcgagctggacgcggagcatcccggcggcggtgccggcgaatcgtggactcccccggaatataaggcgacggttcgttcatgggcggacgacccggccgcggtacctgcgcccgtgcgcgtcgacgccggtatcctgccacgtttcccgcacgacgcgaatccggatgacgccccggtcgaaacgctgcgtgccctggacgatgtcgaagtcatcgacgacgagttctacggagacctgcgcagcaaggacatcggagacgatatggatgtcgccgacccgtccagctggtatctcacccaggaagaggaatatggccgacgtctgctggctgacgaacggcgactcgcatatgtggcgctgacacgggccaagaaagacgcgctgctcacctacagccagtattcgattctggatcgagacccgagccagtacctgaaccgtcccggcaaaagaccgagcgcctcgaagccgtcggtattctggacggagatgcaggactcgctatgccatgagagcggtctggtatccgcgtgcaagagcgggagcgcgggatactccgagaatgcggatgccattgccgacagtagccctgacttggcggtggccggtgcggcatcaggtgcgtctgcgcacccgtcgctggaccagctgggtgtggacaggccacaggggttcttcgtcggcgaccacgccaccgaatatgagcgggatgtcgtcgaagaggcgtggaacgccccattggaggaacgcgaacagggcggcggcccgacatggccggccaagttgtccgaggaaaccctgtcgaagctcaccggcgggatgtccggcgattccgtgcttgtgaccgacgatccggactccctgctggcacgcgcccgaatgctcgttgaagaccccgatctgatgccatggtccttcggccgaggcgagcgcgagatcgaccgctatgtccgccgtcaggcggagcacctgctggagcacggacggcagaacgtcaccgcgttgcaggcgagagcggggcatatgacccagcgcgaggaacgcggctattggcgtggcctgatccggcccatcccgcgcgtcgcatcccccgccgctgaggcgggcaccctgttccacgcatgggcggaacaattcatcaacgcctacggcgacggccaatcaatagatgcagacggcatcggcgcatacgattccagcagcatcgaaaccggtacggccggcacctgccgcgagccggtgacccgcgaatccctgctgcacgatctgtccgaactggaaatgaaatccgacacactgacggcgaaggaacgacagctcaccgtatggcagcgtcgactcgccgaatcgacgtggtcggagcgtcgcccggcgtgggcggaacgccagatcgtcgtgtcgattccccagctcggtgacgtcatcgtcaacggcaaactcgatgcggtgttccacggcggactggacgcgaacgatccgacgaagcaatacaccatcgtcgactggaagaccgggcgcaagccacgcaagccgcaggacatcgaacacaagctcgtgcagctcgactggtatcggctgctgctgtcgtacatcgagcacgtgccgctggacagaatcgacgccaccctctactatctgagtgagcctgatgaaggcgcgcgcgagctgcacgcccgcgcgaaaaccgaacaagagatcctagccgagttgagctccggcattcccgaaggatccgacaatgactaggtgaccgccaagggggcggcacacgctgcggatggaacgcgccgcagccgtcatgccgggagggatgccgcgacccttggcgcaccgtgtgggcgggcacacgtgccggacgcaacaaccacaaaggagcagaaccatggttgcacacgacaacaccgtcatgaatgccaccatcaccaatgccacgccatccgccgatgacgagagcgccctcccggagagcacgccgatcgggacggacccacagcgtggcgtcatgtctgacgtcgtgcctgacgttacgccggaggaggtgccgtgcaccacaatcgcatctacgccggcaacggcaacagtgcccgccgaggagatgaaaccatcgcaatcggtgacctaccggcccatgcgttggaatgatctggacgacatcgtccgggagttcgaccgcacatggggtcagtgcagcgcggccgccggcacgccggtgtccatgcagatatcccggcacttcgtgctgcactacctcgaaccgaccacccgcgccatcatcgccgaactcgacggccgcttcatgggcgtcacactgtcgcgcgtcgccggcgagccattggccttcccgcaagccaagcaggaactcgccgcgatcaacggcgaactgaaccggtcgacgctcggcacgaaaaccctgtccgagaccgagcaatggcatgagatggaactgcgcatggaacgcgaaatcgacatcaacgacgtcgcgcgcggcgagatcgagctgttcctcgtcgcgaaaagcgctcgcggacacggcgtcggcggttcgctctggcggcaggcgatggactatttcgcgaattgccaggtcgcccggttctacctgcacaccgactccagttgcgacgtgagcttctacgaccacaaggggctgaactgcatcgccgcccgatacgcggcggaccatcccgaggatggcgcagacatggacgacatcttcatctacgccggaaccccggagaacactcgatgagcggggctcaacagcagagccgatccgtcgcatcgcagtcgccgtacgcgcaactgttccgcattcccggcgccaaggcgttctgcatctccggagcggtggcccgattgccgatctcgatgatgtcgctgggcatcgtgctcgcgctcaaccacatgtacgacaactggacggtcgccgggtcgatgagcgccatgtacatcctcgccgtcgccgcggtcacgccgttctacgcgcgcctgttcgaccggttcgggcagcggcgtgtcggaccggtggcgcttggcgtgcagatagtggcgatgcttgcgttcgcactggcggcgctcgcccgagtgcccatcccggtgctgttcgcgctggccatatgcatggggctgacccagttctcgttcggcgccctcgtgcgcacccgctgggcgtatgcgctgcgcggttcgcagcacgagtcgctgctcaacaccgcgtatgcgctggaagcggccatcgatgagatcgtattcatcttcggcccgattctggcggcgttcctcgccacctcggtgcacccggtgtcgcagttgttcgtgcccacgctggcctgcggcatcgggggagcggtgttcttctcgctgaagaacaccgtcccgcccgtgttggagccgattgacgtcgtcgccgccgaaataccggacgcgcagtcgaacgccgtcaccggtcagccggctcccgcactccagacggccggagaccatgccgcaccgacgccctcccccgaagacaacggtttccggctgcgtcgtctgcaccggccctattccgccaagccgcgcaatgtactgacgtatcggggcattctgccactgctggtcgtgttcgtggtgttcaacatgagcttcaccgcattcgacgtgtccatgacggccacgatgaaggccgccggcgcggagcggttcctcggcctgcagctcgccatgttcgcggtcggctcctgcatcggggcggtcatcttcggttcccgggagatgaaaggctcgcactggcggcatatggtcatgttcctgacgctgctcaccgtcggctatgtggtgttccgcatggtgatgggcaatttcctgatcctcggcatcatggagatcctgaccggcctgtgcgtctccccgctgttcgctaccggcaacctgatcgtcaaggacatcgtgcctgcgcgctcgctcaccgaaggactgtcgtgggtgaccaccgcaggctcggtcggcacctcgttcggatcgaccatcgccggtgccgtgctggacgcatccagtccgcacatgagcatgatgattccgtggatcgtcaccctgtgcgcggtgccgctcgccctgctcggctggttcctcgcccgaaaacggcgctgacgtccgtcagccatgtacccgccgtggaacgcgatgacgcagaagcgcgtcgccgtgccgtcaacaatcgccttggcatacggcctgcgctcgtacaggctcgcgccggtctgagcacctgagccgacgccgtcaccctcgcccgcgctcctgcgcagatctccagtatctgcgcgaccctgtcgttcacgtccgccttcgtggcaagccggtgttcgagcaacggctcgccgatggaccgcccgatggtcatttgcgggttcagcgcactgtacgggtcttggaagatgtactgcatctgcggacgtatcgtgcgcagttcgcgctgggggagcttgaacaggtcatgtcccttgaacagcacctcgtcgcgctgctcgatggcctgttcgtggcgcgactggtagtcggccatgatacggtcccagttgtcctccgaccacgagcccatctgcactcacggtgtcacctcggaatccgcgcacgtcttgaggacggaggtctttgatgcggatgaccttatctgccattcgacgtttcctttttgacctcgaacgggagtccctgttccctgacgacggccttcaggaagatcgtgaccgcgccggagagggtgagcccgaggtcttcgagcacgcggctggattcctccttgagctgcgggtctatcctcatggtcgtggtgggtatgctcgccatatgcgcctcctatgcttgtcggttgttctgactgtacatcgtatgcacggtgtcatgcggctttccgccaataatccatgtacggtggtgtcatgcgctggcagtcacggcggcggatgcgatacaggcctttgccgagctggcgggcgagcagcccatcatcgtcggtttcgccgaatccgtcgatgaacgcgacgagccattggaaccagtccagataggcttgcaggtatttcgttgacacgccgtggaagccgaacatgaaagcctccaatcgcgcatgcagcgtgttcacgcgggtgatggcgtggtcgcgctcctgtggcgtcagttcgccaagttccttcctgaccctatcggctatacgcgccaccttgcccgttctcataccaccacggtagctacccagtaaccacgctgcaaggcaaaaagtcaaccttggtctaacagggccaaaatttatgaagccgtatcagtgcgttgtggaacggtgcgccgaaccggtcggagccgggatgtgacccagcttacggacaggtggccggaccatgggccggcatgcctatatattggtagggaattttggaaaagttacggacggtttcgctcggaaaggtcgtgtgatggtcagggtttcagtggtcggcgccaaagggcgcatgggatctcatgtggtggatgcggtgaacggtgcgcaggacatgcagctcgccttcgcactcgacgcgggcgatgacctgatgcggatcacgccggagaacaccgatgtcgtggtggagttcaccgtgccgtccgtttcgctcgacaatgtgctcgcgcttgtgaagcggggggtcgacgtggtggtcggcaccaccggttggaccgatgagagactcgccaaggtcacggcggcgctcgccgaggctccccgtgacgatcaggccgtgttcatcgcgcccaacttcgcgatttccgccgtgctggccgattatttcgccaaggtcgccgcgccgtacttcgagtccgcagaggtcatcgagctgcatcatcccaccaaggtggatgcgccctccggaaccgctatccacaccgcccgcgccatcgcggatgcgcgcaaggcggccggcctcggcgccatgccggacgccaccgagacggatggcggctctcgcgggcaggtcgtcgacggcgtgcacgtgcatgccgtgcgtctgcgcgggctcaacgcgcatgaggaggtattgctcggcaatgcgggcgagcagctgaccatccgcgccgacagcttcgaccgcatcagcttcatgcctggcgtgctgctcgccgtgcgcaaggtcgccgacggcggtcatgccggcctgaccgtcggcctcgacaagttcctcgacctgtaaagcgttggcctggcatcccccatccggcgatagtcccgtttggtggggtctggatgggactttggtgggatgaaggagatccgggacgcgttcatattatgtacgggtgacggcgatgcgtccttgctgccaagtacggtaaagagatatgagtgacggtactatgcatcttctcaacccggctccgttcggacgcatcctccccgcaatggtcacccccatgaaagcagatgggacggttgatttcgaggccgcgcagtctctggcgaagcaattggtcgccgacggcgccgacgggttggtggtgaacggcacgaccggcgaatcccccgtgacccacatggaggagaaggtcgagctggtgagggccgtcaaggaggtcgtggatgtcccggtgatctccggtgccggatcgaacgataccgcgcacaccgtgcgcatggtcgagcagacgcaggaggcgggagccgacgcggtgctcgtggttacgccgtactactcgcgccccagccaggacggcgtggtcggccattacaaggccgtcgattccgtggccgagaggccgatcatcgtatatgacgtgcccggccgtaccggactgaaagtccgcgtcgaaacatatgaccgtcttgccgagcttgagcatgtcaaagccgtcaaggacgcgaccggcgacctcgccgccgccgtcgaaaagcagcagcgcaccggcctcgcctggtattcgggtgatgatggcctgttcctgccgttcctgtcgatcggtgccgtgggcatcatctcggtgatcgcgcacgtcgcctcctcgccgatgcgccagctggtcgaggcgttcgaccgcggcgacatccatcaggcgcagcgcctcgccaaccagctcgccccgcttgtccacgcgctcaacggcgacggctaccaggccgtcatggccaaggcctcgctgagaatcaagggctatctttcctccacggccatgcgcctgccgaacatcggcccggacgccgatcaactggccaaggccgaagagggcatgaaagcagcgggactgctctgaccgggccacaccggcctcgctcgggatgcacccggattacggcatcgtccgactccgggaacggccgtcccggtcgcggatgcgaatggcctcggcggacacgggcgagcggttgtagataacgtcgtttccgtgacacagacggaaacaaagaaacagaaaaccaatagagaatggcacaagaacaacaaaagaagaacaattcacgcaggtcccgttccggtggcgcgtcgcgccgccgcggatccgcgaatcgcaacaccagcaacgccggctcgttcaagggccaggccaccgctccccagcaggacgacgtcctgatcgccccgccgaagtaccgcaagggttcgatgcgcatcacgccgctcggcggtctgggcgaaatcggccgcaacatgaacgtaatcgaatacaacggtcacctgctgctcatcgactgcggcgtgctcttccccgaagaggagcagccgggcgtcgacctgattcttcccgatttcagctacatcaagaaccgtctcgacaaggtcgacgcgctcgtgctcactcatggccatgaggaccatatcggcggcgtgccctacctgctcaagctgcgcccggacatcccgctgatcggctccaagctgaccctcgccttcgttgaggcgaaatgccaggagcacaaccagcatcccaccatggtggaggtcaagggacgcgacaagctcaaggtcggcccgttcaacctcgaattcgtcaccgtcacccactcgatccccgacgcgctcgccgtgtacgtcaagacgcccgccggctccctgattgacaccggcgacatcaagctcgaccagctgccgctcgaccacaagatcaccgatctggtggaattcggcaagatcggcgagcagggcgtggatctgctgatgatggactccaccaacgccgaggtgccaggcttcgtcaagccggagacctccatcggacccgcgctcgaccaggcgttcgcgcaggcgagccgcaagatcatcgtcgccagcttctcctcgcacgtgcaccgcgtccagcaggtcgtcgacgtcgcccacaagtacgggcgcaaggtcgtcttcgtcggccgctcgatggtgcgcaacatgtccatcgccgccgacctcggctacctgcacatccccgaaggcaccgtcatcgacctcaagaaggcgcacgatgtgcaggacgacaagctcgtcttcatgtgcaccggttcgcagggtgagccgatggccgccctcggacgcatcgccgacggcaaccaccgcgacatcaccatcaacgagttcgacacggtgatactcgccagctccctgattccaggcaacgagcatggcgtgtacaaggtcatcaacaagctcgtgcagctcggcgcgcgcgtcgtcaaccgcgacaacgcggccgtgcacgtgtccggtcactgcaacgagggcgagctgctgtacatgtacaacatcgtcaagcccaagtgcgcgatgcccatccacggcgagaaccgccacttggtcgccaacggcctgatcgccgtcaagaccggcgtcgatccgaagaacgtggtgctggcggaggatggcgacgtcgtcgacctgtaccacggtcaggccgcggtcgtcggctccgtgccgtgcggctacgtgtacgtggacggcgattcggtcggcgagatcaccgacgaggagcttgagaagcgccgcatcctcggcaccgaaggcttcgtgtccagcttcgtcgtggtcgataccgaggcctccgaagtcgtcaccggcccgaagatcttcctcaacgctgtcgccgaagacgaaagcgagttcgacaagatccgccatcagatcgtcgagcagctgcaggacgcgatgatgcaggggacgaaggacacgcacagactgcagcagatcatgcgccgcacgctcggcggatggatcgcccgacagctgcaccgcaagccgatgatcgttccggtcgtcgccgacatcgcccaggacatcatcgaagaacccagcaagtaaaccgcttcggctcacgcaagtgacgccggcatacgtccagaagcaagcctgaacgtcaacgtctcagcgaggagtagggaaccgcgtgaacggttccttgttcctttttctgtcgcgacggtcccggcttctttcgggaagacatatcagaaggagttagaaaatatgccaggtgcaaaccttacccgcgtggaagccgaggaacgcaagtccatcgtctccgcccccatcagctaccatgtccagcttgatctgacccgggacgcgcgcacgttcggctcgaccacgacgatctgcttcggcgccgagccgggcagcgagacgttcctcgacctgatcgccgacaacgtgaccgagatcatcctgaacgacgaggcgctcgaccccgcgcaggtgttcgaggacaaccgcatcgcgctcaccggcctgcgccgccgcaacgaggtcaccgtcaaggccgactgcgtgtactccaacaccggcgagggcctgcaccgcagcgtggacccgtccgacggcaacatctacctgtactcccagttcgaggtgccggacgcgcgccgcgtgtacgcggtgttcgaccagcccgacctgaaggccacgttcgacttcaccgtgctcgcgccgaagtcgtggatcgtcacgtcgaacatgccggtcaagtccaaggaggacatcgacgacgtcatcaccgcagacggggtgctcggcgaccacgagcccgaatccgcccgcagctggacgttcgagaccacgcctatcatgagctcgtacctgaccgccatctgcgccggtccgtacgccgaatggcacaccacctacctcaacgaggacggccgcaccgtgcctatggcccagtactgccgccaggcgctcgcccccgcgttcgccaaggacgtcgactacctgttcgacatcactaagaagggcttcgcgttctacgccaagacgtggggcgtaccctacccgtacgccaagttcgaccagatctacgtgcccgagtacaacgcgggcgcgatggagaacatcggcatggtcacgatccgcgaccagtacgtgttcgagtcgaaggtcaccgacgcgctcgccgagcgccgcgtggtgaccgtgctgcacgagctcgcccacatgtggttcggcgactacgtgacgatgaaatggtggaacgacctgtggctcaacgagtccttcgccgagttcacctccacgctcgccaccgccgaggccaccgaatggcatgacgcctgggccacgttctgctccggcgagaagagctgggcgctgaaccaggaccagctgagcaccacgcacccgatcgtcgctccgatcaacgacctcaacgacacgtacgtcaacttcgacggcatcacctacgcgaagggcgcctccgtgctcaagcagctcgtgtactacgtcggccgcgagaagttcttccagggcatcaaccagtacctcaacaagtacgcatactccaacgccacgctcgccgacctgctgcacgagctggagaaggcgtccggccgcgatctcaaggcgtggagcgccaagtggttggaggagtccggcatcaacacgatcgccaccgaggtcgaggagaacgcggacggcaccatcgcctcgctcacgctcaaccagaccgcccccgccgagcacccggtgttgcgcccgcatcgcctcgcggtcggcttctacgacgaggatccggccaccggcaagatcgtgcgcaccgaccgcttcgagcttgacgtggacggcgaatccaccgtggtcgccgccgcggccggcaagaagcgccccgcgttcatcctggtgaacgacgatgatctgacatacacgaagctgcgtttcgacgccgattcgctctcgttcgccctggcgaacctgcagcgtttcgatgatgcgctcgcccgcgcggtcgtgtggctgtcgctgtgggacatgacccgtgacggcgatctcgccgccgagaagttcatcgacacgacgctggcgctgctcgccaccgagaccgagtccaccacgttccgttacgcgctgagctgcatgagcaccaccgcgtggcactacaccgcgccggatcgccgcgcggacgtggtcaagcacgtcgccaaggagctgtggaagctcgtcatcgccgctcccggcggatccgaccagcagttccagctcgtcacggcgtacctcggctacggcgaggagggcgacgccgagttcgccgagcacgcgcagggcctcttcgacggctcgctgatcgtggtcggactggagatcgacaacaacttcacgtggacgatcatcaacgcgctctcctcggtgaagctgatcgaccaggccggcatcgacgcgcagctcgccaagcgtgacaccaccgagaaccgcgagttcgcgctcggcgcccacgcggtgcgtggcgacgccgccgcgaaggagtgggcctggaacgaggcgctcaacaacgccgacctgaccaacatgcagctggaggccgtggcccgcgggttcgccgccactccgcgccccgacctggccgagccgtatgccgccaagtactacgacgtggtcgactgggtgtggaagaacaagagcttccacatggccgaggcgctgcttgagggcctgtacccgtactacgctgacccggccacgctggtcgaactcggccatcggtggctcgccgaccatgaggatgccgacaacgccctgaagcgcatcgtgcgcggcaatgtggaatcctcgcagcgcacgctcaaggtgcgcgacttcaacgccgcgctgtaaggcggcgcgaccgacccatacgaaacgcccttcgcgtaacgtgcgcctgcaaggccgccgttcgcgcgaagggcgtttcgcgtgcatgagtatgcaccgacggtgcggcagagtcgtcgttgccgtatcgccgtgttgccgtgattcgttgtacaactcccgcatatcagcgaaacgcagatgttgtgcacctacggcgctgtacaactcccgcagacgggcaaaatatacgtgttgtacagtgacttgaaccgcgaaatcgttgatttcaagccattctcttatcgcgcctaaatatctgccgtcgtacaactcctgcataatgcgtaatcgcggacgttgtccagcgtgatgtaccgtgccgtcacatgccgcgcccctgcgactgcgccgttcactgcccgtataccgaaatgtacgggaaaggggtattgctgaaagcttcatgagagtacactttcggattgtagggggttcatcatgaaactcctcggcgatatcatccaaagacggcgtgagccgggaagggcaggttcatggtttctcgttggtcgagggtgaaggccggatgcgcgttcgcgctggcatgcgtattgccttgcgcgttcacgcccggtgccttcgcggcggatgacgggcgttggccggtggtgaacgacacggtggcttccgcatggaagcagggcattgacggttccggtgtgaaggtggcggtgctggatacgcaggcggtcgaggattaccccgcgttgaaggacgccgacatcacgtacaggctgggccggttctccggtatggacggcaacgaggtcgagtgcaaggtgggcggcaggccgttgaccgcgacgatcaaggccggtgacgatgggtactattcatcgcacggcactgacatgctgtcatggatcgtgggggacggaggcaattacaccttggacaaggcggggatgctgggcgcggcgcccaaggccaggatactgcacatcacgaccatggggacgagcgccaccgcggcgacgacgttgtgcgacgcgaagaagctgggcgatgcgtcgagcgacaatggcgccgatgtcaggacggccgtggattggggagcccgcatcatcaaccggtcccagagcggcggtcttgacgatacggattatgccgggtatgtggatgcgctgcggcacggaatcatcatggtcggagcgcgcgcgaacgacaccacccccggcctggatgatctgaccggcgacccgcgcagcatggagaccttccccggcgtggtgatggtgaacagcgtggacgagtccggcaccctggcttccacctcggacgtcatggacggcaacgtggcggtgctgtcgtacggggcgaacgtgctcaagcccatcaattacgtcgccgaaggcgataaccgcgtgggcaacggcggcacgtcgaccgcggtcgcggtattgtcgtcgtacctggcgctggccatgcagaagtggcccgacgcgacgggcaaccagatcatccagtctttgatacgcaacacgaagagcggcaaaggcaagccggtcatcgacccggagcgcaaacgcgggttcggtgaggtggacctgaacgcgctgctgacggtcgatccgacgcagtacaaggacgtgaacccgattctggaataccagatgaaggccgccgcccaatacccggccctgaaggactggtatacacaggattgcaagacgaacccggacggcgttggcaccgcggcggataatgtcccgtgtgaggccgggctcatcgggcgggagtatgagcgtcagcaggcggcgtggaagaaggtggagcagtgccgatcagacggcggctccgactgcatgaaatactccgccacgaacaccgccgatggtgagaccaataacaccacgacaccgaacgggcaggccaagcccgaaggagacccgtcgcagagcgcttcgtccggcatgccggtgtggctgtggggcgtgatcggcgcaggcgtggccgctatagccgcgggcgtgataatcgccctggtggtgtctcggcggcgtaggacgcgcgcgcggattcccgtatccggtgtggcatatggcagtgttcgatcataccccaacggacccgtgccatcccgcccatattctggtggatcacaggggagtgggggccaggctccgcctgccgaaccgggtgccggaacagccgcctagccagccgcagcagccatatcctcagcaggtcccccggcaaggattcgctccgccgcaaccatacccgccgactgaaccggctcccggagttccagcccctgacaaccatggtggcaatggaaactccggcggacatggacggcattcagggtaatgaccacagcagagaaggccccaatcggccccttctctcattggcaaatgactcgcgaatctgcttgtattctctcacatgcctttctccgaaactggcaattgcgcgtgatttgggcagtattcatggatatgggtgcaatcactccgccggccggttacgatggtgctcggtatgtcgaagagacggcggaagccgtcgaagcaaaggaatcgcagattatgccgagattgtttggaaccgatggcgttcgtggattggcgaacagggatttgaccgcgcgtctggcgcttgatctgggggatgccgccgtgcgcgtgctgggcaacagtgccgtcagggaaggcctgccggagggccgccgtcgtgcgctgatcggccgtgatacgcgcgtgtccggtgattttctggcgtccgcgctgtgcgccggcatgtctgctggcggcttcgacgtgatcgacgcgggcatcatccccacgccgggcgtcgcgttcctgacctccgtgctcaacgtcgagatgggcgcggtgatctccgcgtcgcacaaccccatgcccgacaacggcatcaagttcttcgcgcgcggcggtttcaagctgcccgacagcaaggaggacgacatcgaggccgtgctcggtcaggactgggaccgtccgaccggcgcgggcgtcggccgcgtctcgcatgagacggtgaccgccacgaacctgtacatcgaccatctggtgtcgaccatcgccccgctcaacccggacaagacccagcccaagccgttgcgcggcctgaagatcgtggcggactgcgcgaacggcgccacatcggtggtcgctccggaggcgctgcgccgcgccggcgcggaagtgctggtcatcaacgcctccccggatggatacaacatcaacaagaacgccggttccacgcaccccgagcagctgcaggccatggtcaaggccaccgacgcggtgatgggcgtcgcgttcgacggcgacgccgaccgatgcctcgccgtggatgaggacggcaacatggtcaacggcgatcagatcatgggcatcctggcccgcgccaagaaggaggccggcaagctcgccgacaacacgctcgtcgtcaccgtgatgagcaacctcggactcaagctcgccctcaaggacatgggcatcaagaccgtgcagaccgcggtcggcgaccgctacgtgctggaggagatgctccgcggcggctacacgctcggcggcgagcagtccggccacgtcatcaaccgcgagttcgccaccaccggcgacggcaccctgaccgcgctcaccctgtgcaacgaggtcgtcaaatccggcaagagcctcaagcagctcgccgcggacttcccgcagctgccgcagcagctcgtcaatgtgccgaacgtcgacaagatggccgccaccaccaacgcggcggtgcaggccgccgtcgacaaggagtcgaagctgctcggcgacaccggtcgcgtgctgctgcgtccgtccggcaccgaaccgctcgtacgcgtgatggccgaagccgccacgcagcagcaggccgacgaggtgtgcgaccggctcgccaaagtcgtggccgacgagctcgcgctgtagaacgaataacggcaataccgcaataccaaggaatcattcgtatgttcggaaaaaacacgaaagtcgacctcgaactcaaccgtgaggtcgaacagctcctcaagaccggcggcaaggagcgaatcctgccgattgtgcaggccggcgaaccggtgctgcgccagcagaccgtgcaatactccggccagctgagcaagggcacgctgaacaagctcatcgacacgatgcacacgacgatgctggaagcgccgggagtcggcctggccgccacacagatcggcctggggctcgcgctcgcggtggtcgaggaccacgtgcgcgacgacgaggacgatccgcgcgaaatcgccgaattcccgttccacgtcatcatcaaccccagttatgagccgatcggcgacgcgacccgcagcttctacgaaggctgcctgagcttcgacggatatcaggccgtgcgtaggcgctggctcgacatcaccgcacgctgggccgacgagaacggcaagcagcatgaggagcgtctgcacggttggccggcgcgcattttccagcatgagaccgaccatctgagcggcgaactgtacatcgacaaggccgagattcgcagtctgaccacctacgagaaccttgaggatttctggtgcgacgaccccgtgccgaccgacgccgccgaggaactcggcttcgagctgtaagccggggctgggccgactctggtcgcggctggttacggctaactgctgtacaacttccgcattatcgatatttgcgcgtgttgtcccgcgaaatcaggacgccacacgcgcaaaacgctattatttcgcagaataatcgcggaaaaacgttgcagttaagccgtttttgctaaatcgtgccgatgtgggtcatcgctgccggctggacaactgccgcaaaagtcgataatgcgggagttgtccagccggcgaacgcgaagacccctcacgagccgattgcacacgaaccgtatacgtgctttaggctcggcgatccatcgcggcggacgagcgcgtcacaataccgccgcgagatcggcgcgggcgtcggggaacgtacggcagtagcgttctgcctcggcactcagccgctcgttgacgagcagccgctcgtaaatcggattgcgggcgtagcgtccggatccgtcatcgtacgccgtgacgatgctccgcacctgcccggcccaatcccggccgctgatcgcgcgcagctgtgcgatggtgtgcaggtcggaggggtcgtacgcctcgacgatgcgctcgcggtacatcgccctgagctcgtcccaacgtcccagcgcctcgaatgcggcctcgcgcagggattcccactcatacgcaaccagatcctccgggaacatcaccgtgtactggttcggccggtcgcgctccaccatgtcgatgaagccgatgagctcatcccagcgctccgccgcgataaggcgcgccgcgtaggcatccgccatggcttccgattcgtggtggctcaccaagaagcggtcggcgtcggccgcatcaccgctcacgcgcatcagatcatggcgcaggaacatgatcgattcctcgaactgctggtgcgccgacagcgccaccgtacgcttgatgagttccgaagcgtcggccgtcgagccggtcgcggcctcggcggcgatgacgccatcgtcgtgtgccgtttcgccgtcgcatcgcccgtcctcgtcgattttcgcctccttggcgaaacgatccatcgtgtcaagggcgctgttcagcgcatcataggcgaacatgcgcgtatcgtcccattgcgcgaacgacaggccgcacgacagcagctccaccatctgcgtcgcgttcagctggaaatcctcgttgcaggccacccgcgtgatcagtcgcagcgccttctccccgtcctgcgggtcggcgttgcgcgccacggaatccatgtacacgcgcacgttctggatgagctccttgagatagtcgaagccctcgccgtcccggtccgccgcgttgcccacgaatcgcgcggtcatctcgaccgacttcgccagattcgtggtggcgtcgacccagcgcgtgctcatcagcgcgttgccgaccacggcatccactcccgacaacgcctgcgaatcgatgcggaacgtgggcatgtcgttgcgcggcatggacacgccgtcctcggtgcgttcggcggtcggcacggtggatgagatggagtcgaagtaccattgcatcgtcaacccgatcacgtcggcgacctcgttgggagcggcgacgggcacattgttgcggttgtcgtcgtcctgggcggacgcgtcggagatcatatggttccacaggaacgtgggcccgtcgaaatccgttgatgccagccagctgtcattgacgaaatccacgacgtcgtcgagctgttgccgcggatccacgctgatcgaggtggttgagccatccatgattctgcctccctggttccgctccgtggttgcaagcgtacgtgtagtctatcgcgattgacgctccgacgtcggcaatggcggataatggagaccgtgagcgaacaaagcgtaaaccatgacgagcggcggcatgcggcgaaaggcgccggcgatgagatgacggctgcggggaaggccgagggaaaggccgcgaggaagaccggtggatccggcaaatcgggcgcgaaggccaagcccggcgaacggtatgagcggggcacgcgcagctacacgatgtcgcatatccgcgggaaggacacccgcatcgaagtactcgtgcgccggtacctgttctcgcgggggcttcggttccgcaaaaacgacaggcgctatcccggccatcccgacgtggttctgcccaaatggcatacgatcgtgttcatcaacggatgcttctggcatgcgcatcagggatgttccaagtattccattcccaaatccaacgtggaattctggaccgcgaaactgacccgcaaccatgaccgcgacatcgcgcagcacgccgcgctcgaatccgccggatggcatgtcatcgtcgtctgggagtgcgagctcgccaagcccgtgcgcgaggcgcgtctggaacggctctacaccgagatcaccgcgcctggttccattggcgtccaatgagcttgctggcctcgccaatgcggccggttccgtcaatgcaggcggttccatcgtataattccccgattgccggctccacatccggccatagtcccgtgaacgcccggtgaaacgggattttgccgggagggtggtaggcaattacaatcggtggcagtaccgaatggacggcaaagggtgatgcatgatgagcgagacgaaacagccgacgatgtcacgacgcgcacgcgaggcgcagccgttccgggcaatggtgttcggcgagagggccgacgagatgatcgcccgcagcatcagcgtcatcaagctgagtctgggggagccggatttcggagcgccgcccgccgtgcgcgacgcgatgcgagagcaatatgatggccgcgcgctgccgtacaccgctgcgctgggcctgcccgagctgcgacgcgccatcgccgacttctaccatgaacgccatcatgtcgacatcgacccccgccgcatcgtcatcaccgcaggcgggtctgccgcactgttgctggccaccgcgctcactgtcgaccccggcgacgaggtgatcgtcgctgacccgtcctacccgtgcaaccgcgaactgatccgctccttcgaaggcgtggtggtggacgtgccgaccagcgcggccacccgcttccatctcaacgccgaactggtcgaccgcgcgtggagcgagcgcaccaaggcggtgatggtcacgtcgccgtccaaccccaccggcacgaccatcgacttcgacgtgctcaaaggcgtgtgcgacctggcgcgattccgcggcgcgtggcgcatcatcgacgagacatacctcgacctcgccgaccgggagcccgacggcagcgaggtcaggtccgcgctgctcgccgacccggacgcgatcatctgcaacagcttctccaagttcttcggcatgaccggctggcgtctcggctgggcggtggtgcccgaatacacgatcgaggcggtcgacgatctggcgaccaactattatctatgcgcgcacacgcccacccagcatgctgcgcttgcctgcttcacgcccgaatcgttggcggtgtgcgaggaacgcagacaggagctgctcgcccgccgccgcatcgtcgtaagtggtctggagcgcatcggcctgccgctcgaagtggttccgaacggcgcgttctacgcgtatttcagcgtcgcgggaaccggtttggacgcgtggacgttctgcgagcgtgcgctggaagaggcgcatgtggcgctgactccgggacgggatttcggcccggcgaccgcggacacgcatgtgcggctgtcctacgcggcgtcgcgcgaggcgttgacggaggggctgtcccggctcggaaagttcgtcgcctcgctgcgatgattctccgataaccgcggccggccttgggtggaacaccgcgcgcatgctgcggccgcgccggtgatacagtgagatgctatggtgaatttgcgttcgcgcgtcactcgattgggcgtgcttgacatcggctccaacacgattcatatgctgatcgtcgacgctgcgcccggcgcgcgacccgatcccgaggccagcaccaaatccacggtgcggctgatgcagtatgtcaaggatgacgggtcgatcaagaagtccggcatcgaggcgattctgaccgccgtggatcagtgcatggaacttgccgaggaatacgacatcacgcaattgctcgcgatggccacgtcggccatcaaggaggctcccaacagcaacaagatcctgcgcaagattgaagagcgcatcgaccagagcgtgaccgtgctgtcgggaacggacgaggcccgcctgacgttcctcgccgcccgacgcgttccccaaatccaagcatccggcgcatgccgtgggcacgtcaaagacgttccgctcattggcacgtctggcgggtgcggtgctgcgccagtccgggcgcgaggacacgtggatcatgacgcgcgagcagctggaggactggattccccggcttgcggccatcgagccggagcagcgcgtggcgttgccgggcatcacgccggagcgcgcgatgcagatcgtcggcggcggcatcgtggccgacgagatcatgaggtccctgaacgtgcatgaggtcgagatctgcccgtgggcgttacgcgagggcgcgattctgcgctggctcgatcagttcggccgcacgcggctgggtttctgaccgttgcggtttctgcgcgcagcatctatatgccgcgccggtgacggggcatctactgctccaattgtgccagctgcgtgcgaatcttatgcagtttggcgtaaatctcgttgcgctgggcggggttcttggcacgctgatgatcacgcgacagcttctcttcggcggctttcagcgtgacgatctggtcccggcgggcgattcgcgcgtccagattggctccgtccgcggaatcgagaatcgcctgcgcgcacagcgaatcccacaggtcgtccatcgtcttcgcgccgccgtcggcgttcccttccggtagttccagcgtgacctcgccggccggcctccattcgccggagaacactttcgtgatcggcacatgaccggcacggaccggcacgttgcggcgcacggccagcgcacactcctcgcgtaccgtgccttcgaactcgccttcgtgcacgcagacgaacacgatgccggatttacgctgtccggcgatcagatcgatcacctcgacggggatgccgggcgtgttcacgcgcaggccaatcaccagcacctcgggcatcttgccgctgccggcgcccatcgccgtgttcgcgggccgcagcagcgcgagcatcgtgatcgaggcgatgtcgttgaccagtcgctgcttgagtttggacgataccggcgccttcgccacgaacaatcccttcggcagcgtgcccttctgctcgggaatcgccgccgaggccggcagtcccagcgtcagggcggatacctcgccgcagtgtgcgacggtcaggtgtgcagcagtcatcatcggcctccttgtgttcgcctccggcggcaggcccgcctgtgcgcattgctccaatcctaaccccatccgggcgcccgccggggatgaccgtcacaaaacggccgtccgtgtgctccctgcgcgaaataccgttcctccgttacgctatgctgtgcatacatcgacgagtcgggcgacgtcgcggacgggtgccgctgacaggggagaaggacatggctttcacggatgaccagctggagagatattcgcggcatctgattctgaaggagatcggcgtacgcggacagaagaagctgctcgccgcgcgagtgctggtcatcggcgcgggcggtctgggatcgccggccgcgatgtatctggcggccgccggcgtcggcacgatcggcatcgtcgatgatgatgtggtggacctgtcgaacctgcaacgtcagatcattcacggcaccggcaacgtcggcatgccgaaggtcgaatcggcggccgaaaccgtcacctccatcaacccagacgtgacggtgaagccgtatcacatacgcgtatctgccggcaatatcgccgagctgattgccggctacgatgtcatcgtcgacgccgcggacaatttctcgacgaaattcctcatcaacgacgcctgcgttcttgccgggaagccgtatatatatggtggcgcgctgcggttcgagggccagctcatgacgtatgtgcccgggcgaggcccctgctaccgctgcatttttcgcgatatgcccgcggccggcgaggtgcccagctgcaaggaggccggcgtgctcggcgcagtggtcggagtgatcggcagcatgcaagcggtggaggcggtgaagctgatactcggcgtcggcaagccgctgaccgcccggctgatgacgttcgacgcgctggcgatgacgtgccgcgccgtgccgttgccggagcgcgaacccgattgcccggtgtgcggcgagcatccgaccataaccacgctggatccggcgcgatacatccagccggcgtgcggcgtgtgaatgacggcgattccgccgtttaataacgcgccatcaccggcgtctatcaccacgctgcaacgggagacagacatctggcataggctcatgaacggataccgtgcgcctcggcggccaaaggcgcaaggcgcgcgcaggcgctggcatgagccacgaacatatgaggggagcatctgacatgacggacaagcacatcgattcaccgctggcggacgacgacggcgatgccatcaagcgcatcacgccggcacgattcgctgagctcgacaaatccacggtgacgctgctggacctgcgcgagcccgacgaggtgttggtccatggccttgatggcgcgatcaatatcccgtttaaccagatcggcacgaggctgagccaggtgccgaacgacaagccggtcgtcgtgttctgccgggtgggggattggagcgagcaggtcaccgagatccttgccgatcgcggctatgacgccatcaaccttgacggcggattccaggcgtatcgggagtatctcgcctctctgccgcaacagcgggagaacgacgtcgacgatggtgatgcccggcccgaaaaacaggcgaagggaagcgccgcgacgctctccatcccgaccgcggcgcagcagatatccctgcgcggccctgagcatgagagcaagtcgacgggggccgccgactcggccgcctcgcacggcagcaatggagatacggacggcgcgcagcctcacgcggtattcgttgacgccaaagggctcaagtgccccggtccgatcgtgaaggtcgccgacacgctgcgcccgctgccgatcggaacccgactggccgccgaggcgaccgaagacgccttcctgtcagacatcgcggtgtggtgcgaacgcaccggcaaccatctcgtctcgctcgaacgcgacgaaaacggcgtgattcatgtcgtcatcgacaagaccgcgcacatgccggcccccggagctccggccgccgcatgcccgtcgtcgccggccggtcgggcggtatcggccgagactcccgccgccgcaccgcagcagaccggcttcaacccggatggcggcgacgtccgccatgacaagaccttcgtcgtgttcagcggtgacctcgacaagaccatcgccgtgttcatcatggcgaacggcgccgccgcgatgggccgcaaggtcacgatcttcttcacgttctgggggctcaacatcctgcgcaagcccaagcgcgtgcgtgtcaggaagacgctcatcgagcgcatgttcggcatgatgatgccgcgcggcacgcgcaagctcggcctctcgcgcatgaacatgggcggcatcggcgcgaagatgatccgctggatcatgaaatccaagaacgtggaatcactcgaatcgctgatgaagcaggcgaccgatcacggcgtgcgcctggtcgcatgccagatgtcgatggacatcatgggcatccatcaggaggagctcatcgacggagtggagctcggcggcgtctcaacgttcctcggctccggcgagaccagcgacatgagcctgttcgtctgacggggcgcggcgaggccggttgacagtcgccataggtgtgcggcgtagaatacggaaggcgaaggagacccgcatgacacgcaaactcattctcgatttggataccggcatcgacgacacactggcaatcgcgtatgcgctcgcaagcgaacaggccgatgacgtccggctgatcggcatcaccggcacctatggcaacgtcaccgtcgagaccggcatgcgcaacgcgctcgccgtcaccgacctgcttgggcatcccgaagtgtcggtgtatcccggtctcgaccgcccgtcgaccgcaccggaaaacttccgctattcgccgtcggcaggaacgcggcgcatccacggcgacaacggcatcggcgacatgacgatccccgattcgcggcgctcgccggaaacgacggccgcggcggatttcatcatcgacgcggcgcacacgtacggcaaggacttggtcatcgtgcccaccggcgcgatgaccacgatcgccgaagtctgccgtcgtgagccgcgcatcggcgagctcgtcggttccatcacgttcatgggcggtgcgctgaccgtgccgggcaatgtgacacccggcgctgaagcgaacatcatgcaggacccggaggccgccgacgccatcttgcgcagcggcgtggaaaccacgatgatcggccttgacgtcacgcatcaggcggtgctcacgcggcgcgacatcgagcgatggcggcggctgggcaccgcggcgggtgatttcctggcgggcatgacggatttctacatcgacgcgtattcggcgacgcagcccgagctggaggggtgcggcatgcacgatccgcttgccgtggccgcggcgctcgacccgacgctggtcaccacgctgggcatgaacctgcaggtcgacttggagggcgcgtatcgcggcaggaccatcggcgaccgcgctcacgaccggctcaccgactcgcacaagaccacgcaggtggccgtgcgcgtcgacatcgcgcgattcaagagccagttccttaaccggatcacggcgctggcctcccactgatcaccgcgagacgggcggctgctgatcgccgcgcggcgcttgaccattccccgccctcttcccgcgaaagtcccatgtacattggtcgtgatgggactttcgcgggatggcggcggagccgagccaaggcgagccgggtgaagggggggggcggtcagtgcaggatgtcgaccggcgtggcgttcttgttgcgctcgatgatcgcgcagacctgccccggggtctcctgcgacacgtaggcgccgccgcgaagcgtgtacgacacggtgctcggcgatacccccgccgccttcgccacgtctttcagcgttgccatgcgtcaccgtctcatccgtcatcgtgagagatcatccatttccccggtggccggttggaatcatcatccccgctgcgctgccgccctcctcatgccgccttggcccgtcctgtcggcggcggtgctggaggtgacgcgcacggggatgtcatgcatgatgccggtcggtcactgttctgcacgcatgctatcgggcgtcactggaaggcctgtgacgacgatgtcgaaaaatggcgctctcaaaactcgcagagtgacggtaccctcgcacagtgacggtatattcccgaaatgtctcgtatggtatggatgcgcggggattgggatccgggcgatagactcgatagttattcaaggatgaccgaatgattcggtaaaccgtgcccgttgatatcagcgggcacggttccgctcgttctgctcgggtcttccagtcgaatgggtgccccggatgcgattcgaacgcacgacacccgctttaggagagcggtgctctatcccctgagctaccggggcaacgaatgaccattatacatgtcgggcggatatgcgcgtatcgtgcgcagtgtgaagcccgcaggccgccgcgcatacgtgccggaatggggaatgattctcgggaacgatggcgtccgcggttccggggcgttatcgtatgagcttgtatgcgcgacggctggaagaatacatgtcgttgcgtaccggttgacggacgacaggggagtggcgaatggcaaacgcgcgaggatcatcacggaacgtctacggctcggcggctcggcggtccggcgcgtcgtccggcactgcgaaaaggcccgccgcgaaaacaagcgccccacgcggccgacgccaccgtctccttggcgtcttgtcggtcatattcgccgctctcgcattggcgtgcagcgtcctgcgcatgctccccgagaacctgcaggcgctgccgtacatccccgtgatcgtatccgcgacgccgtggttcgtgattctcgccgtgctcgcgctgatactgtcgatcatctcgcgccgctggatcgccatgctgatggcgctcgcctgcatcggcctccaggtgtggtggcagtggccgttcttcagcgcgtccacgaagctgccggcggccgtcgacgcggccatggcatcgacccgggcggacaccggcgacatgatcgcccgcgtgatgaccttcaacgtctacaaaggccatgcggacgcgaaggccatcgtcgacatcgtgcgggatcagcgcgtcgaagtgctcgcgttgcaggagacgacgaacgatttcgtcaagaagctcgacgaggcgggcatccacagctatctgccgtattcgcaggtttcgtcgtcggacggtgtctacggcaacggcatctggtccgcgaccgagctcgggcgtccggtcgatgacgaggtcgggtcgagcgcgtcgttcatgccgggcggcaccgtgacgttcggcggcggcaaggcccagctgcgattcgtctccgtgcataccaccgcgccgattcccggctactggagccggtggaagcgctcgttggacgagctggcatccatgcgctcgcgcgaaggttcgcgctacgtgttcatgggcgatttcaacgccacgaccgaccacacgccgttccgcaacatcctggggaaccggttctcggacgccgcgcggcagtcggggcacgggttcacgttcacctggccgtccaacaagctgccgctgccgcggttcgccggcatcgaccatatcgtgctggacaaggacatcatcgccggtcagatgcaggtcaagtcggtcgccggctcggatcatgccgcgctgctcgccaccatcgtcgtgcagtgacggcggtgacggccggctgattggggcggtaccttacggcgacgttgtcatgttgtggtaggcgtcggccgatgacggatgccgcgtagtgcgactacggtgcgtggcactacggcggtgcgtcgccacgcatatggggacatagatggtctcggcacgccatcgttgcgtccataagtgctcgtccaaacggcggctgcgcgcacatatgggcgcaaacctcgtgttttccgtccataagttcgcgcggacttcgccgtggcgcgcgcttatggacgcaacgtcccgcgtagggtgccccgtcagtccaggttggactgggtgccggcggtgtcggcgctgttggcctgctcggcctgggcggcgtcgagcttggccttgacctcgttcagcaggctctgcgcacgcttggcaagcgcttcgccgatctcccactggcgcatggactggtcgaggttcaatccgccggcctccagcgcctgcacggcctggatgagcttgtcgcgggcctcctcgtacggcatctgcgcgatggcctcgcgctccttgtcggtcaggctggtcgccggctcgctcgccgccgatgcgttcttgctggtcatgatggtctccttctgtcgtgtatgcgtgtcgtattcgattggataacggtcatatatatatggttatgcggctgatatctgccccgcactctgctgccgtgcggcactccgctactgggcggtggcggtgatgacccccttgcgcagcgtcagcgtgagatggtctcccgcgctcacctttccggcgtcgtcgatgacgtgcccgtcggcgttctggacgacggcgtatccgcggtcgagcgtggattgcgggctgagcgcggtcaggctggcatgcagcttctccacggtcaggctggcgtcgtccacgatgcgcgtcaggccgatgtccatgcggcggcgcgcgtcgtcgacgaaccgttggtacggctccagcatggtcagcggctgcgtcaggctgggccggttcgcgtacccttcgaccagccgtatctcgttgccgacgcgcgcgtcgatgcgcatgcgcatgcggtcgatggcattgccgatcagctgccactgctcgtgcacgtcgggcacgaccttcttcgccgcgtcggtcggcgtcgaggcccgcaggtccgccgccaggtcgatcagcgtccagtcgtcctcatgcccgatggcggagacgatcggcgtctcgcatcccgccgtggcgcgcaccaccgcctcgtccgagaatccgatgaggtcctcgaacgagccgccgcctcgcgccacgatgatcacgtcgacgtccgggtcggcgtctagccggtgaatcgcctcgacgatggattgcgggcactgcggcccttgtacgaaggcatggacgatgttgaaccgcaccgtcggccagcgcagccgcacgttggtgatgacatcgccttcggcccgtgcgtgcggggcgcatatcagtccgatgcaggaggggaattccggcagcggcagcttgcggtccgcgtcgaacaggccctcgcccttgagcttcatgcgcaactggtcgatctgctccttcagtccgccgccggagccgatcttgcggatgtcgtcgccgatgaagctcaaccgcgtctgcttgacccagatgtcggccttgccatgcacgaccacgcggtcgccctgcttgaatgaggcggccttcgaggcgaacgcccgccagccggacacggatatggcgatgtcctccacgtcatcgcgcaccgtaagatacgccgagccggcgcggcgcgtgttgatctccgtgatctgcccggcgatccacgcggcgggccagcgctccaccgcggtatggaatttctggctcagtacgctgaccggccaggggttgtccgcggtggtctcggctgccaggcgcggcagttggtcgaagggcttggggatgcgctccccgccgccctccgacggccgctgcgtcgcgattgcaaggtcctgttcctgattcatgccttcaaggtttacgtacagaaaggacaagtttttctgcctgcgagagcgtcgccgtcggacggtatcattgttggccggcttttcggtgatggtctcgccgcgacacgctgacgacataccgtgaagtaaatcacacggatgttcttttcggctctattccgccgaaatgtgcatatctaggattgttttcggcatttccccactatatctaggggtggcatgtcgtatagtcatcagagaacaaacaacttacacacgtgtgatttcggatcggcgaccgccgcaagacatgccgggaatcacgaaaggacagggattgggacatggatgctctgctgatgaacgccagtaccgccacctcctccaaggtgctggtggagaagcgtgacggtcgcgtcgtcgacttcgacccgataaacatcatcagcgccgtgaagtccgccttcgccgaccttgacaagcaggtcggcccggaggaggagaagctgatccgcggcttcgccgaccagatcgaaggcgagatcacggagcgctacaacggtcccgccaagatcgaggacatccagaacctcgtcgagcacgccctgatcgacgcccacctgtacgacgtggcccgcgcctacaccaactaccgtctcgacaaggacatccagcgcgccaaggccacggacgtcaacgaggccgtctcccgcttcatcaaccaggatccgacgctgatccacgagaacgcgaacaaggatgccaacgtctacgccactcagcgcgacctgctcgccggcgccgtctccaaggccgccgcgttcaacatgttgcccccggccgtcgcgaacgcgcacatgaagggcgacatccacttccacgacgccgactactcgccgttcaccgcgcagtccaactgctcgctgcccaacttctgggacatgctcgccaacggcttcacgctcggcaacgcgccgatggcctccccgaagtccatcgccatcgccgccacgcagatcacccagatcatgaaggacgtggcctccagccagtacggcggccagaccgccaaccgcgccgacgagcacctcgccgcctacgcgaagaaggactacgagaagttcctcgaagaggcccgcgagaccatccccgacggcatgccggtggagttcgcccgtcgtcaggtcgagaacgccaaggccaacgagcccgccaagctgcacttcggctcccgcgagccgctgcccatggacacgccgttccacaccgacgtcgacgagctggagcaggagcgtgagatcctcgccaaggtccgcacgcgcaagtccatctacgacgccatgcaaacgatggagtaccagatcaactccaaccgcgtctccaacggccagaccccgttcgtcaccgtcggcttcggcctgggcaccgactggttcgcccgcgaggtgcagcgcgcgatcctgctcaaccgcatccgcggcctcggcaaggaccaccacaccgcaatcttcccgaagctcgtgttcaccgtgcgccacggcgtgaacgccgaccccggcgacccgaactacgacctgaagcagctcgccctggaatgcgccaccaagcgcatgtacccggacgtcgtgttctacgagaacatcgtcaagatcaccggctccttcaaggcgccgatgggctgccgctccttcctgcagggctggatcaaccccgagaccggcaaggacgaggaggatggccgcatgaacctcggcgtcgtttccgtgaacgtgccgcgcatcgccatcgaatcccacggcagcaaggagcgcttctggaagctgttcaacgagcgcatggaggtcgcccaccaggcgctgcagttccgcatcatgcgctgcaagcaggccaccccggtcaacgcgcccaccctgttccgcttcggcgccttcggtcgcctcggcgcgagcggcaacgtcgacacgctgttcaagaacgagcgcgccaccgtgtcgctcggctacatcggcctggccgaggccaccgccgtcttctacggcaaggactggatccgcgaccacggctgggacccgcagggcaaggagttcgcgctgtcgatcgtcaagcgcatgagcgaactgtgcaagcagtggagcaaggccgaaggctaccattactccgtgtactccacaccggccgaatccctcaccgaccgcttcaaccgcatggaccgcgagaagttcggccgcatcgagggcgtcaccgaccacgacttctacaccaactccttccactacccggtgtggctgcagcccaccccgatggagaagctcaactacgagaaggacttcccgtacttcgcgtccggcggcttcatcaactactgcgagtacccgtgcctgcaggacaacccgaaggcgctggaggccgtgtgggattacgcctacaacatcggcatcggctacctcggcaccaacacgccgatcgaccactgcttcgtgtgcggcttccagggcgacttcgagccgaccgacgagggcttcaagtgccctgaatgcggcaactgcgaccctgacaagtgcaacgtcaccaagcgcacctgcggctacctcggcaacccggtgcagcgcccgatggtgcatggccgtcacgaggagatctcccaccgcgtcaagcacatgagcggcgagaccggtcacgtgacgctggcggacggctccgagcgcgagtggttcgaagaggccaagtaactgccggtaccgcgcgttgtgctgtccgcgagggtcgccggtatatgttgtctgacacgctcaaggccgttcggccaagcttacggtcagacaacatataccggcgaccctcgcccgttgcgcgcaacgttacggttggacagggaggatgatgatggacaggaagtcgacgctgcatgatttcgcagccggcgagaccggccgcggacccggagtgccgtcatcactgaccaacaacccccgttccggccagtgggacgggcggcgcatgtccaagcgcatgatcgccgactacaagaccttcatcgtcaccgacggcgaaggcgtacgcaattcgctgtacgtctccggctgcccgttccactgcgtcgaatgcttcaactcgtcgatctgggatttccaggccggccacgaatacacgcagaagctcgaagacaagatcgtcgacgacctcaaggcgccgtggatccagggcatcacgttcctcggcggcgaacccatgctgaatacgcccgtcctgttgccgctcgcccggcgcatccgcggcgagttcggccacgacaaagacatctggtgctggaccggctacacgtgggaggagctgatgcgtcccggtgagacgccggacaagctcgaactgttgcagctcatcgacatcctcgtcgacggccgctacctcaaggaccagcacgactccctcctgcagttccgcggatccagaaaccagcgcatcctcgacgtaccgcgttcgctggccgccggcaggcctgtcgtctgggacaagctccacgaccaggagcgcgacatccccgaaatgtacctcaaggatcgcgaggccggcgagggcgcgcaggcgtcgtgacggcgccgccggccttgccatccatccagtggattcgatgccgtcggcctgatcgcggccatcctgacggtctcgcccgccatcggcatggccttgcttctccccgcattcatctggcctcgcgtgagtccgctgttccatgtgatgatgctctgtttccgggaagggtgatcgcgcatactgggcaccggattggggcggacgactctgtatatgcgcggcgtgcgggacggcgtggtcgacgttttcgcgggcagcggcgtgcccggtccgctggagggctcggatactgcggccggggtatggcccgccgtcgtcaccatcatggccgccatatcagggatttgagcgggactgggggcaatagcactagtccataagaccaccagcctgctggcatgctcggctcaccccccgaatgcgcgataatgggggtaacgccgcaatcgtggggaacccgtcgagtttccgttttgcgtttgttagcgaaatcacgccatacgacggctcgttaggaggggtctcggactacattacataaggaagtagcgggaagtcctgaaccgaagacagaggtaacagatggtggatacagcgaataccgcggccgaaagccacgatagtaagccgttgcgcgtgggtctggatatcggatcgaccacggtcaaggccgtggtgctcgatcagaccaatgcgctcaatgacgtgctgttctccgactaccgacgtcaccacgccaacgtccgcgccacggtggctggactgctcaaggacatccatcagacgctcgtcgacctcggccgcggcgacgagcccattcgtctcgccatcaccggttccggcggcctgacgctcgccgacaacctgcacgtgccgttcatccaagaggtcatcgccgagacccgcgcgatcgacgaggaatacccgcaggccgacgtcatcatcgagctcggcggcgaggacgccaagatcacgtatctgaagcccactcccgaacagcgcatgaacggttcgtgcgcgggcggcaccggcgcattcatcgaccagatggccacgctgctcgacaccgacgcctccggcctcaacgattatgccaaggactacaagaccctgtacccgatcgcgtcgcgttgcggcgtgttcgcgaagaccgacctgcagccgctaatcaacgacggcgccgccaagcccgatctggccgcgtcgatcttcaccgcggtggccacgcagaccatcgccggtctggcttccggacgcccgatccacggcacggtcatcttcctcggcggcccgctgttcttcatgtccgagctgcgcgaggcgttccaccgcgcgctcgccggcaaggtcgacgagttcatcgtgccgaccgacgcccacctgtacgtcgcatacggctccgcgctgatcgctggggagccggatggcatcgacgtcgacggcgtgcatttcgagccgcgcacctgtgacgacatcatcgccgccctcgacgacctgaagaacctgccggcgaacacgccgaccatgcccccgctgttctcctccgaccaggagcgcgaggcgttcaacgagcgccaccatcgcgaacacatccacatcggcacgctcgaaggcgcgaaaggcccgcacttcctcggtatcgacgcgggttcgaccaccatcaaggcgacgctcgtcaacgacgaccgcgagatcgtatggtccagctacgccaccaacgaaggcagcccgttgaccgccgccatcaacatcgtcaagaagatccagtccgagctgcccgaaggcgcgtggatcgcccgatcctgcgcgaccggctacggcgagggactgatcaccaccggcttgcacctggacgagggcgtggtcgagaccatggcgcactaccgtggcgccgaaatggtcagccccggcgtcaccgctgtcatcgacatcggtggccaggacatgaaatacctggccatcaccgacggcgtcatcgactcgatcgccgtcaacgaggcatgctcgtccggttgcggctcgttcctgcagaccttcgcgcagtcgatgggtctgaccatccaggagttcacccaggcggccctcaactccgaccatccggtcgacctcggctcgcgctgcacggtgttcatgaactcgtccgtcaagcaggcacagaaggaaggcgcgtcgatggagaacatcgccgccggcctgtgctattcggtcgtgcgcaacgcgctgtacaaggtcatcaagctgcgtgactccggtgagctcggcgacaccgtcgtcgtgcagggcggcacgttcctcaatgacgccgtgctgcgcgccttcgagctgctcaccgagcgcgaggtgacccgcccgaacatcgccggcttgatgggcgcgttcggcgccgccctgaccgcgcgcatgcattacgaggacgtggccgacgacgcgcacgaccacgacgccgaagtctccgcgggccagtccgccgatatggccggcagcgacgatgtcagcgcggagcacgaccacgaggtcgtcatcgacggcgtgcaccacacggcgtccaacatcctgtccggcgacgacctcgacaacatgtcgatgacctccgagcgcgacgtgtgcaagctgtgccagaaccactgcaagctcaccatcaccacgttcgccgacggctcgcgctacgttaccggcaaccgctgcgagcgcggcggcgacgcgaagaagaagcgctccgacaggccgaacctgtatgactacaagtacaagcgctgcttcgcctaccgcaggctcaccgacaagaaggccacccgcggcgagatcggcatcccgcgcgtgctcaacatgtacgagaactacccgttctggttcacgctgctcacctcgctcggcttcaaggtgatgatctccggccgcagctcgcacgagctgttcgagaccggcatcgaatcgatcgcctccgagaacatctgctacccggccaagctggtgcacggccacatcaagtggctgctgggcaagggcgtcaagaacatcttctacccgtgcgtgagctacgaggacaacctcgtgcccaatacggacaaccactacaactgcccggtcgtggccaactacccggtggtgatcggcgcgaacatgcccgaactgcgcgaggacggcatccgctacatgcacccgtacttcaacctcgccaaccacgagctcatggtcgaccgcatcgtcgaggagttcgcctgggcgaacgtgagccgcgaggaggccgagaccgcggtcaaggccgcgtacgccgaggacaagatcttcaagaacgacgtgcaggaggaaggtttcaaggcgctcgcctacatgaaggagcacaactgccggggcatcgtgctcgccggacgcccgtaccacatcgaccccgaggtcaaccacggcatccccgagacgatctgcgcgctcggcatggtcgtgctctcggaggattcgatctgcgaactgcagccgggggagaacctgcatctgagcgactacctgtcggaaggcgaggaggacccgcgcaagaagaacgcgaacggcttccgccacgtcggcgaccgcaaggtgaccgtctcccgcatgccgctgcgcgtcaccaaccagtgggcctaccattctcggctctacgcggcggcgcatttcgtggcatcctaccctggtctcgaactcgtgcagctcaactccttcggctgcggcctggacgccatcaccaccgatcaggtggccgagatcctcgccgacaaggccgacgtgtacacgctgctcaagatcgatgaggtgagcaacctcggagcggcgaagatccgcctgcgttcgctcaaggccgccgtcgaggagcgcgaggccaacaagcggcgtctggccgcacaggcccagtcccaatcccgccagcaggtgctgccgaacaagcaggaccaaccggtcggccccagtgcggccgagcttgcggcgcagcgtcaggccaaggaggagctcgcggccgccgaggtgcagctcaaggccgcccaggaccagctcgccgccgcgcaggccgccgtcgaggccgcggagaagcagaagaacgccgccgagcagccggccccgcattccacgggcttccgcaagaccggatccgaggcgcccacgcccggccgtcaggtcatgctcgacacggtgatgaagagcaacccgcagctcaccaaggccgtcaaggacgcctcccaccgcgcggcgcaggccgagtcgcggctcgccgccacctcgccgaacggcaagtccgcgaggaagaccgccaagaaatccggccacaacaccgcgaccatgtcgaagtacgccaacaaggtgccgttcggcaagtcgatgaagaaggactacacgatcgtcggcccccagatgagcccgatccacatgtcgctggtcgagtcggtcatccgctccggcggatacaagttcgacatcctcaagaccgcgagccgcgaggacgtcgaactcggcctcaagtacgtcaacaacgacgcctgctacccggcgatcatggtcatcggccagctcgtcgacgccatcgtcaagggcaagtacgatcccgaccatgtggcgctcgccatcacgcagaccggcggcatgtgccgcgcgacgaactacttcggcctgatccgcaaggcgctgatcgacgccggctacccgcaggtgccggtcatcgcgctgtccacgcagggcttcgaggacaacccgggcttcaaggccacgcccacgctgctgcaccgcgccatcaaggcgctggtcgtcggcgacctgctgctcaaatgcctgatgcgcgtgcgcccgtacgaggtcgagaagggcagcgccgacaagctgtaccagatgtgggacaccatcgtgcgcgagaccatcgaacaccacggcttctccgataccgctaagaagaagatcggcaagcattacctgccgtaccagacgctgctcaaggagatcgtcaaatcgttcgacgcactgccgctgcgcgacatcccgcgcaaggtgcgcgtcggcgtcgtcggcgagatcctcgtcaagtaccatcccgacgcgaacaaccacgtggtcgacgtcatcgaatcgcaggattgcgaggccgtggtccccggcatcatggagttcatgaccacgcgtccgtacatcaccgactggaacgagaagaacctcggcatgggcggcaacaagaagctgtactcgctcatgcgctggggtctcgaccgttacctcaacccggtgcgcgcggccatcgatctggcgcatggcaagttcagccaggacctgccgatgcctgagctggtcaagaaggcctccgaggtgacctcggtgggcgtgcaggccggcgaggggtggctgctgaccgccgagatcttggagctcatcgagtctggctgcccgaatgtgatctgcgctcagccgttcgcctgcctgcccaaccatgtgaccggccgcggcatgttcggcaagattcgccgtctgcacccggacgcgaacatcgtttccatcgactatgatcccggcgcctcacaggccaatcagctcaaccgcatcaagctgatgatcgccgcggcgaagaagaaccaccagaagctgaccgcggccgactgacggatcagcctcggcccggcgatcagccgaccagggtcgccgcgtaggcgtacagcctcttccatggcagggtcgacacgtctatcttgtcggccttgctctgaaccctctcgcggtagcgttccgtgcacagcgccgtcttcacattggctttcacatcggcgagcggcgccttgccctcgaccccgtccacggtccagtcgtgcgcgtcgtaaaactcctgcacctcggtctcgctcgggttcatgcccggtttcgtggcgtcgtcgacgtagtcgttcttcagcgcggtcatctcgtagtcgatgtatgaggcgatgtcgtattcgctgcgtccgtagatgacctgccccgcttcacgtttctgccggttgttcgcgttgagggtttccatgcgcttgacgatgccggtgtacgagtcgtcgtcgaccagcccgtacgagactgcgatcaggtacgccgcgtgacggaagcgcagcgtgtcgatagtctgtttcgtcagccattcgaccggcttctcgccgccgtatgaggcggtccagtcggcgtcccgggcgttgaggttgacgtcgtgcttctgcttgaaatagctgacggcggcggtgcgctgcgacgaccacgcctgggtgaattcggcctgcgtgatggtggtgtcgccgaaggagaatttcgggaaggcctgcgtcgcgttggcttgcgcgtcgtccgtctttgacgagtcggggctcgccgtgagtgaacggacgagaaagacggtgccgacgatggccgcaatcagcaggacggccgcgacgacgatgatcgcgcgggttctcgtattggttttcgtccccatcttcgcggcgtcacggccgctcccgtccgttgccttgctgggagagcctgatccgcgttttcgtgactgcttcatgccgtcatgatacgcgacggacatgattgcggggtgtcgcccgcattgcgcaggaacgcccccacaatcatgtccgtcggtcgtcgccttggattccggttattcctggaatacgttcggatgcttcggatcgccgggctcgtcggccaacaggccctccaatcccaggaactccttccagaattcgagcggctggccatacggcgccgattgcgcgccgcgcgcctgcaggttcgccttcgcctcgaacacgtcctcttcgcggatatcctcgaagtagctttccagccgctccctgttccccggcatgtagaacagggacgcgatgatctccgtcagccgctcggcgcgctcgatcggcagcgaatcccaatgccgcagctcgatgaagttcttcatacgcacgtcgttgaaatgcgtggagatgatgtggttgatctcgtacgggttgagctcgcggtcgggatacacctctccggcgttctcatagaacgccgggtgatgcagctccttgccgctcaggcccttggcctccggcgtatgcgtcagatcggcgaacatcagcggcgtggacagcacgtcgatggcgtactcctcccagccgaaccgcttgtcgaacagtccgggaatcacgttcgtgcgctgggggtcgagatagtcccacatgcgctggcgtagcaggggccacgggttcggcgcgccctcgaaatacggcgtattgcggaagtaccaggcgaggatcggcccgatgatggtgcccagacgcagcttgtcgatggaatcctgctcgtcgacgtagtcgatgctcacctgcgtggaggctgagcaccgcatcatgcacgggccgaactggcctacccgccccaggtagtgggtcatggcgtcgtaacggtccttcgggttgaccttgacgtcggcgaagcccgacttgggctggtagccgtaattgaccagacggaagcccagctcgtccagcacgggatcgatgtcacgccggaaggaacgatacagcgtcagcagttcctgcggcgtcttgaggatgcccagcgagcactccacctgaccgccgggctccagcgacacggcgatgccttcgcgcccgagtccgaccagatggccgttctcccagtactccttctccttgtcatagtacggcgcgatgcgcttgagcagcgtttcgacgccgttctcctcgtagtagctgacggcggtgtcgtcgccgttgtgcaccggaagatgttcgatctccacgccgaaaccgcccgtgccgcgtttggaacggccttcctcgaagaatcgcagcagactgtcgatgtgcttgggattcggcttggcgagcagatgcgcgtaactgattctcggtgtcgtcatggggcatatcgtacctgtagattccatcggccacggcggtgccgttatacaaagaatcgatagctggtttgcgtccgaatgctggacattgcgactgatttcccgggttccgttcagggggtacaagggtgacgttatgacagttaacgaaatgccgaatacgccatacccccattgccgtagcctatgggtaccgctatacttgtgaacttgtaaagtctctttacatattggtggtgtggcgagtccgtgaatgaccccggaagggggcatcgtcatggatgaccggatcgccgacatgtccccccgcaacgaggaggggaacggagactctccaataacagtaaggacaacgatgaaacctcatgtaggatcacggatgatcgcagcatcggtcgctttggggacggcgttcgcgttgatcgcgccgtcttcggcgctcgcgggcgatgcgacgccagcggcggcgtcgaccggaacgacatattacgtgtcatcgacgcatggcgatgacggcaacgccggcaccgatcagaaccatccctggaagacgctggacaaggtcaacgccatcgcgaccgaccttaagccgggcgactccgtgctgctggagcgtggctccacgttccaggaccagtatctgcacatcaaggacacgtcgggaaccgccgacgcgcccatcaccatcgccgattacggcgacgcctccgccaagccggtcatcgcggcgaacggcgtcaagggcagccggtggtaccagaactaccgtgcgtcggtcggcaaccaccagaacaagggcaccgtctcctcggccatcctgctcaaggacgtgtcgtacatcacggtgaagaacctggagatcaccaatgacgaccccgacgtctacgacccgatcgacacgtggaagtggaccgacacggccgattcggatggcaccaagctcgaccgctcggccgaccgcatggaccgcaccggcgtggccggcatcgcggagaacggcacaacgatgagccatgtcacgcttgagggcctgaacatccacgacgtggacggcaacatctacaacaagcacatggccaacggcggcatctacttcatggctcactacgcccgcgagaacaagaacgccgcggacaacacgtggctgcagaaccacatctcgcgcttcgaccacatcaccatcaagaacaacatcgtcaaggacgtggaccgctggggcatcgccgtgggctacaccgcgtacctcaacttcatcgacgcggcgtggggcgacggcagcatcgacgacgacctgatcgccaagtacggccagaccaacgtgaccatcgagaacaactacgtcaagggtgcgggcggcgacgccatcaccctcatgtactgcgaccgtccggtcatccagtacaacgtgggcgacagcgtctcgaagcacatgaacgacgtcgactacccgcatgaccgcgagcacggcggcaggtacggcggctgggtcgcggcgggcatctggccctggcgctgcaaggacccgatcttccagtacaacgagatgtacaacaacctcaactccgagcacggcaacggcgacggccaggcgtgggacgccgattacggcgacggcacgctgtaccagtacaactactcgtacggcaactcgttcgcctcgctgatgatctgcaaccagtacgccatcaacacgacgttccgctacaacatctcgcagaacgaccgccgcggcgtgttcgacctgccgagcaacggtccgggcaaccacatctacaacaacaccgtctacatcggtaaggacagcgcggtgctgaccggccgatccaacagccaggcgaagttcgagaacaacatcttcatcaacgcgaccgacaccaagaagaccgagacgtggaaccgcggcaaccagcacggcggccagacgtacgacaagaacatgtacgtcaattacgcgaacaggcccgcctccgattccaacgccgtcgaggtcgccgatgtgaagaccgtgctggccaatgccggacacgcgccgagcgcgccgaaggccgacggttcggtctatggccgttccggcagcgagttcgacggatacaagcccgttgacggctccccggccatcaatgccggcaaggtcatctccgacatgaacgactacgcggtcacgaacgacttcttcggcaacaccatcaagggaaccccggacctgggtgccgtcgaaagcaacgtgctctccgtctccggcaaggtcaacgcgtacgagaccgccacggtcggcggctccaaggtcgtctacgtgccgttcaccgcgaagaacccgaccacagtcaagcagcttcgcgcgggcctgacggtcggtgacggatcagtcgccaacgtgtaccgcggcggcaacaagctggcggccgacgcggcgatccagtccgacgacgtgctgcgcttcgaggtcgaaggcacttcaaacacgccgatcgaatacaccatcgctcagaagaacgcctggaactgggtcgactggttcaagaccgccacgggcgtggtctggaactcccagaagcagaatggcgccgacggtgactggacggacatcacgacgttctccaccgagtacccgatgtcgaagtacaacgagtactacggcgcgggactcaccggcaacctgtcggacctgccggcggtgggagctgaccgccccgggcgtcagggcctgttggtcgacgacccgggtgcggccggcggcaccgccatcgtgtggaaggccccgaaggccggcaccgtgaaggtcacactcggccgcgacaacgagccgcagcggcgcaacgccaacgcttcgggcacggtgacgctcgcactgaccaagaacggcgagacgctgtgcaccgcagacatctccaccgcgcagaccaagaacgacgacttcgtcaattgcctgaaatcggataagggcacggtgcaggtgaacgccggcgacgtgattcgcatcgcggcgaccgcggccagtggcgcggccgctccggacctgtacgtctcgccggtcgtcacctatcaggatgtggcacccgtcgagtcccagacggcgcagtacgctgcctcctacgacgcggtgagcgccaaggtcggcgccaaggccaccgctacggtgaagttcacgaagggcggcgccgccgccaccccgaccggcgtcaagtcctacgcgctgaagaccgcggtcgacggtgtggccgtggatgccgcgaccggcgcggtcacctacacgcccggcgccgatgcgtacggcaccaccaagaccgcgaccgtggtcgtcacctactcggatgacaccaccgacgaggcgaccgtcaccttcaacgtcgagaagtccaacgcgcagaagtacaacgtgctgtacccggccgtgtccggcggcgcgggcgtcgcgctcaagcgcacgcccaagttcacgctcaaggcggacagcgccgcggcgtccatccccgccggcaccaagttcgcgctcggcgcgggcgccccggccggtgcgtccgtgaacgccgccaccggtgaggtcacgctgaccagcacccgggccggcaccatcaccgtgccggtgacggtcaccttctccgacaccaacgagtccatcgaggcgacggccacgttcaccgtgaccgctccggcggcgctcggcacctccaagctggagaccggcaccgcggacggcgcgaacgtcatctatgtgccgttcacctcgaagaccccgaccaccgtcgccgatttgctggccctggtgaccgccgagccggattcggccctcaaggccgtgtaccgtgacggcaccaagctggaggacgccgcggcagtaaaggccggcgacgtgctgcgcttctacgccgacggctccaccgtcaccgccgactacacggtcgtgcagaagaacgcctggaactgggtcgacgacttcaagaccgactctcagggcccgatctggacgtcgcagcgtcaggtgtccggcaaatggcagacgattaccgatttcggttccgatgtgtacccgcagacgtactacgacaagtactacggcgtcggtgtggactatcagaacaagagccttccggccgaccgcagcgccatccacggcctgatcgccgacaatccgggtgattccgcggcgacggcgatggcctggaccgcgccgaaggccggttccgtgaaggtcacgctggacaaggtgaccggagcgcacgtcgagccgtacatccgtcagtcgaacagcaacggcaaggatgtggtcctgaagctgctgaagaacgacgaggtgatctgctccgcgacgatgaccgattccttcgcgacggcgaccgggttcaacgaatgcctggcgtccgccaagggcacggtcaaggtcgcggtcggcgatgtgctgcgcttctcggtggatgccgcggccggcgcctccaagtcgtcgatccacatcagcccggtcatcacctacacggatgccgatgagccttcgcccgagcctggcctgtcggagcagtatgctgcggcgtatccggcttcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgagccttcgcccgagcctggcctgtcggagcagtatgctgcggcgtatccggcttcggttgcggcgaaggtgggcgagaaggccaccgccgcggtgtcgttcacgaagggcggcgccgccgcggatgccccggcgggcacgacgttcgcggtcgcgggtgacgggttcacggtcgccgcggacggtacggtgtcgttcacgccgacggacgcgcaggcgggcaagacggtgacggccacggtgacggtgacgtattcggacaagtcgacggatacggcgacggtgacgttcaaggtcgccgccaagaccgagccttcgcccgagcctggcctgtcggagcagtatgctgcggcgtatccggcttcggttgcggcgaaggtgggcgagaaggccaccgccgcggtgtcgttcacgaagggcggcgccgccgcggatgccccggcgggcacgacgttcgcggtcgcgggtgacgggttcacggtcgccgcggacggtacggtgtcgttcacgccgacggacgcgcaggcgggcaagacggtgacggccacggtgacggtgacgtattcggacaagtcgacggatacggcgacggtgacgttcaaggtcgccgccaagaccgagcctgagcccaagcccgaaccgaccgatccgaaggccgacctgcgcaaggaggtcgaatccgcgtcgaagcttgacgagaaggactacaccgccgactcgtggaaggtgttcgccgcggcgctcgataacgccaaggccgtgctggaggacaaggacgccaccgaggcgcagatctccggcgcgctcacgacgctgaagtccgccactgccgcgctggccaaggccggcgacaccggcaagcccgacgatggcgacaagccttccgcgggcaagcccaacgacaagggcgacaagggcaacggtctgtccaagaccggcgccagcgtcgccgtcatcggcgttgccatgctgctgctcgcagccgccggcttcgtcacggtgaacgtcgttcgccgccgccggtaacggcatgacgggcacccgcccgtaacaagcaatcaggggtctcatggtcagccatgagacccctttgctatgcctgttagccgctctctcgctgtcgattaccctatattcccgcgaaagtcccatttgcggacgctggaatgggagtatcgacggatgggagcaattgttcaacacgccgattgttgtatatgcaactgttgtatatggtatgcattattatgttatgttgcctgaatgttcggaatgcgattttcgcatcgacagacatggtatggaggggtatggagcaacgtattctcagcattgaaatgcgggcggtgagtaaggccgtcgaccgttatttgggcgaaagcatgccgctctccgccaaggggaccaccggcggcaacgcgcatatcatcatgttcctggcgcgcaatcgggatcgggagatctatcagcacaccatcgagcagaaattctgcatcacccgttccacggcatcccgcgtgctggcgctgatggagaagaacgggctgattgcccgtgaatccgtggcgcacgacgcacgatgtaagcgcattgtgctgacggataaagccgacgccatcgtcgccgatctcaaagcgaacggggagcgtgtggagcgtcttctggtcgacggtttcacgcaaacggagcaagatgcgctgcatgactacgtggagcgcatgcgtgccaacatcgagcgcgcacaacatgaatttgaacatcagacatcctcccagacgccgtcaacggcggctcccgaatactcggaagcggaggtcatcaacacgaaggaggagaacaagtgagcagcaccgaagaagcgattgcgcaagcgcgcaaagccgtggaaccggacaagccgaaacatgtcctgcgcacgctgggcaagtcgatccgcgagtacaagaaggccagtctgctggccccggcgctcgtggcggtcgaaggcatcctggagatcctgatcccgacgatcatggcctcgctgatcgacgagggcatcaccggcggcagcatgccgtccaccatcaagttcggagtgatcctgctgatctgtgcgatggtctcgctgggtgccggcttcctgtccggcaagttcgcggccatcgcgggcgcgggcttcgccaagaacctgcgccaggaccagttcaagaaggttcagggcttcagcttcaccaatatcgaccggttctccaccggctcgatcgtgacccgactgaccaccgacgtgacgaacctgcagaacgcctacatgatgattatccgtctgggcgtgcgtgccccgatcatggtgattgtggcctggatcttctcgttccgcatctccccgtccatctcgctggtgttcctggcctgcatcccgatcctggcgatcggcctgtgcggtctggccgtgctcgtgcaccccgtgttcgagcgcgtgttccacacttacgacgcgctcaacaacgtggtcgacgagaacctgcagggcatccgcgtggtgaaatcctacaaccgcgaatccttcgaggtgggcaagttcggccgcatctcccagcgcatcttcaaggacttcaccaaggccgagcgcatcatgagcttcaacagcccgctgatgatggtgtgcgtctacgcctcgatgatcctcattgcatggatgggcgcgcagcagatcgtcgcctccggcaacaacgccgccgtgggcctgaccaccggcgacctgaccgcactggtcacctatgccatgcagatcctcatggccatgatgatgctgtcgatgatcttcatcatggtcattatctcccaggcctccgccgagcgtatctgtcaggtgctgcaggaggaaagcaccgtgactgatccggccaatccggtgaccgacatggccgacggctccatcgaattcgaccacgtcaccttccgctactccgacagctccgaaaagcccgtactcgacgacatcaacctgaagattcgctccggcatgaccatcggcatcgtcggcggcaccggttccgccaagtcgagcctcgtgcagctcgtgccgcgactgtacgacgtgagctccggctcgctcaaggtcggcggcgtggacgtgcgcgattacgatctggaagccctgcgcgaccaggtggccatggtactgcagaagaacgtgctgttctccggcaccatcgccgagaatctcaggtggggcaacccgaacgccaccgacgaggaggtccgccacgccgcgcagcttgcgcaggctgacggattcgtgcaggaattccccgacaaatacgacacctacatcgagcagggaggcaccaacgtctccggcggccagcgccagcgcctgtgcatcgcccgcgcgctgctgaagaagccgaagatcctcatcctcgacgattcgaccagcgccgtcgacaccaagaccgacaagctgatccgcaacgcgttccacaacgagatccccgacaccacgaagatcatcatcgcccagcgtgtcgcctccgtcgaggaatccgacatgatcctcgtcatggacaacggccgcatcatggcgtccggcacgcacgacgagctgctcgccacctgcgacgaataccggtccatctacgaatcccagaccaagaaccaggcccgacccgaggagctggtcgccgcggagccggccggggcgcaatctgagaccgagaccaaggaaggagagacgcgatgagcaacgaccagagcttcaagaaccgcaaacccggcatgggcaaagccgaacctggcaccatcaagcgcatcttcagctacatcttccaatacaagtggcgcgtcgtcgccatcgtgatctgcattctgatcggcgccgccgcgcaggccggatccgcgctgttcctccagtccctcatcgacacgtacatcctgccgatggtgggggagacaaatcccgactgggcgccgctgctgcgcgccatctcgcttatgggctgcctgtacctggccggtatcgtggcgtcctgggcctggcagtggctgatcgtcaccgtcgaacagggcacgctcaagaagatccgcgacgacatgttcgcccaccagcagaagttgccgatccgctacttcgacagccatgaacacggcgacatcatgagccactacaccaacgacaccgatacgctgcgtcaggcgatctcgcagtcgttcccgcagatgttctcctcgatcatctccgcgctggcggcgctgctgtccatgctgtggctctcgattccgttcaccgcgttcgtgatcgtgttcaccgtgctgctctacttcatcgtgcgcaagatcgtgagccgttccggccgctacttcgtcaagcagcagatgtggatcggcgacgtgaacgccttcgtggaggagtccgtcaacggccagaaggtcatcaaggtcttcaaccacgaggacgccacgcagaagaccttcgacgagaagaacgaggagctgttcgaggcgtccgccgaagcgaacacctggggcaacgtcaccatgccggtggtcggcaacatgggatacctgctctacatcctgctcgccatcatcggcgcagccgtttcgctggccggcgtcaacgatctcggcctgaccggcgtcaagccgctcaccctcggcaccctcgtctcgctgctcaccctctcccgttcgttcatcaacccgatcggccaggtctcccagcagctgaccatggtgatgatggcgctcgccggcgcctcccgaatcttcaagctgatggacgagcccgtggagtccgacaacggcaccgtcacgctcgtcaacgtcgagctcggcgagggcggccgtaccatgcgggaggtcgaccacgagaccggccactgggcgtggaagcgcgaggaaggcgacgacggcacgaggtcgctcaaggccgccgagaaactgcacggatccgcgcgcgaagtggccgtcaaggccaaggagcaggcgattacctcgccggacggccgctacacgttgctgcgcggcgatgtgcgcttcaccgacgtgaccttcggctacaatcccgataagccggtgttgcacgacatcacctggttcgccaagcccggtcagaagatcgcgctcgtcggtgccaccggtgccggcaagaccacggtgaccaacctcatcaaccggttctacgacatccagcaggggcagatcctctacgacggtatctccgtggccggcatcaagaagccggatctgcgccgttcgctgggcatcgtgctgcaggacgtgaacctgttcaccggcaccgtgatggacaacattcgctacggccgactgaacgccaccgatgaggaatgcatcgaggccgcgcgactggtgaacgcggacggcttcatccgcatgctgcccaagggctaccagacggtgctcgaaggcgacggctccggcctgtcccagggtcagcgccagctaatctccatcgcccgcgccgccgtggccgatccgcccgcgctgatcctcgacgaggccacgtcgtcgatcgacacccgcaccgaggaggtcgtgcaggccggtatggacaacctgatgaagggccgcacggtcttcgtcattgcccaccgcctgtccaccgtgcgcaactccgatgtgatcatggtgcttgaccacggcaacatcatcgaacgcggctcgcacgacgacctcatcgcgcaacgtggggagtactaccagctctataccggcgcggtggaactggagtagccaaggactgccttcggcagaccgtcatgtttcctcggcactgtcgtgcctcggcgtcgcctatgggaagtccaccgggcttcccgcttaacggctccgcagctagtggctgatattccagtcgctggcattatccgcgaaagtcccatccgaacatgtcggaatgggactttcgtcgggtgggggaggagtggccttccctacccggcacgataattgggggtgtgcgccacgcctcagtttgccaggtagttggcgatcgcgccggcggcggcgtagcctttgcggtacatgagttccagtccctcgaaggacttgctcagcgtcgaaagcccgcacaggtcatcgggcgcgaggatgagcacgcggccgtcgcgctcgtactccttggccaaggcaacctcgtcgttgtaggtggcgtatcggttcagcagtcgctcagcggcggccggataggaatgccgaaggattcgcgccggcgcgatgtcgcgcttctgctcgcgcagcacgtccttcggccttgtcagcaccagcacgatgcggtcatatccgtcgtcaatggccttctgcacggggaccggatcgacgatgccaccgtcgaaatacgggacgccgtcgatcacatacggctcgcaggccacgggcacggccgacgaagccttcatgatgttgaaatcatcgtaatgcacgtcggacttgtcgaaatacttcgcggaaccgtccaacgcattgcacgcgatcaccgtgaacccggtggggttcgccgcgaacgcctcataatccaccggatattcgccgtcgtgattgctcagcgtgccgtatacgtaatccagattcgcgaaattgtggtgcttgacatagctgtcgaagctggcgtattccttgcggaaggcgtattcggtgtagaacttgtggttgcggccgtgctggccggcgaggaacgacaccatgttggcgctgcctgcggagacgccatagcagtggtcgaacgtgatgccttcctcctggcagcggtccatcacgccggctccgaatatcgcgcggaagcctccgccgacatcgatcagcgccgtcctgtgcgagggtttcgattgtgcggatacatcactgcgctgtgtgtcggtgcgttgcgattcgaccgtctcggctgcacccgcgtcccgtgcgcccgtatccgcgtgggccgtggccttgtgaccgttgtccgtcgccttcaccgtcatcgtcgtcccctttcgtagtgtcgtccaagtgtacgcccgttatgcggacaatcacggtgtctgccagggtcgcccgatctagctgtgcagcagttctcgtgacagcgcggcgatgcgttcgccgctatcagaattcgcgatctcgacgccgccgtccatctcctcgggagcaagcttccccaacgattccagaaccatgcccagatgccggaccgttccgcgattgccgtcgataatcgcggtcgtcgacggcagcagctcacggaagtagtcgcggtagaacacgaaatgcgtgcagccgagcaccaccgagtcgatggacggaaggtcatagccgtcaaaataccggtgcagggtgcgcatcaccaggtcatggtcgcaaagccttccgctttcgacgatttccaccagatcggggcacggctggggcgaaatcatgttgttcgccttgaaacggtccatcagtgcggcgaacttgtgctcgcgcagcgtcagcggcgtggccgcgacgatgacgtgctgcggcatgtgccgtgcaggcgcggtcccgtctcccgcggcggtgtcgccccgatcgcaggcgaccttcagcgcaggctccatgccgatgatcggaatgtcgtaatggtcgcgcaacgcgttcaccgccgcggacgtggcggtgttgcaggcgatgaccaccgtcttgaccccctgactcatgaacctctccatgatgtcgaagctcagccgacgcacctcctgcggggtcttcgtgccgtatggcgcgttcgcggaatccccgaaatacaggacccgctcgtgaggcatgtcctgcacgatctgtcgcaccaccgaaataccgcccaagccggaatcgaatatgccgatcggtgccgtcgaagtcatgtcccatcgcctttccaacgtctagcggccaagccttcctgccgggaggccgtgtcatcgaacgcccccatactatcgcacactgttatccggcgcatgcgtttgcggccgcagcgcacgatgtcgtcgcacggccgcaagcgcagcagtcgtgcagcaacgcatcggctgtgcagccatgcatcggacggccagcccattcgcgggctgggagtactctggcagtcatgagtatcccgaaaagcgtcaccaaggcgcatgcgaccggcaatgatttcatcgcgtatctggattccgacggccgtttcgagccgaccgccgatgaggtgcggcaattgtgcgacaggcatttcggcatcggcgccgacggcctgctcaggctcacaaaaccgcagtacgtcgccgatctgagcgaggcgcaggtcgcggcgtgcgatgacggagacgccgagtggttcatggactatcgcaacgccgacggatcgctcgcagagatgtgcggcaacggcacgagggcgatcacgctgttcgcccagcggtgcggcgtggcgtcgacgcaggtgggggagccgttccgcctgggaacgcgcgccggtgtcaagacgctgcgcccgctcggcgacgtggcgccatacggcagggatgtgttccgcgtggacatgggctcatggcggcgcggcgaccttgacgccttcacggtgaccattcccggcacgccgggagccgcccgcggcacgttcgtggatatgggcaatccgcatgtggtctgcgtgatcgaagacgcgatgtccacgctgccaagggtcgaggatctggatcttgtgaccaaaccggaggtctcaccggtgctggaatccgaccagaacgcggagttcgtgcgcgtcgacgagatcgacgctgccgcagggacgggagaggcgaccatgcgcgtcaatgagcgcggttgcggcgagacgctgtcctgcggcaccggtctgtgcgccaccgcgatcacgctgcgcgccaaaaccggcgtagatcactgggacatcaccgtgcggggaggcacggtgcgggtggacgtcaccgatgagaccgtcgcgctcaccggttcggccactctggtcgcggacgtgacgttgatctgatcgatcgaggctctcaaaactcgaagatacaaaaaaggaaccgccattttccaacaatggcggttccctatcttcgagttttgagagcttcgttttcgtatcaggcgaaaattgccggcccatccacgacgataatcagcacgatcagcgcaatgatccagaccacgtccaccatcagatcgaaattcagccggtagtacttgcgcaggccgttggatttcgccggcatccgctgcacgctcaccgtagcgtgcgacagcgccatgaactggatcgtcgtggcgaacatcaggcccaggcaccacgggcacagggcgcggatcacgaacatcgattggatgaacagccagtaggcgtacgccaaggccgcgagcccgcccagccatgtgcaaagcgcgaaccagcgcggcacgacgaccttggacaggcctatcaccgcaatcgtgacgaacacggattcggcggcgatgccgaagaaggcgttcgggaagctcaatccggcgaatttgatgaactccgcctgccatgattccgccacggtcgagcaggagaccacggcattcacgtcgcagccgagcttgacgccgggattgcgagcgagctgcagcgtctccgccgacagcatgagggagacgaacaatgccgccgcggaggcggccaacatgaccagatacgtccagaccgcgccatgacgccagccggtgagcccggcgtcgacgctgatgtcagcctgtttgactgcatcgctgttgtgagtcatacatcatccttacgttcgaggagaccgtgatgagggtggctgacaacgcggcgatatcacggtggttcttgatttttcgcggggttatgacgcgccttgtgcaataaccgacagcacacagcttacgatggatacatgactcgtttagcacttgccgccgcgccgccgaagtcgggctgggacatccactgccatacggtgtattcggacgggacgcagaccccggcgtccctggtcgaactgagccgccatatcggcctgcacggggcctcgatcagcgaccatgacacgaccagcggatgggcggatgccgaggccgcggcgcgcgaggagggcatgcgcctgctgcgcggcacggagatcacggcgtgcgatgggccggtgtcggtgcacatgctcgcgtatcagtacaatcccaacgaccgtcatacgtcggacctgttcgcgcgcacacgtcaggcgaggctgaagcgaaccaaggccatggtggcgcgactgggcgaggattatccgatcagctggcagtccgtgctggagcaggtgcacgagggggagcggaccacgatcggacgtccgcacatcgccgatgcgctggtcgccgcgggcgtgtaccgcacgcggtccgaggcgttcgccgacgcggtgagcgccacatcgaagtattacatccccacgccctccccgaccacgcacgaggtgctcgccgccgtggccgcagccggcggcgtggtgatcatcgcgcatccgggcgcggtgaatcgcaacgtgacactgctgtccgacagccagatcgagacgctgatcgaagaggggcttgacgggctggaggtatggcatcgggacaatccgccgcagcagcgggaacggctgtatgccatcgcgcaggcgcatcagctgctggtcaccggcggatcggactggcatggcgccggcaagccgaaccatctgggcgagaacctgactgatgacgagaccgtggccgagatcgtgcggcgaggggcgatttcgctggtctgacaccgaccatcgaccccggctgtagagaaaacacaaaaccgggagcggccgcagggcgttcaaaccctccggtcgctcccggtcgtcactgtatatccggccgactcccgcctacgcacaaaggcgggagaggggagccatctgagcccggcgttcggtcagagcgccccgaagcccacggcgtgcttggtctcggagccgatgagcgcgtatccgagcgcgttcgccggcacgatgatgcgacggcccttgtcgtccgtcagcttgatcggggttccggccgacagcgccgattcgatggcctcggtgacgctggccgcgtcctcctcggtgctgaaggtgacgggtcgcgccacattggcgatgcccaattcgatgtccatgtttgctcctctcgggatgatgcgctgttgaaggcgctgggtggatgatgtgtccgacgcccgtttgcgccacgggctttcagtcgcatgcacgcgtgccgatgaaagccattgtgcattgctcccatcgacgtgcgtgacggttttcgctgtaggctacttgccttgcgatgactgcagctcggactgggcgtcacgcatggcgcgttcctcacgttcgagcagcgggatgacgatggtcggggtgtcgcgcgccgccgacgcgccgtcctgtcggtccggcgttgcttgggacggggcgtcttcgatatgggcggccggcgtcgcgttcggcgtgcggtcgtcggtatcgtccgtggtgcctgttgcgtctgcatcgcccgtgtcgtcgctgtccccgcggctcagcgtcatcgttcccgatgtcgtgcccgccgttgccgtgacatgttccgtctcagcgctgtaccgaattcccatggtctgcggatcgaactccccggccgccttgatgtccgcggaaccggtgcggtcggtctcgtcggtgttgtcgttcgggtcggcgatgtcgtcgggcacacgcgctccggcctgtgtcgcggccgcggccttgcgccggtcggcgtcattgagcagcgtgccgacggtgatggtcgatggcggcttggacgactgggcacccgacgtcgtcgcgggcgcggtcttacgcgtgaatgcgccgagctggtgggccagccgctccacctgcgccttgaactggatgattttctgactatcggcccggttcaacgcatcgatgaactcgccgacctgctccatttgcagccacaggttcgcgcgcagcatgatcagatcgtccagacgagaacccatcatgcggccatacgccgcaagcaccgcattgcggtgatcttcgtcaagcttgccgaaaatccacgcgagatcgcgtgccggatcgttgacctgcatgttctgccagttcgtcaccgcggtgatggtcgcgccggaaaacagcacgtcgccatccgagaacccgccatgcaccgggcaggtgacgaacgaccacaggccctccgtctcgatgatccggccccagctcgacgtgatttccggcggcacatggcccgcctgccgcagccgcttgatccaggcggtcagctgggcgcgaatctgcccggtggagaataccggatacgattcggcctgcaggaaattcggccgcagccggtgaatggcgccgatggccgtgcccatcgccgcgcaatcatccaaagtaagcagatcgaggggtcttgcgacgccatcgttgtgcgccgccaccatcacggtcgcgccgccggtgagcgtgcttttctccttgccgtcaacgaatgcaagcaccgtatccagggcgaatccgagaccgcccggatccttggcgcgctccagcgtcctggcggcctgcacgcgcccggtcaggcgcttgcggccgtcttcggtgtcgcatgcgtatatgtcatacatcctgcctgcggcatcctgcatcacggcctgatcgatgcccgcggcgtcgtcggtgtcgttggcccgttcgctgtctcgcacgccggccatgacgatgctgggcatcgccgccgaggcgagtgccgccaacataagcttgcttcgttgagtcacactcccacactaatacaatgtcgcgcctcgcgggaggcaattggccgtatgactcgcggaaaatcacggtttgcccactatgctggcagcgcatcggccgggcatgcgccacaatggaggatatgagtgcatcgagcgagacgattcttgaggggctggacgatgcgcagatgtcggccgttaccgcgttggacggcccggtgcgcatcatcgcgggggccggagcgggcaagacccgcacggtgacccgtcgcatcgcctatgcgtgcgcgcggggggattgggatgcccgcaaggtgctcgccgtgacgttctcggtgaaggcggccgcggagatgcgcgcgcggctgcagacgctgggggtcggcgacgacgtgaccgctgcgacgttccattctgcggcattgcagcagctgaggcgtgtgtgggacgacatcttcgagacgccgctgccgcacgtgacctccgaccagcgcgagaacgtggagagggcgatcagacgggtcaccaatgccgcggacatcgatgcgcagcaggtgcgtgacgtcagggcggagatcaactggacgaaggtgtcgctggtggcgcccgacgactatccgcgcgtgtgctcggcgacgcaccgtcagccgccggcggagctcgatccacagcgtttcgccgacgtcatcacggcgtacgagggggagaagacggtccgcggacagatcgatttcgatgacattctgctgctcgtgtgccatgtcatggatgattacgaagagttggccgcctcgatccgctcgtcgattggctggctgacggtcgacgagtatcaggacgtgtcgccgttgcagcatcggctgatgacgctgtggctcggaaacaaccgcaacgtgtgcgtggtcggcgatccggcgcagacgatctactcgttcgccggggcgagcagctatgacctgctgcatttcgcggacgagttccgcccgctgaccgccgacgtcactctgaacacggattaccgctcgacgccgcaggtggtgcggtatgcgaaccgggtgctggccgccgcgccagaacgggaacagtatctggtgctgcgttcggcgcgttcgggcgggccacgcgtgggccacacatgctatgacaccgatgaggaggaggcgcggggcatcgccgcgcggatagcgcgtctggtcgccggcggtgtggatcccggcgattgcgcggtgctgacgcgcatcaacgcgcagcagcccgcgatctgcgccgcgcttcgggccgagggattgcgataccgggtgaggcgtgactccggatggcagaactcggcgctcgcggatgatgcgcagagccgtctggccctgctggaggccaagggattgagtgctgcagcctcatcggtgaccgtttcgacgattcacgcgtccaagggtctggagttcccgtacgtgttcatcgtcggttgctcggaggggctgattccctacggcgcatcgattgcgggcgaggctttggaggaggagcggagactgctgtatgtcggcgtcacccgcgccgaggacggattgcacatgtcgtacgcgcgggccaaggacgagggctcccgtcccaatcgcctccccagccgcttcctcagctgacccaaggcacatgtcgcgtgcccctgctggcgggggcacgcttgtgtgtggtgacgttacttggcggaatcgttttcgtcgttttcgccgccgtcctcgccgagcagtttgctcagttcggcgtcccagtcgatggcgccgccatcgttctgcgcctcggctccgttcgcggcgtcctttgtgccgtccttcgcgtcacctgcgacggaagctccgtcatccgttccggccctcgtaacgcctgaggccgtgtcccccgcggctccggagtcgacggtcttggcctcatcgggcaatgctggcagcagatcggggtgggaccaggcgccgtcgcgcccttcgacaccacgctccgcggtgatctgctcccagagggccgccgcctcgcgcatgcgcttggggcgcagctgcatgcccagcagcgactcgaaggtgcgttccgccgggccgcccaccgcgcgcttgcgcctcatcatctcacgaagctgctcgatatgcggaatgtgcgccatgccggcgcgccacgtcacgcaatccacccagccttcgacaagcgccatcagcgtctccagcgagaccagcgcctcacgctgctcgggcgtatcggggatgcccaccttggtcaggttcaccgcgccggagatcgactccggatccatcgcgcccgcatcgcgaagctgctcctccatcgcgtcgagatcgatggtgatgccacgcgcgtatttgccgatcagcgcttcgaaccgcggcatcagccacggcactcctgcgaacagacgggcgtgcgtgacttcgcgcagcgccaggaacgccgtcacctccgcgacggggatgtcgagcgacgtcgcgtattcctcgatgttctgcatgatcagtccgcccgcggggttcttgagcagcgcgatgccctggtcgaagctgccgttgacctcgtgcgacaggtctcccgcggcgtgccccagctgcatggcgaatgacgtgttgcccagcagcttgatgagctgcccgggatccttcatgccatcggggacgggaatcggcaccggtccggcgaacatgcccgcgatctcgccgttgaacgagttgccgagacgctcggagatcaccgaggcgagcgcgtcgttcatcgactgcgcgaccggcccggcgaatttcgcccacgattccagcgtgtcctcgacccagccggcccgtgtgagcatctgcgtctctcctgaggtcgggtcgaacgtgcaggccgtgtccagccacaggttggcctcgctgagcgcccgccgcgcgatgtcggccgactgggcgctcaccgttccctgcgagccgtcggcgttcgccttctgcaatgcgatggacttggcgagtttcacgttgatcggcccggattccacggtctgcttcatatctccgaacgtgttcagtccgccggcggtgaacgcctgcatgagcgattgcacttcctcgggcttggggagcttgccgatatcctggctcatcagctgctcgcggatctcgtcgggcagctgcgaaagctggttccatgccatttcgccctgcaccggtccgaagcaatcgatgaaccattgccgcatcgcgttctcatccatggtgtttcccgccttatgtgttaacgtcagttgattccatattatgggaggtatggcgaatatgcatgaaaacaaccatcttcacgcgcacagcgcactttcgcgcatccgcaactacctcggctcgcactcgctcaggtatttcgccggcgccatcgccgtgatactggcagtggtgacgatgatgctgccgtccgcgtatacggtagagggcccggggccgacgcaggatgtgctcggctcgtcgtcaggctccgatgtgatcagcatctccggcgctgaaacccacaaggattctggtaagctgctgctcgtcaccgtcaacgccgccggcgtgcccgggtatcccgtcaccaacgctcaggcgttggccgcatggcttgatccgaagcagaccgtgatgccgcaggaggtcgtgttcccggtcgggcagaccagcgaggagtacgccgaggaatcctcccaggagatggactcatcccagtcgtcggcgaccaatgccgcgctctcgtatcttaagggcaagggcatggacgtctccggcgtgaaggtgtcgatgcatgtcgacgacatcggcggcccgtccgcaggcatgatgtatgcgctgggcgtcatcgacaagctcaccgaagccgatgagaccggcggcaagaccatcgctggcaccggcacgatcgacgcgaagggcaaggtcggggccatcggcggcattcgactcaagatgctgggcgccctgcgtgacggcgcgacatggttcctcgctcccgagtcgaactgcaatgaggtggtagggcacgtgccgcagggcctgcgtgtcgtcaaggtgtcaacgctcgatgaggcgtatcaggctctggtggcgatcggtcaggggcacaccgacggattggccggctgcaccgcatcgtgagtcgcccatcccggcccgccggaacgcgtccggacgaggcacggaaccggcctgtccatgcggcagcgggacggccgggaatcggccatgagacggacgcgtccatcggcatgtcccgtatcaattgcgagaaaaacccaaaaaacatccggtttttcggagtgttaacgtcgctgttcccagcgttttggtaatgtgttcaccgtgaatgaaacggcatcacagaacggtgaagaatttggtttccagtccggcgacatcgtgcaggaatggttgtgggatgacgacgtcgatgactcggtgcgcgccaagattgaggatctgaccggcgaggatctggtcgacgaggactatgattccgcagtcgacggagccattgtctggtggcgggacggtgatgacgaggacgagctgtccgacaccatcgtggacgcctattcggtcgtcggcgatgatggccctttctgggtgctgacccccaagcccggcaggaccggcgcggcgagttccagcacggtccagtccgccgccaagaccgccggcatgaacgcggccacaccgctcaccgtaagccccgactggaacggcatccggcttcgggcgttcggcaagggacgctgatccggcctgtccgccggcacgataccagcggacgatatcgacggcggcatcatgcatgccgccgcatctgacgtacggcatcagaggcatcatgcatgccgccgccgtcacagccaacatgcccggggcgcgaaccgccgcacatggaatgagccgtgcacgccgtgaagcgggccccgcgaatcagcgctgcgccacggattgcttgtcaatcagcgtgcaatgaatcttcgccggtattgaggcgtccaacggcggcaggggagcggtcgtctccggttcgtcatcgtccggctcccgaccctcgatcagcgataccaatttgcgcgtcgcccaataccccatctcataatgcggcagctccacggtcgtcagctgcggctccagcgtctcggcgaacacccggtggttgtccacaccgaccacggacacgtcccggccgacgaccaggccacgtctcgccgcgttctcgtacacgtaccatgcgcgggcgtcattgaagcagaagtacccgtcgggccgcctccgctcgaacaggtcggtcacggtctgcaacgcaggcccgttgttcggcacggcgaccaccagcgactcgtcgaacggcatgcccgcctccaacagtgcacggcgatacccctccagccgtccctgctgcgcgagcatcggctccgagcagccgatataggcgatgctcgcgcagcaggcgtcgatcagccgcttggtcgcgtcgtagccgatgagcgtttcatccggttcgatgctggcataccggccggtgcgatccgtggcgtcgacgagcaccagcggataatcgtgcaacggtttcggcacgtcggtgaaacggttcgacatcttcgcgtaaaggaacccgtccaccccatagcgtttcagcgtggcgatctccctcgcctcgtcgctgttgccgtcggtgttcacggtcagcagcatataccccaacttgctggccgcgtcctgcgcgccgaggatgattccgcccgcatagggcgtggcggcgatcccctcgctgatgaaacccaggatgcgcgtcttgctggtgcgcagcgagcgtgcaagcggattaggccggtagccgagccgcttggcggtggcgcgcacctgttcggcgatggcgggtttgacccggccctcgtcgcgatcgttcaataccaaggaaacggtagagaccgacacccccgttctctcggcgacctccttcatcgtcgtcataggaagaacggtacacgcaatctgcgggtttcgcaggattgttcacgctattgacatccgcctgccggtgccatgcaatcgctcggtggcggtcatctggtggcggtcgcgggcacaggcagggcggcggttattcgtcgccggtcactcgcttttgccggagaggatggcgtcgacgatcttcggcttctcggtgagctgaccggtgaatccagggcggatgtccatgtgtagcacgaggctcgtgcggtagccctgctcggcgagcttcttggcggcctcgccggccactttgagcacctcgtccaggtcgccttccacgttggtgaacagcgcattggtctcctgcggcaggccggattcgcgaatcaccttgacggcctgcgccacatatggcgacacctcggagccgacgccgttcgcggagacctgtatagccgccacggtgttgagatacggcttgccggtttccaggtcgatcggcacttcctgcgtgacggcgttgcggtcgatggtcatatgaatgccccctgattggttggttgttgctgtgttggatggtctgtatatacggtatgttccggccggcgtcgccataagggatccgcctgccgcgtgcaggtcagcgccagtgccatgcgtggtccatcggcccggaaccgtggccgaggttcagctgcgcgccgagcgctccggtcagatagtccttggcatgacggatcgcgtcgggcagtgcctcgcctttggccagattcgaggcgatcgccgacgacagcgtgcatcctgtgccatgcgtgttcggattgtccacgcgcacgccgtgaatccatgtcgcgacgccatcggcatacagcaggtcgctcgcatcggccacgccatgcccgcccttgacgagcaccgcgcagccgtaatgctccgacacggtgcggccggcgtcctccatcgccgtatcgctcacgatacgcgtgctctcacggtcggtgtcctcagcccatttcgcagggtccagcgaggctccccggtgggcgatcaggtcaagcagcacctcggtttcggggatgttcggcgtgatcacctcggccagggggaacaggcgctcggtgagtgcagtgatggcgtcgtcatcaatgagcttggcgccggacgtggcgaccatcaccggatcgagcacgatatgacgtgcgtgatgggcctccagccggtccgctatcgtgcagatgagttccgccgacgataccatgccgatcttgaccgcggccggtggaatgtccgtgtacaccgcgtcgatctgtgcggcgaccatgtccggtgtgatattctgcacacccgtcacgcccatcgtgttctgtgcggtgatcgcggtgatcgcgctcatgccgaacaccccgttggcgagcatggtcttcagatcggcctgaatgcctgcgccgccggacgaatcactgccggcgatggtcagcaccggaggcagcgtggattgcgccgccgttgtgtcaagttgctctgtcatgccgttcattgtagccggatggtcttgaaattgcgctgtttctatggtgagatggagtcgttttgcaatcgctgaccatggatcggcgaccacggataaaggagagctgcggcgagatggcgaatgacgatatccttcggcgtgatggtgttctggcgcgtatcaccggcttcgatgaaggacgcaccgcatattatgcggtgatgccgaacggccacagcacgcagctgacgttccccagccaggagatcttcgacatcggcgacgtgctgctggtcggcaaggacttctatacgaaggtgccgccctcggtgtggccggtcaagccgcgtgtcggcgtaatccgccgtgcgctggaggattgcgtggtcatcgagacctcggatggtctggaattgctggaaggcgaatatccggtcgacatcgcgcccggaaacacggtggagttcaccgatctgttcggcatcgaacgggtgctgtggccgaccgcgattcggccgggggagtccgaccatgatgacgacatcaagcagtaccgcctcacgccgagcgccgatccgtcgctcacgttcgcggcgttcggtgggtatgagcgggtgatcgcccgcgcgaaggagctgatcgagacgcagctgggcaacagcgcccagatgcgggcgatcggcgcgaagcccatcaagggcgtgatcttcaccggcgcgccgggtaccggcaagacgcacctggcccgcatcatcgcgaacgtggctgacgcccagttctaccttgtctccggtccgacgatcgtcagcaagtacgtcggcgacagtgaggagacgctgcgcatgatcttcgccgcggcgcagtccgacaagcgcgcgatcatcttcttcgacgagatcgattcgatcgcctcctcgcgcgagaccgacacgaacggcgtcggcaagcgcctggtggcgcagctgctcacattgatggacggtttcgagtccaagggcaatgtggtggtggtcgccgcgacgaaccgcatagaggacgtggatccggccctgctgcgcccggggcgtttcgattggcagattccgttcccgatgccgagcgagcatgaccgtctgcgtatcctgcaggtgcaggccgcatcgctgtcatgcgagggcgagctgccgttgaccgacgtcgccgagcgcaccgagggctggagcggcgccgaagtgtgcgccatctggaccgaagccgcactggtggccgccaaggacaagcgtgccgcgatccgcgccggcgacctcatgaccgcattcgagcgcgtcgagcatcggcccgagttccgcgcacgccggcactaggtgcgagctcgattctcggctcctgcttgcggtaagggatggttcttgccctcgctggcggccgcaggccgtccttgattgcagggcccggagggctcccgcgtagcgggcgatggtgtggtcttgtgtttcgtcggttttgcatccgttctgccgtttgtccaccctccggtgctgcgtgccacctcccgccagcgggaggggatgggtcttgtctgctggtctgattgggatgtggagtcttttgttccaaagtgtgagacaagtcgaggattttgtgccacaccacgtcgaaaacgccggttttgcgcgtggtgtggcacaggaccttgctgcggaatcggttttaaccggttacatacgctgccgtggtacaagaggaatatcggcaatccttgaaaaatggccgattccgctgtccggtgcgaatcctcccgtatcgggcgtgtaccacaccacggtcaaaaacgtgtttttcgtcctggtgtggcagcgacttcgccgtcatggctgcacccgcacagcctcatccgcacagccgcacccgcataaccgtcaccgaccggcgggagagcgacgacctgatgcgctaccgatgcgcccgcaggaagtgcttgatgagtcgcaccaaggcgaatcccacgaatgagaatacggtgaataccagcatgaagtatccgatttgctccatgcagccccatgaaagctgccatccgccaatcgaggtgcagacgtcggccttcgcgcaaggaccgccttcgaacccgtggatcagagcgaacagcagcgggagtgagaccgctacgcatccgagagggaatttccaagtgcttttcctgaagcaggcagccgcgatattgatgataagcaatactggaggaacaaggaagttgatcatcagtgcagcggccatgaagccctcataatcgggctgaactatacaggccagaagcaggccgtaaaggacggctacgatcagcatgcaggcgaatcgtccgggattgccgcgtatccacgaaccggatttcgacagtatggaaaggctgttgttcgtcgtactcatggaatccctttctcgacattgagcaacgtatatccatgatacgggatggcgcccgtcagaggaagagccgcaaatacgaatgccccccgctagcggggggcattaccgatgaaggctggagcttactcgctggccttggagtagagcttgccgccctgggcgcggtacttttcacccatggcgtccataccggcaaggatctcctcggggctcaggacgttggcggacacgacggtgtcgtcggtgaccgggttcgccggggtctcgacgccctccgggatcttgccggcgacggcgtccgcgacgatctgctgctgggcggcctcgccgccgaacgccttgcggatgttctgcgagatggccatcgagcagaacttcgggccgcacatcgagcagaagtgcgccatcttggccggctcggcgggcagcgtgtcgtcgtggaaggcgatggcggtatccggatcgtagctcaggttgaactggtcgagccagcggaactcgaagcgggccttcgagatcgcgttgtcgcggtccatcgcgtgcgggtggtgcttggcgatgtcggcggcatggcaggcgatcttgtaggcgatcacgccctgcttgacgtcatccttgttcggcaggcccaggtgctccttgggcgtcacgtagcacagcatggcggtgccgtaacggccgatttcggtggcgccgatggcggaggtgatgtggtcgtagcccggcgcggtgtcggtcgtcagcggtcccagcgtgtagaacggggcgccgtggcacacggccttctccagctcgatgttcatgcgcaccgtgtcgaagggcacgtggcccggtccctcgatcatgacctgaacgtccttggcccaggcgcgctcggtgagctcgcccagggtcatcagctcgctcagctgggccgcgtcgttcgcgtcggccagcgagccggggcgcagaccatcgccgagcgagaatgccacatcgtacttggcgaagatgtcgcacagttcgtcgaagtgcgtgtacaggaagctctcctgatggtgacgcaggcaccagtcggccatgatggaaccaccacgggagacgatgccggtgacgcggttggcggtcagcggcacgtagcgcagcagcacgccggcgtggatggtcatgtagtccacgccctgctcgcactgctcgatcacggtgtcgcggaacagctcccaagacagcttggaggcgtcatcctcgaccttttcgagcgcctggtacatcggcacggtgccgatcggcacgggggagttgcgcaggatccactcgcgggtggtgtggatgtcgttgccggtcgacagatccatcacggtgtcggcgccccacttggtggcccaggtgagcttctccacttcttcatcgatggaggaggtgacggccgaattgcccatgttggcgttgagcttggtgaggaaggcggatccgatgatcatcggctcggcttcggggtggttgatgttgcagggcatcacggcgcggccggcggccagctcggagcgcacgagctccacgtcgcagttctcgcgggtggcgacgtactgcatctccggggtgatgatgccgtgacgggcgtaccacatctgggtcaccgggtggtccttggcgcgcatcggctggtgcgtgcgtccacgccattccttggtggcgcggccgcgcttgatggcgcgcttgccgtcgtcctgcaggttgcggcggcggccctcgtagtcctcgatgtcgccgcggtcgcggatccagtcgaggcgcaggggcttcaggccctccttcgggtcgcacttggggccttcggtgttgtagtcgtggaacggggtgttcgggcccaccccgggggtgtcggagagcttgatctcggtgtagggtacctcaaggtcgtaggagccgtactcgtaggagaacggcacagacttggtcttgcggatgtgcgccttgtcgcgctgcttggacccacgggcggcgatgtcgacgcgctgctgcttggcgagcttctgcgcgtccttggcgtccttggcgttggtgaacttcttttcggtggcctcggccccggcggcggcgctgccttcctgcgcggcctgcgtgtcggtggcgggggtgtgggtcacgatgcgcggggcgtatccgtggcgctcatctgcgcgcacggccttccagccggagaccatctcgcgggtggcggcctcggggtcttcggcgcccgcgatggcggagaccgcgaaccagccggcggccttcgtgccggccagcatggccatgtcagccgcggtcacgccgccgccgacgacgaccgggaactcgctggcggagcagatcgtgttgatctgcgcggcatccagggtcttgccggagccgtcgttgccgcccaccgaggcttccggcttggtggaggagacgtgcagaggtccggcgccgatgtagtcgatgcagccgtcgggcagctcattgatgagtcggaccagggactcggtctcagccgacagtcccacgatcgcttcgtcgcccagcagggcgcgggcctcgcgcggctccatatcgctctggccgatgtgcacgccgtcgaccttgatgcccttgcggcgggcctgccacaccacgtcggcgcggtcgtcgatcacgaaggccacggagtcggacttctcgttgtcctcgatgatctgcgcgatgtcgcgggccatctcggtcagctcagaggcgtcggcgcccttggctcgcaattgaatgaaggtggcgccgccatgcaaggcctgatcgatcacctcggtcagcggccggtccttgcagtcctgggggccgaccacgaagtacgcgctcaggtcgaacgaatcgcgcatggacgcgaatgggtattcattgctcatctgttgttcctttaattgtgttattggaagaatatgatgccggcgccactcatcgggagcaccgggaggggcggctatcgcatgtcgatcgcgcggtctgccacctcctcggcggtaacgttccacagcgcgtccagcagcgccacctggaacgaaccggggccgttgcttcgtttctcggctatctcgccggccgtgttgtacagcgatgtggcggcgagcgcggcgatcagcggctgcgcgacggcgagatacacggcggtgacgccgccgagcgagcatccggcgccggtgattttcgtcatcatggcgctgccacccgccagccggtacacgtgttcgccgtcggtcaccatgtccgtcgcaccggagacggccaccgccgccgtgccgttggcgccgtgcctcgccatgaaccgtgcgagccgctgcgccggtgcgatggcggattccacgtcgtcgacggattccacgccggcgggcttggatgcggtagcggtcgcggattcctcgttcagcccccacatggcgtcgagcgcgatgatctccgaggcgttgcctcggatcacggtcggcggatagcgcttgaatgactgcaatatggcggttctggtctctccaatgccggcggcgacggggtcgagcacccagggatggccggtgttgtggaacgccctcgccacttgcggcagcgcgtccttgtagaacggcagcagggtgccgacgttgatgtagtcggcgccgctgatcgtggcggtgtcgatgatgtcgtccggcaggaagctcatggccgccgcgcctccggcggcgagctgcgcgttggcgacaaggttgatggtgacgaaattggtgaaggactgtgccagcggcgtagtctcgcgtaccgtgcgcaccgcgtccgctatctgctcgcgcagtgatggctgtgtttgcggcgatatccgcgtgttcggcgattcctcgctcataatcattgctccctacgatggtcttgaccaacaggttcaaagggtcaggcgtgtggcctttctcaactcgcgtactgctgcgggttcccctgcattgtgcccttcaacgctatggcccaatatggacattgtgtcttgcgtttcttggaggtacgtggtaatggcgccgtttcgttgccggcatgcgttgcgttgcgatttttccggccctgtatgggggatacaggattggcgatggcgacacgccgtttttgttaatggcatttacatgaaatacaggtaatgagatatcattctcatgatcaccgtgtggatatcgcattggtgcgtatacactaacagcaacagagcggcgcggcaggcgctcgtggattcaatgaagaaggaacgtttatggcagttcgcagacttggtggccgcatcgtggctttcgccgccacagtggccttgtcaataccgttagggttgttaacaaattcagcgtgggcggtcgaggacgccacccgatccgactccaccacgcagatgagctccacgccggaggtggtctactccagcgccgtggattccaagcagaatcgcacctcggatttcgacgccaactggaagttcatgctgtccgattccgtgcaggcgcaggatccggcgttcgacgattcggcctggcagcaggtcgacctgccgcatgactacagcatcacgcagaagtattcgcagagcaacgaggccgaaagcgcataccttcccggcggcaccggctggtaccgcaagtccttcaccatcgaccgggacctcgccggcaagcgcatcgccatcaacttcgacggcgtgtacatgaacgccaccgtctggttcaacggcgtcaagctcggcacccatccgtacggctactcgccgttctccttcgacctgaccggcaacgccaagttcggcgaggagaacaccatcgtcgtcaaggtcgagaacaggctgccgtccagccgctggtactccggctccggcatctaccgcgacgtcaccctcaccgtcaccgacggcgtgcacgtcggcaataacggcgtggccatcaagaccccgagcctcgccacccaaaacggcggcaacgtgacgatgaacctcaccaccaaggtcgccaacgacaccaaggccgcggcaaacatcaccctcaagcagaccgtgttccccaagggaggcaagaccgacgccgccatcggcaccgtcaccaccgcatccaagtccatcgcggccggtgccagcgcggacgtgacctccacgatcaccgccgcctcgcccaagctgtggagcatcaagaacccgaacctgtacaccgtgcgcaccgaagtgctcaacggcggcaaggtgctcgacacttacgacaccgaatatggcttccgctggaccggcttcgatgcgaccagcggtttctcgctcaacggcgagaaagtcaagctcaagggcgtctcaatgcatcatgaccagggatcgcttggtgcggtcgccaaccgccgcgccatcgagcgccaggtcgagattctccagaagatgggcgtcaactcgatccgcaccacgcacaaccccgcagccaaggcgctgattgacgtctgcaacgagaagggcgtcctcgtggtcgaagaggtcttcgacatgtggaaccggtcgaagaacggcaacaccgaggattacggcaagtggttcggccaggccatcgccggtgacaacgccgtcctgggtggcgacaaggacgagacctgggccaagttcgacctgaccagcaccatcaaccgtgacaggaacgccccgtccgtcatcatgtggtcgctcggcaacgagatgatggaaggcatcagcggcagcgtctcgggcttcccggctacctccgccaagctggtcgcatggacgaaggccgcggacagcacccgcccgatgacctacggcgacaacaagatcaaggccaactggaacgagtcgaacacgatgggcgacaacctgaccgccaacggcggcgtggtcggcaccaactactccgacggcgcgaactacgacaagatccgcacggaccacccctcatgggccatctacggttccgagacggcgtccgccatcaacagccgaggcatctacaaccgcaccaccggcggcgcccagtcaagcgacaagcagctgaccagctatgacaattccgcagtcggctggggtgccgtcgccagctccgcctggtacgacgtggtccagcgcgatttcgtcgccggcacatacgtgtggaccggcttcgactacctcggcgaacccaccccgtggaacggcaccgtctccggcgccgtgggctcctggccgtcgccgaagaactcgtacttcggcatcgtcgacaccgcaggattcccgaaggacacctattacttctatcagagccagtggaacgacgacgtgcacacgctgcacatcctccccgcatggaacgagaacgtcgtcgccaagggctccggcaacaacgtgccggtcgtcgtctacaccgacgcggccaaggtcaagctgtacttcacaccgaagggcagtaccgaaaagcgactgatcggagagaagtccttcaccaagaagaccaccgcggccggatacacctatcaggtctatgagggcaccgacaaggactccaccgcccacaagaacatgtacctgacctggaacgtgccgtgggccgagggcaccatctccgccgaagcatacgacgagaacaacaggctgatccccgaggggtccaccgagggcaacgcgtcggtgaccaccaccggcaaggccgcgaagcttaaagccgatgccgaccgcaagacgatcaccgcggacggcaaggacctgtcgtacatcgaggtcgacgtgaccgacgccaacggccatatcgtccccgatgccgccaaccgcgtcaccttcgacgtcaagggcgccggcaaactggtcggcgtcgacaacggcagctcgccggatcacgactcctatcaggccgacaaccgcaaggcgttcagcggcaaggtgctcgccatcgtccagtccaccaaggaggcgggcgagatcaccgtcaccgccaaggccgacggtctgcaatcatccacagtgaagatcgccaccaccgccgtccccggcaccagcaccgagaagacggtccgcagcttctactactcgcgcaactactacgtcaagaccggcaacaagccgattctgccgagtgatgtcgaggtgcgctactccgacggcacgtcggaccgtcagaacgtcacatgggacgcagtcagcgacgaccagatcgccaaggccggttcgttcagcgtggccggcacggtcgccgggcagaagatctccgtgcgcgtgacgatgatcgacgagatcggtgcgctgctcaactattcggccagcacaccggtcggcacgcccgccgtgctgcctggctcgcgtccggccgtgctgcccgacggcaccgtgaccagcgcgaacttcgctgtccactggaccaagcccgccgacaccgtgtacaacacggccggcaccgtcaaggtccccggcaccgccaccgtcttcggcaaggagttcaaggtcaccgcgacgattcgcgtgcagcggtcgcaggtcaccatcggcagcagcgtctccggcaatgcgctgcgcctgactcagaacatccccgccgacaagcagtccgacacgctggacgccatcaaggacggctccacgaccgtcgacgccaataccggcggcggcgcgaacccgtcagcatggaccaactgggcgtactcgaaggccggccacaacaccgccgagatcaccttcgagtacgcgaccgagcagcagctcggccagattgtcatgtacttcttccgcgacagcaacgcggtgaggttccccgacgccggcaagacgaagatccagatctccgcggacggcaagaactggacggatctcgctgccacggagaccatcgcggcccaggagtcgtccgaccgagtcaagccgtacacctatgacttcgctccggtgggagccacgttcgtcaaggtcacggtcaccaacgccgacaccacaacccccagcggcgtggtctgcgccggcctgaccgagatcgagctgaagaccgcgaccagcaagttcgtcacgaacacgtccgccgcgctctcgtcgctgacagtgaacggcacgaaggtctccgactccgtgctcgccgccggctcctacaacacgcccgcgatcatcgcggacgtcaaagccgagggcgaaggcaacgccagcgtcaccgtgctgcccgcgcacgacaacgtgatccgcgtgatcaccgagtccgaggaccacgtcacgcgcaagaccttcaccatcaacctgggcacggagcaggaattccccgcagactccgatgaacgcgactacccggccgccgacatgacggtcaccgtgggcagcgaacagacgtccggcaccgcgaccgaaggcccgaagaaattcgcggtcgacggcaacaccagcacgtactggcattccaactggacgcccaccaccgtgaacgacctgtggatcgccttcgagctccagaaacccaccaagctcgacgcgctgcgctacctgccgcgccccgcgggcagcaagaacggctccgtcaccgaatacaaggttcaggtcagcgatgacggcaccaactggaccgacgcgggctccggcacatggaccaccgattacggctggaagctcgccgagttcaatcagccggtgaccaccaagcacgtgcggctcaaggccgtccacacctatgcggattccggcaacgacaagttcatgtccgcctccgaaatccgcctgcgcaaggccgtcgacaccaccgacatcagcggcgcgaccgtgaccgtgcccgccaagctgaccgtcgaccgggtggacgccgaccatcccgccaccttcgccacgaaggacgtgacggtgacgttgggcgacgccacgctgcgctacggcgtggactacctgctcgactacgcgggcaacaccgccgtcggcaaggccacggtgaccgtgcgcggcatcgacaagtactccggcaccgtcgccaagacgttcaccatcgaactgaagaacgccccggcgccggaaccgacgctgacctcggtgagcgtcaagaccaagccttccaagctgacctatgtggtcggcgacgcgttcgacccggcaggactggtgctgcagctcaactatgacgacgacagcaccggcaccgtgacctggaacacgcagacggccggcgacttcacgttcaagcctgcgctcgacgcgaagctcaaggtcaccgacaagaccgtcaccgtcacctaccagggcaagtccgcggtcatcgacatcaccgtctcgcagcccgccccgaccgtcagcaagacggatctggacaaggccatcaaggcgatcgaggccaagaacccggattcgtccaagtacacggccgactcgtggaagaccttcgcggacgccatggcgcatgccaaggccgtcatcgcggatgattccgccacccagcaggacgtcgataacgcgctcaaggcgctgaccgacgcctacgccgggctgaccgagaagacgcccgaacccgcccccgtcagcaagtccgagctggacaagaagatcaaggcgatcgaggccgagaagctggacgggtcgaagtacacggccgactcgtggaaggcgttcgagaccgccctggcgcatgccaaggccgtcatcgccagcgattccgccacccagcaggatgtggacgcggcccttggcgccctgacctccgctcgcgacggactgaccgagaagggcgaagtcaagcccgacccgaagcccgaaccgggcaccgtcgacaaggcggcgctggataaggcggtcaagaaggtcgaggccgagaagctggacgggtcgaagtacacggccgactcgtggaaggcgttcgagaccgccctggcgcatgccaaggccgtcatcggcaacgccaactccacgcagttcgacatcgacaacgcgctgtcgatgctcaacgacgcccgcgccgcgctcaaggagaagcccggccgcatcatcgccatcatcgatggcagcgcactgagcaagaccggcgcatccgtcgccatcatcgcctccgtcgcggccgcgatgctggcggtcggtgccggcgtcatggcgttgcgccgcaagcgctcctgacccccacgagactctcgcgagtctccccgggtgccccgtcgacgatcatgccggcggggcacccgcatatccgcaggttggatgctgccgaacaaggcggcatgctgtcaccgtctgccgttagactcgtgcgagcatactaagtccccaaaccgttcaaaccagaaggtgcattgtggctgtttctaaactcgatgaagtcgtatccctcgccaagcggcgcggattcgtgttccccgccggcgaaatctatggcggcacccgttccgcatgggattacggccccctcggcgtcgccctgaaagacaatatcaagcgtgaatggtggcgctccatggtcgtcacccgcggcgacgtggtgggcgtggacacatccatcatcctgccgccggccgtatgggtcgcttcgggtcacgtctcagtgttcaacgatccgctgatcgaatgcctcaagtgccacaagcgccagcgttccgacaagctggaggagtcctacgccgaaaagcacggcgacaagctgcccgagaacggtctcaaggacatcgtctgccccgagtgcggcacccgcggcgagtggaccgaaccgcgtgacttcaacatgatgctgcgcacccacctcgggccggtcgaggacgagaacagcctgcactacctgcgccccgagaccgcgcagggcatcttcgtcgacttcaagaacgtgatgacctcctcgcgttccaagccgccgttcggcatcgccaacatgggcaagtccttccgcaacgagatcacgcccggcaacttcatcttccgcacccgtgagttcgagcagatggagatggagttcttcgtggtgcccggcaccgacgaggaatggcaccagtactggatcgacacccgcacccgctggtacaccgacctgggcatcaaccccgagaacctgcgtcactacgagcacccgaaggagaagctctcccactactcgaagcgcacggtcgacatcgaatacaagttcggtttccagggctccgactggggtgagctcgaaggcatcgccaaccgcaccaactacgacctgagcgcgcattccaagcactccggcgaggatctgagctacttcaaccaggccaccggcgagaagttcgtgccgtacgtcatcgagccggccgccggcctgacccgttccctgatggcgttcctcgttgacgcctacgacgtcgacgaggcgccgaacaccaagggcggcgtcgacaagcgcaccgtgctgcgtctcgacccgcgtcttgctccggtcaaggccgccgtgctgccgctgagcaagaagcccgagctgcagtccatcgcccacgatctggccgccgacctgcgtcagcacgagtggatgatcgactacgacgaggccggtgccatcggccgccgttaccgtcgtgaggacgagatcgggacgccgctgtgcatcaccgtcgatttcgacacgatcgacgaccaggccgtcaccatccgcgaacgtgacacgatgcagcaggagcgcgtcgcgctcgacaaggtcgccgactacgtggccgcccgcgtgtccgagaagcgcgtgcgctaccccgagggccccgtcagcatcaccggcgccaaggccgccgacggcggcaccgacgtcgccaaggagaccggcgtggacgagtccgccccggtcaaggtcgccgaggccggtggcctgtactgatcgatacccggcccgactacaccgggccgggtgctgaacatcattcggacagcccccttttcaccaagggggctcttgtacattcaagacatgtatggcatgagccgtgccgattcgtgggggagagccgtgacagacaccgttgaacagaccatcgccgtcgacgcgcatgagaccgacgtgctcgacccgcgcaccgacgcaccggccgggaaggaaccggtcacgatggcaccagtcgatctcgggccgatccacgtgccgacgccggtggtgctctccccgatggcgggcgtcacgaactggccgttccgcgtgctgtgtgaggaatacggcccggacggcctgtacgtggccgagatgattacggcgcgcgcgttggtcgcccgcaatccgaaggcgctgcgcctgtgccggttcgcgccgagcgagcgcatccggtcgctgcagctgtatggcgtgaacccggccatcgtcgagcaggccgcgcgcatcgtcgtcgatgaggacatggccgaccatgtggacctgaacttcggctgcccggttcccaaggtcacccgtcgtggcggcgggtccgcgctgccgtggaagaccgacctgttccgcgagatcattcagcgcgtggtgaaggtgtgctcggcggcgaacatccccgttaccgccaagatccgcgtcggcatcgatcacagccatgagacgttcatggaagccggccacatcgcgcaggaggaggggtgcgcggccgtcacgctgcacgcccgcaccacggcggaatactatggcggccattcggactggagccgcataggcgaactggtcggcgcgctggacatcccggtgttcggcaacggcgacatctggggcgccgacgacgccctggagatggtccgcgagacgggatgcgccggggtcgccatcgggcgcggatgccagggccggccgtggctgttcgccgatatcaggaacgccttcgcgggcagcgacgagcgcgtcaaccctacgctgggggccgtatgcgacgtgatcatgcgccacgcccggctgctcgtcgagttctatgacggtgacgagcgcatggccgtgcacgacctgcgcaagcacatcgcctggtatctcaagggattccccgtcggagggacgacgcgcagggcgttcatggagtgtgagaacctcgccgacgtggagcgcgagacctcgcgtctcgatcccgccatcaccttccccgaacgggtgaaggacaagccgcgcggccgtgttcgctttgcaaaaaaagtgcatctgccgtacggttggctcgactctcgggtcaccacgcacgaggagcgcgagacgctgttcggcgacgatccgatggacgccggatactgagacggcatccgggtcatgggccgaatgcggccatggcgtgtcgttttgtgcaaatgagatggaaaaacgttgatacacgccgagaaaatagctttataatcaatggttctgcgatagagttatgcgtaaccgtgagtgacaggagacaatggtgagcgagattgcccagactgacaatttcaacgacaggaccaacatcaaagtcgtcggtgtcggtggagccggcggtaatgccgtcaaccgcatgatcgccgaaggcctgcagaacgtgcagttcgtggccatcaacaccgatgccaaggatttgctgcgctccgacgccgatgtgaagatctcgttgaatgacgcttcaagccgtggattgggtgccggcgccgatcccgagcggggcagcaaggccgcgcaggatcaccagtccgacatcgaggaggcgctcaagggcgccgacatggtcttcgtgacctgtggcgagggcggcggcaccggcaccggcgcgagccccatcgtcgcccgcgcggcgcatcagcagggggcgctgaccatcgccgtggtcacccggccgttcacgttcgagggaccgcagcgttccgcctccgccgatctgggcatcgagaacctgcgcaaggaggtcgacgccctgatcgtcatccccaacgaccggctgcttgagctgtccgaccgcacgatcggcatcgtcgacgccttcaagaccgccgattcggcgctgctcgccggtgtgcagggcatcaccgacctgatcacgatgaactcgtacatccatgtcgacttctccgacgtcaccgccatccttcgcggcgccggcaccgcgctgttcggcatcggctccgcgcggggcgaggaccgcgccacgcaggccgccgagatcgccatcagctcgccgctgctggaatccagcgtcgaaggggctcacggagccctcatcaacatcgccggcccgaccgacctcaagctgcaggaggcctccgcggccaccgagctggtgcgcaaggccatccaccccgaagcccagatcatctggggtctcgcgctcgacgacgcctacggcgacgaggtccgcgtcacggtcatcgcggccggtttcgacgccgattccaagaacaccaacgtaccctcgatgaagggcgccacgaccgccgcatccatcccggcttcccacaccacggaccccgtcacgccgacgcacgcgcacgaccagcagcagccggtcgcgccgagcatccccgtgcgcacgcagccatccgcgaacacgcccatgaccaccaccaatccggcggcgcgtcaggtgccggatttcgcgctgcgcaagggcggccccgcgtcgatgccgatcgatgacgagacctccgagcacgatatcgtctcctccggtgacctgggcgacctcgatatccctgattttctgcgctgagccgaaaggaactgaacagtcatggctgggtttatgaagaacgcgatgcagtatctgggcatggcggatgttgccgaagacgacgagccgatggacatccaggatgaggatcccggattcgacgacgatcattcggtcactccggtgtcccaggctgcgccatcgtcgccgacatccgcgcccagccgtgagtcgaatccgttccagggtcgcgtgagccgcatcaccacgattcatccgaagtcctacgaggacgcgcagctggtggggcgtgctatccgcgacggcgtgcccgtcgtgctcaacctgaccggtgtctccgaggccgtggcgtaccgcatcgtggacttttccgcgggcgtcgtcttcggcgtgcgcgggtccatcgagcgtgtcactccgcgcgtgttcctgctcagcccagcccaggtgaacatcaaggtggaggagccgcaggcgccgtcctcggcgcacgacctgttcgccgactgatctgccggcggtcgtccggattggcggctgtagacgattcgtcgtcatgacagcggcggcggtaatgcccagttgacgttcagctgacggcaatgaagctgtatgccgttttgataggctggaaggcatggtgttcacaatagtgcgtctggtgattgactggattatcgacgcttatatcacggtgctgttcgtccgtatgatcctggattgggtgtcggtgcttgcgccgcgttggtatcccaagggcgtcgtcgcatcgctgatcaatgtcgtctaccagctcaccgagccgccgttgcgctggctgcgacgctacatccggcccataccgatggggcctatagcgatggacgtcagcttcatcgtgctgtacaccgcacttgtcgccttgagaatattggtgtaaatcgcgccgtaatcacgcatacggcgagagttctttcagggttcgtgctagcatcggaaggtgataccaacacagcgaggcatcgtgcccaaagcgaggtgtaagttttatggctcttttgacgcctaaagatatacgggagcataccttccagaccgtgcgtttcaaggaaggctatgatgtcgacgaggttgacgattttctcgatcaggtgacggaaaccgtcgaggcgcttggcaagcaggccgttgcaagtggccaggcgacgcagtcccttcctcccgacgtcgccaagctcaactccaagatttccgagttgactgcgcaggtacagtcactgcagagcgaaaacgagcagctcaagtccgcggcgcccgtcgccagcaaggacgatcaggcggctcaggtggctgcggcgaaactcaccgaagccgaggagagcaaccgcgcgctgtcccagcagaacgagcagctcaaggatcaggtggatcgcctcagcggccagatcgaccagctgaccgcgcaggccgcccaggcctccggcaaggccgatgtcgccgcgcagctcgccgcggtgcagaacgagcgcgaccagtaccgcgtcagcgccagggacatgagcggacgtctgcaggaagcgcagcagcaggccgcctcctaccagcagcagctcaacgatgccaagaagcacctcgatgcgttgcagcagcaggccgcgcaggcctccgatctggctcgtcagctggaggagtccaagcagcgcgagaaccagctgcgcgagcaggtcgccaaggtcgagccgagcacggagaccggcagcctgcagaagatcgctggtgccgccgccgctgccagcagcgagcccgagcgcgccaccgccatgctgacgctggccatgcagctgcacgaccagtacgtcgacaagggcaaggccaaggcgaaggaaatcaccgaggccagccagaacaagtacaacgagctggtcaccaaggccaacgactactcgtcccgcacccgtaccgaggccgatgagtacaacaagcaggttcactccgatgccgacgcgtactcggagcgcactcgttccgacgccgacgcctactcggtgaagacccgtcaggatgccgacacgtaccgcgagaacacgcagcagcaggccgacaactatgaggacgaggtgcgtcgtcgcgccggcgagtacgacagcaagacccgctccaacgccgatgagtatgcgcagcaggtgcgtgacaagctcaccacccagtccaaggtcatcgagggcaacattcagggcctcaagcagttcgaagccgaataccgtgcgcgtctgaccgagttcctcggccagctgtctcgtcaggtgtccgatacgaacaactacagccagatcggcaagcaggcggaatagtcgatgaaggatatccaaggacggctgcgtgttcgcgtagccgtctttgcatgtgtggcggccgtggcgctgggcatcgatcagctcaccaagatgtgggcgcagcaggcgttgggcgacgggcgtacagtgccgctgatcccgggcctgctttcgttgacgctggttcataatccgggtgcatcgctcggtctcggatcgggaagcacatggctgatttcgctgctcgccgtggtggcgtgcgtggtgatggcggtgctggcggcacgcacgatatcgatgcgctggacggtgatgttcgcgttcgcgttcgccggagcgttcggcaatctgatcgatcgcgtggcctatgcggacgggttcctcaatggcaaggtcgttgatttcctgaattatggctggtccgtgggcaatgtcgccgatatctatctggtgatggccggcatcggcgtcgtggtgctgattgtgctggatgtgccgttcagtcgcaaggacctcgatcggattgagcatctgggggaggatgccggtgacgtggcgcgtgacggggagtcagacggcacggcggacgaatcgcaggactcgtcagcgatggtgcaggatgcatcgtccggctcatcccggacggaggtgaccgtttcgagccgtcagcctgatgactcggagaggagcgcttcatgagccgtctcgttccggcgcccgacgcattggtgggatcacgattcgacgtggcggtttccaagatgctgggcatctcgcgtgccaaggcggcggatcttatcgaatccggccaagcccgcgtgctggatcgtgcgatcgccaagtcgggcacgctgctgtatggggagaccgtcgaattcgacatcgccgaagaacggcatgagccggaaccggtgtgtctcgacatggccatcgcgtatgaggatgacgatgtcgtcgtggtcgacaagcccgtgggcgtcgctgcacatgcttcagccggatggacaggccccaccgtattgggcagcctgctcaaacgcggcgtgcgcatcacctcatacggagctcccgggcggcagggcatcgtgtcgcggttggatgtgggcacgtccggcctgatgctggtgtgcaagtcagagctggcgtacaaggagatgcggcggcagttctccgagcatgaggtggtcaagacctatcatgcgatggcccagggcaacctcaaggaggacaaggccaccatcgaagcacccattggccgcgccaaggtgtcggacttccgcttctgcgtcacgccgtcgggcaagccggcggtcacgcattgggacgtgctggaccgattcggcgaggcgacgctggtttcggtgaatctcgaaaccggacgcacgcatcagattcgcgtgcatttctcttcgatcgggcatcctctggtcggagacccgatgtatggggccaatccggtgctggccggggagctcggcctggaccgtcagtggttgcatgcgatgaagctggagtttcgccacccccgcacccatctctggacgtcggtcgaatcccactacccggccgatcttgcccatgcactggaacttatgcgcgccaggcatgcctcaactggtctggaagccgccgactagcgtacccaatcggcctgtcgcgtagcgctgtcatcctactgtcgcccccgctggcggggggggctgtcgcgtagcgactgggggtggtccaacgccaattcgcgcccccgctgttcttacttatcgcgtttcttccatgcaacgacggaagtgaccacgccggccgccagcagcggtacgcaggccaacgccgcgacgccttcaaccagcagcaggatggcgtctgcaggattgtagacgccgcgattgagatacatataacatgcgattgcggccagtaccgatactgtgccggccgccagcagcgcaaagccgagcgtgcgcaaggcatcatgcgatgaggagcaatattgggccgatgccgcagtcggcatgggcggcgcggactgcacggtgaccggcggcgaatcctcatagtgtggctgatttgcggacgtcattgttcctcctggtggttcgttgccgcgaattgtctggcgacggcggatcatccttgatggcaatctatgcgacggagacactctttgtccagcggaacggacaatgtggtcgaaggctgccgagttatccacattttgggcgtgtcgcgccggattcgattcagcttccgcgagttacatgtggcattttcgcagtgtttactgatggtcgtcattcgctgccatacatgtccctcctgtacaatgaccgtgtcatgcatgatgagacaaggagtgagtatgtatacctcgttggacaggttccgcatcaagccgggcaaagaggatttggcccgcgaatggttccgatatctgaacgatcacttggccgaagcgaatgcgacgatgccggctgagggcgcgcatatcgagtcatggttcctgcacgaggaatcggacggactgtacggatacgtgtacgtgatctacgacgacaatgataaggctgtcgaagtgttcaaggagagtgagaatccgttggacatcaagcacaacgagtacatgaacgcctgcatcgactaccacgactacgccaagatgaagcctgccgtggcgctgggcgactactccgtattccggagatgattggtcgacggttcgtcgacgccgttgtgtttgcagactcgtttgtacaacttatgcatttcggtcaaatgcataagttgtacaaacgatttccctagagaccctacttgccttgctgcgtttcgttggaattccagcgttttcgggaatacccgtggctcgcggcaacgggtgtgtgtgctgtttcccgcgattatgcgggacaacgtccgcattatggcatttcgcgggcgttgtacacgcggcattgcactcgggtcggaaacgcatggagcaagttcttccgcctcgccgccggggcggaagaaccatatgcactgagacatgtcgcccgaggaataatgcagaggacgctccgccagcgcacaatcagttcttgtgcagtttggcgttgagctcaatccccgtcttccggtagcgggcctcaatgcggccgttgacggagttgcggatgaagaggatgttgtctttgccgctcagatcggcgcccttgacgacgtccagcggttcgccggcggcggctttggccttgtcccagacggtgatcttggtaccggcggtgacgtacaggcctgcttcgacgacgcagttgtcgccgagcgagatgccgatgccggcgttggcgccgagcagggagtgctcgccgatggagttgcggagcttgccgccgccggacagggtgcccatgatggaggcgccgccgccgatgtcggagccgttgccgacgacgacgccttgcgagacacggccttcgaccattgagacgcccaaagttcccgcgttgaagttgacgaagccggcgtgcatgacggtggtgccttcggacaggtgggcgccgagacgcacgcggtcggcgtcgccgatgcgcacgccggaggggaccacgtagtcgatcatgcgtgggaacttgtcgattgacagcacgttgacggtggcggcgggagcggcggccggaagcccggcggaggcggcgaaggagcgcgcggcgctggtggcggccgcttcgacgtcgagcttgcgggcgttgaagtcttcgaccgcgaacgggccgtaattggtccagaccacgttcgtgagcttggcgaagatgccgtcgaggttgagggtgttcggctgggcgaggcgcatggagagcaggtgcaggcgcaggtaggcgtcggccgcatccgcgatcgggtcgtcaagggagcttacggtgaacaccggttcgcggcgcacgccacgggcgtcggcctgcggctgcgccagcgccccgaactcgtggttggggcggttcgcgccttcgggcgcggcgccgagcgtcagttgcggataccagacgtcgagtgtgttcccggctgcatcgatgctggccagtccccagccccatgcggtgcgttcgttcgtcatgcttgtctccttggtggatgaacggtagatgcttctatattatgggcagatgggcacgtatgaggctgccgttccgaatcattgtggcgcggtttcgtcacgggagaaaatctagcggggcggctacgatgaaaagctatgagtgactacaggaccgaacgggagcagcgtgagcgccgccgccgcatcatcatgcgtgcggtgtgcatcgtcattgccgtggccatgctcggcagcctggtcattcccgcggtgtatgcgggtctttgacgcgatcattggcgtcctgccgtgacgcgaggtgcttgagatttcgcatatggtcggcagcgtcgtcacacaatcgattcgttcacaagttcaatgattatggtggtattcgatggcagaatttgatttttcacaggcaatcggcgaggcacggtcgaagtatgagtccattgcgaaggcgttggacatcgaacggctgaagtcgcagatcgcgacgttggagaccgaggccgctaagcctggtctgtgggacgatcctgagaacgcgcagaaggtgaccagccgcctgtccgcggctcaggcgcagctgaagcgcctgaacgaggcgaaccgtcgcatcgaggatgtcgagacgctggtggagctcgctcaggaggaggctgacgccgattctctgagcgaggctcagtccgagatcggctccatcgcccaggagctggatgacatggagatccagacgctgctggacggcgaatatgacgagcgttccgcggtcgtgacgatccgctccggcgcgggtggcgtggacgccgccgatttcgcccagatgctgttgcgcatgtacctgcgctactgcgagcgcaacgggttcaaggccaaggtgatggatacgtcgtacgccgaggaagcgggcatcaagtcggccacgttccaggtggatgcgccgtatgcgtatggccgcctgagcgtggagggcggcacgcaccgtctggtgcgcatcagcccgttcgacaaccagggccgtcgacagacgagtttcgccgccgtcgaggtggtgccgctcgtcgaggcgaccgatcacatcgacattccggacaccgatatccgcgtggatacgtactgctcgtccggccccggcggccagggcgtgaacaccacgtattccgcggtgcgcatcacccaccttcccaccggcatcgtggtgacgatgcaggacgagcgctcgcagatccagaaccgtgccgccgccatggccgtgctgcagtcccgactgctggtgctgcgccacgaggaggaagcgaagaagaagaaggagctcgcgggcgacatcaaggccagctggggtgaccagatgcgttcgtacgtgcttcacccgtaccagatggtcaaggatctgcgcaccggttgcgagaccagccagacccaggccgtgttcgacggcgatatcgatgcgttcatcgaagccggtatccgctggcgtcacgagcagcgtcgccaggcggccgaagaggaagagtaaaccgtgacttggctcccggctccgggggcgagtgaggagacgatatggcactcatcgcattggatcatgtgagcaaggtgtatcccaagggtacgaggccggcgttggatgatgtcaacctcgacatcgaacgtggcgatttcgtgtttctggtcggtgcttccggttctggcaagacgacgctgctgagcctgctgctgcgcgaggaggaggccacggacggcgagattcgagtggccggcaatgatcttcgccgtctgacgaaccgtcaggtgccgcagtatcgtcgttccatcggattcgtgttccaggattacaagctgctggcgaacaagaccgtgtggcagaatgtggcgttcgcgcttgaggtgatcggcacgcgccggtccgccatcaagtcgctggtgccgcaggtgctgcagaccgtgggattgaccggtaaggagaacaattacccgcatgagctgtccggcggtgagcagcagcgtgtggccatcgcccgcgcgtatgtgaaccatccgcagatcctgctggccgatgagcccaccggaaacctcgatccgacgacgtcgctgggcatcatggaggtgctggacgccatcaaccgcaccggcacgacgatcgtgatggccacgcacaacgaggagatcgtcaactcgatgcgcaagcgcgtcatcgagctgcataccggcaagatcgtgcgcgacgaggcccagggctcgtatgattccgccgagttcttccccgacagcgatgtcgcgtccaaggcgcatgaggcgatcagcgggcagtcggatgattcgcgtttccgccctgattccggctcgttcgacgcacaggtcaccactatcgaggcccgtggcgaggagggtgcagtcgagggtatcgaagtggtcgccaaggcggtcagcggcaatatccggaacgaaggcatcgcccggttggcgagctccgtgcattcggggcgtaccggccgctacggtgaggcgttccagtcggtggaggacacgctgacctggggcaaaggcctgtcgcttgagcagattgccgcgcaggaggagcagaaggcccgcgccgagcagggcggggatgaacactccgatgccgcggctcagtcgagcgaccgggcgacggctcggggtgatgcccggtccgcgcagccggaggacgccgcccagccggaacggcacgagccgccggaaccgccgcattcggcggatgatgccgcaccgcatggtcagccggagacgaagcatcctcaggatgaatccacatcccaaagcgaacaggccggttcggcggcggagccgggctcctcgtccgatgaggagggcgagacgaagccgaggcgcgcgcacaagctgccgccggcgccgccggcccaaccggggcatcgcgacaggcatgccggaaaggccggtagcgctgatgatgccgacggtgctcgcaacgaggaggacaatcgatgagaatgcgttttatcctgtctgaaacctggaccagcctgcggcgcaacgtgtccatgatcatctcggtcatgctcgtcacgttcatctccttcgtgttcatcggcgcgtccgtgctgatacaggcgcagatcaccaaggcgaagggcgactggtacaacaaggtcgaggtcgtggtgtggctgtgcccggacggcaccagccagtcggcgtcctgctcgaccggcaaggcgccgacccagcaggagatcgtggatcttgaggacgtgatcaacaacgagctcggcagtgacgtgtcaaagatcacgtatatgagccgcgaggagttcttcaagaacacgttcctcaagcagtacccgaacggcgtgtacgagggacgtaccctcaccgcctccgatatgcaggattcgctgcgtctcaagctcaaggacccgaccaaataccaggtggtgtcggaggtgctgaccgggcgcacgggcgtggaggcggttgtcgaccagcggcagatcttcgacccggtgttctcggtgttgaaccgggccaccgtggtcaccgtcgtgctggccggtgtcatggtggtcgtcgccatcatgctgaccgcgacgacgattcgcatgagcgccgcctcccggaagaacgagacagagatcatgcgtctggtgggtgcttcgaactggacgattcgattgccgttcatcctggagggcgtggtggcgtccctgctgggatcgctgctggcggtcggcgcgctgagcggcatcgtcaaggtgttcgtcaccgattggttggcgaccagcgtgcagtggatgccgttcatcacgcagacgacggtgtggctgaccgcccccgtgctggtggtgggggccatgctgctgtcggcggttgcgtccgcggtatcgctgcgacgctatctcaaggtgtgacttgccgccgcgtgtcgtccgggatgcgcgaagtatgagatgaatcatttcgctgccggatgacacgcggcgcatttatccagtttaattcgttacaatacgttcaaatacggcattaatggaagggcgacaacaatggtgaagatggcgaaacgtgggggtacgttcaccgctttggcgcttgccgccgcaatggctctgggggcgggatcggtggccgtggtcgccccgcccgagcaggccgctgcggttacggagtatgaataccagcagaaggtatcgaaccacaacagcctcaagaagcagctgaccggcgtcgattccaaacttgccgatctcatcatctcgttgaatgacctgaccgagaaccagattcccgccgcgcagaaggccgtacaggaggcccagcagaaggccgaacaggcgaagagcctcgcagaggcgactacggcgcggcttgaggcggcgaagaacgaccggacctcgcttgaggagaagatcaagcagaccggtgaggattacgatgacgccaaggatgcggtcgctcagctcgcgcgcgaaagcttccacggctcggacgcctccaccctgatggacgtggtgaccaatgccaccacgaccgaggacttcgtcaacaagatgcagtcggatgccgctgtcacacgcagtgaggcgaatgccgccgacgccgcggccaccagcctcagcacgtcgatgaaccgcaaggaacgtctcacggccatcgaggacgagatcacccagctcaagggccaggcggacagccaggcggccagcgcgcagcaggccgctgaggatgcggcgtccaagcagagtgagctggaggccttgcgcaagaagagcgacgaggaacgcgcccagctggaagcgcagaagaagagcctgagcaccaaggaagcacaggaggccgccgaactggtgtcgatgaaggccgagatcgattcgtggagcgtgcagaacaacaccggttcggcgaatgccggcaccggcggacagcagcagatcaagcccggcgccggcagcgggtcgggcagcggctccggttccggttccggcaatggttccggttcgggcggatcccagcccggcggatcgggacaggccaacggcatgaactacacggtgcccggcaactgctatgagggcatgccggtgtgctacgggcacaggaccggcaacacggtgggcggcagcgcctacccgtggagccagtgcacgtggtatgcgtaccgtcgccgcgtgtactactaccatctgcccaccggctcatacatgggcaatgggcaggattgggcgaacaccggccgcagcctcggctatctggtcaaccgcacgccgcacgtcggcgccgcgatggtgttccgtgcaggccagctcggcgccaacagccgttacggccatgtggcggtcgtcgagcgtgtgaacagcgacggatccgtgctgatctccgagtgcggcgccagccttcagggcgtggcgcaatggcgcacgatttacaatgctggtaatttccaatacgtgcattactgagttccgggtggtgttttccgattcgtccggtcacggcccgtgcaagcgggtctggtctcatgatgtctgtgttgatgtgagtgattgaagaggaaggccatggcaaaggaacagggcactgtgctcatcgcacagaaccgcaaggcccggcatgattacctgatcgaggacaagtacgaggcgggactggtgctgaccgggaccgaggtcaagtcgctgcgcgagggacgggcgtcgctcgccgaggcgttcgtctccattgaccgtcggggtgaaatgtggctggaaggtgccaatatccccgaatatctcaacggcacgtggaacaaccatgcgcccaagcgcaagcgcaagctgttgctgcatgcgcagcagatcgtcaaactgtcccgtcagatcgaggccaaggggtacaccatcgtgccgctcagcctgtatttcaaggatggtcgggcgaaggccgagatcgccctcgcacgaggcaagcgcgagttcgacaagcgtcaggctctgcgtgaggagcaggacaagcgcgaggcgctgcgtgccatgcgctacaagaacatgcgctcccggtgagagccgacgggcggaaagcgctttggacagaccgcaccggtgggtgagtgaggagccccatatcccgttcgatatcgacgtggtgtatgaggatgccggcatcatcgtcatcgacaagccgcatttcctcgcgacgaccccgcgcggcatgtggtatcggcagaccgcgctgattcggcttcgcgagatgttcgacgagccggacatcacgcccgcgcatcggctggaccggctcaccgccggcatcgtcgtgttcgtgagggatccagcgctgcggggcgcataccagatgatgttccagggccggaagatcagcaagacctacgaatgcctggctccgtgccggccgacgacacggccgcgatacggcaccgtcgagcggctggaccctcctgtcgtgttcccgctgcgccgacgttcgcacatcaccaagctgcgtggcgtgctgcaggcgttcgaggagccgcagaccgtcaatgccgagacggtgatcgatctcgcggcgggagaatatccctcgatgggcgggcgcttatgccacgggaagaacggtctgcgcgcctacgagctgcacccgctcaccggcaagacccatcagctgcgcgtgcacatgaactcgatagggttgccgatccatggcgatgatttctatccgcgtatcgtcgaacgcgcctatgacgacttctccacgccgctggaactggtcgcgcggtcattgcgcttcaccgaccccgtcagcggggagccgcgcgaattcatctcccgcatacctctgggttggtgaagtttacttcactttttctgttgacgtattcgcgtcttggcggtaatatgaagttaacttcatgagaagtaagcttcatgttatggaaggaattgattgaagacaagagtgagagaactgcgaaaacaatcaaagctgacgcaacagcaattggccgacttggtccatgtttcaaacagaacgattatttccatcgaaaaggaacaatatagtccatcgctaatgttggcctaccgaattgcggaagtgttcggtgtgactgtcgaagaattatgttgtctcaaagaaaacagggaattggaggataaggatcaggaagcgaattaacaatgtgaggagtctcgttacggcgatcgtggttctgattctgggaattgcctgcttgcctggagtgcgatcgatttcttcttcgcctttactcaatcaagtattgacagccaagtcgaaaaggtcacggacgaacgcgatagatatattgcggaaaagcggcaggaaagccctgctgatcaccaattacgtaattggtgccggtgaattccagaggcagcagatggtattccgggtcatcggggtctggcccctcatccatgaatccgaagcgagagaacaaatccatgcttggcctgttgcgcggatccacttgagtcagcacgagcggcgtgcgattggaacgccacgcatcatcacgaagcctcataatcaccgaggcgagcagcgtgtctccgagatgttgccccgtaccttcagctcggtggcgatgtacgaaatctggtagatgccttcgtgctcctcggtggtttccgcgccgacaccgtattcgcagaagccggccacttcatcatgcaggggaatgtccccggatatgacaagaagcgtgcgcataactccggtcggggtcttgcgcacgctgagaccgcgtatatatcctgtgggtccatcgcccattcggggtctcctggcttgcagcacaggaactgtctgagggctgtctgatggtctctggagcattcacgctcgatgacgagattcagattcatcgacggtgtcttcccgggtgtttgccctgcgtgacagatagtggcgagcgctgttggtcagcttcatccatttctcgtccactgcgttgcgcggcttgccgtcctcaggcggcgcgtatgccggaatcagtttcacaccggtgcctgatattggcggtgttccgccgtttcgtaatgtgtgggcaataagggactcgaacccctgacatccaccgtgtaaaggtggcgctctaaccaactgagctaattgcccgcagactcacactgtatcgtatagtctgtatcgggacgccggccgagtgtcgttgggtggaattccgccgtcggtcgaaccgtggcgatgctgtgcttgccggcgcatgatatatgccgtaatcgtgcgaaagacgtgtgaggatgccgttttgctgggccaaatgtgaagctgcgtctcaacactcacgtaaagtgtgcaagagaagtactatccgtaggaggtcgatacaccaatggcgcatcaagacggggcagataaaggcgcatcggggatcgctcgcgttgggaagcgcaaatggggatacgatcccgatcaggtggacgctttcctggatcgtgcacatgcgctctacgagagcgaggatgcccatctcacgcagcaggacatccagaacgtgtccttcgatctgagcaagggcgggtatgacatcacccaggttgatgcggcgctgtcccggctggagcaggccgtggtcgacaagcagacgacgcgggagattaccgagcacggtcgtgtggcgtggaaggcccagaccgaagagctgtaccgtcaggtatgtgagcacgccgaccgcggcacgggggagcgattcgcgcgcggacatgatcgccggccgtcgtacgaccgcaagcaggtcgaccgactgatcgaccagatcgtggacaaggccgccgcaggccttggcgtggacggcgtgagcgaacaggacgtgcgcaagctcgccgatctgaattccggtgccgtctccaacgtggtgttcacgcagcgcaagggcaagaacggctatgacgagcgtcaggtcgattattacctcaactcgtgcgtgcagttgctcagccgtctcgaatcgttcgcgcgcgtctccgattatgtcggtggcggtcacgaatccggcggcagccggcgttcgtccggtgcaaggagcgcctccgacgcgggtgtgacgccgttgttcggcgcggacaacgcctatgtatatgcgccgtcgccggcgcggcaggaagcggagcctcagtccttcgcgcccgcgaacgaatcgttccatgccctccatgaggcagaggaggcgctgttctcatcgcagacggccgacgagccgagcgtcgcggctgatgcgcagtccgttcctccctcgttcgctcccgccggcatgtccggtacggtcgtatccgcgcccgcctcagcgcttccgtccacgttctcggccggagcctccgccccggagccgcagtcgtcgttggcggcgctgtcccggcgcaccggcagaagcgtgagctcgagcaacgtgagcgcggatcatgccgcggctcctgccccggcaccggagattccgtctccggccatctcggcggcaccggcatcgttcgccccctcgcacgccgcggtatccgatcagccggccgcagtcgccgagcctcaggctcccgaacgcgtcgccaagtccgtgaaggttcccgcggagccagttgcagccgcacccgccgttgctccctccgcgccggcccccatgccggtcttcgatcagcccgtggcctccgacgcccataccgatgccagtgtcgaggccctgccgtcgttcgcgccgtcctcgtcgccgtcggcgaacgttcccgttcatgccgtagacgatgccgcgcagacgcaatccgatggctctcacaagtcatcgtcggatgacctattctccagcatgtacctcagcccggaaagcaagctcgatttcgacatccccgacctgtcgttccccacgctcaacacgggcgagttttatagcggactgagcggtttcggcaaggacaacgactgaccatttcgtcggcgcgggaagacagatacaccacagaagacataaagaagcattgcaatgagccagtataggaatacggttgtcattctcggatcgaccggttcgatcggcacgcaaggtctggatgtcatcagtcggcatccggagcggttcaccgtcaccggtctggccgccggaggcgcgcatgtgcggcttctggcacagcaggtcgcacgtcatcatgtgccgcaggtggccgtatatgacgaggccgccgttccggcgctgcatgaggcactcgaggaggtcggagctcggtacacgcagattcaggccgggccgcaggcggtcaacgccatcgccggttccggtgccgacctggtgttgaacggcatcacgggctcggtcggactcgaaccatccattgcggcgctgagggctggctctcagctggcgctcgccaacaaggaatcggtcgtcgcaggcggtcacctgcttttcggcgcgcaagtgcgcgatgaccagatcaatcccgtcgactcggagcattccgccatctggcagtcgctgcggtccggcacccacgccgaggtcagcagactggtcgtcacggcctcgggcggtcccttccgcggctggaagcgcgccgacatgagcgacatcacccctgaacaggcactcaaccaccccacgtggcatatgggacccgtggtgaccatcaactcgtccaccctgatgaacaagggactggaggtcatcgaggcgagccgtctgttcggcgtggcgccggatcgcatcgtcgtgaccgtgcacccgcaatccatcgtgcactcgatggtggagttcgtggacggagcgaccgtctgccaggcgtccccgcctgacatgcggctgccgatcgccttgggcctgtcggcgcctgatcgtctgggtgatgtcgcggcggcgtgcgactggacgcatgccagcgagtggacgttcgagccactggacgacgaggcgttccccgccgtcgcgttggcgcgcgagtgcctacgcgcgtcggagaagcataccgcggtgctcaacgcagcgaacgagcaggccgtgcatgccttcctcgaccatcgactgccctatctgggcatcgtcgacacggtcaaggaggtcgtcgacgcgatggacggggagcttcgcggcaacccgctgttcgcatccgtggaggaaatgggtcaagtcgagcgtgaggcgcgccggcgagccgatgatttgataaacagtcagaagtgaatcattcgcgcgaccgcgcccggattgatggcatggcgcagccatgcgatcaatcagtcatgccccggcatggatgtggtgtcgcgcataatcgaacaggaaagaccaatcatcagcatgagcgcgttgccgcaaaccagtgcacagacgtccgcgaccacaggaacggcgtcggccgtgacaggatcgttccgcaagaccggagagccggatatcagcgagagcccgttgcatccgcgccgcaaatcacgtcgcatcatggtcgggccggtgccggtcggcggcggcgcccccatctccgtgcagtcgatgaccaacacgctcaccgcgaacgtgccggccacgctgcagcagatcgccgagctcaccgccgcaggctgcgacatcgtgcgcgtagcggtgcccagccaggatgacgccgacgccttgccgcagatcgtcgccaaatcaccgattccaatcatcgccgacatccacttccagtcgaagtacgtgttccaggccatcgacgccggctgcgcggccgtgcgcgtgaaccccggcaacatccgcaaattcgaccaggtcggccccgacatctgcaaggccgccaccgacgcgggcgtcagcctgcgcatcggagtcaacgccggatcgctcgacaaggagctgtacgccaagtacggcggtcccacgcccgaggcgctcgtcgcctccgcgctcaaggaagcccacatgttcgaggacgtcggcttccgcgatttcaagatatccgtcaaacaccacgacgtgattacgatggtgcagacctaccggctgctcgcatccaagggcgattggccgctgcatctgggagtcaccgaggcggggccggcatggcagggcaccatcaagtcatgcctcgcgttcggcgcgctgctggccgaaggcatcggcgacacgatccgcgtgtccctgtccgcaccgcccgtcgaggaggtcaaggtcggctgcaagctgctggagtacatgggactgcgcaagcgcaagttcgacatcatctcatgcccgagctgcggtcgcgcccaggtcgatgtcatccagctggcgaacgcggtcaccgagggactcaagaacgtcaccgcgcccattcgcgtcgccgtgatgggatgcatcgtcaacgggccgggagaagcccgcgaggccgatctcggcgtggcttcgggcaacggcaaaggacagatcttcatcaagggcaaggtcatcgagaccgtgccggaagaccagatcgtcgagacgctgctcgcgcgggccaacgacatcgccgcccagatggaggccgacggacaggtgccggtaggcgccaccggccctgtcgtcatccccatccagcatccgaacgcgatgaacgccgttcgctgaggtttttcatcggcgtccggccgccgtcgccgccggcatccggccggacggcctgagcgcggccggatgtcgtcagctcacagcgcagaagaccggcggattggctagtatggttgcgtgttgaatcggcagcgtaacaggtttcgtatccgccgcggcgaacgtcccgcagacgggaagtcgcgcgtatccgacgaatcggccgcatcgcggcggcaaccgggcgacaaggcgtcgccggccgcctggacgcgatggcgccgtctgatgtgcaccgtgccgattttcatcatcctcatcggcctgctggtgttcgtctccaatgcgacggccatgccgtggaacaatgagcccacagggcagactttgtcgacactgtccgccgataccggcgtgacgttcgacaacccgggcggcgttcacctcgccaagcgcggcgagtacgaggtgagcgagcggtctgtatggttcgacgcgaagagaccatcaacgggcgagatccaacgcacgcatgtcatcatccgcgagcctgtcggcgtctccgggaagctgcccggcatggtgttcatgcacggcgcgggctacggttccgccgtcgattcgttcgtcgacatggcctatgacctgtcgtccgcgggattcgtcaccgccgtgctcgacaagccggtatggtccacgaacgacataacgcgcgattatacgggctcggcggccgtctatgacgaagtgatccgcatgttgcgcggcctcgacaacgtggatgacagggaggtcggcatctacgcgacctcggaatcgacatgggtgtcgtcatatctgctggacatggacaaggacatcgcgttccaggtgctgctcagcccgatggtgttcacgccgcgacaggcgatagggttcctcgccgcacaggatttcgcgctggtcggagcccatgacggataccagtcgatagtccggcgcgtgttcaacatcgattccgcgctgttcggcgtcacgcttcccgacgtccatacgctcaagccgagcgcgtattcgattccgacgctggtagcgtatggatcgaaggacgtgatgaccgcccaggtggagggcgtggaggcgatcgtggacatggccctgcgcgcgggcaaccatgacgtgagcatccgcggctatcccgtggccaatcatgtgctccggttgggcgacgaatccgaaaccgggacgccgttcgcggaccagtacgccgctgacgtggtggattgggcggtcggcacggcgaagggcctgcgccagacgagcgagcgcgtgggaggcgtgaacctgtatcagtcgatagcagtgccgaaagacctgaaggcgaatcgcggcctgacggtgtacgggctgctgctgcacgtgttcatggtgttcatgatggtgctttcgctggtcatcgccgtggtcgcgctggtggtgaagatacgcgcgatgatccgtcgcaccggtccggcgctggggttctcgcatggtttcggcaaccagctgctcactctgacggtcactaccgtggccacgctggccctgttcggcgccggtctcggacaggtcatcatgggtgtggtgaagattgcctggggcggtgccccgccagagaagcccggactcatgtattggagctggccggtcatccaggtggtgtgcacagtggtggtgtgggcgtggtcccgcgtgttggcccgtctgatcgaagtggcgtcgctgcgcggtgtcatccggttccctccgcgcaagggcgcgatcggggatgtgatgacaggccgtgatccggtgctcgcctcgaccagacttggacgcgtgctgttctgggtgacggccgtcaccatgctgtcggttctgctgatgttcgcgttctggggattgttcgtctactgacggcgttcgccgcagcgaacggtggcggaaccaatggatacgcgaggaacgggaggaagcgcttatgccgctgtatcgtgacgaaggcgtcgtgttgcgtacggccaaactcggtgaagccgaccgcatcgtcaccttgctgacccgcagccatggcaagatccgagccgtggcgaagggcgtgcgccgtgtgaaatcacggttcggcggtcggctggagcctttcatgcgagttgacgtgctcatcgccactggacggaccctggacgtggtgtcgcaggccgagtccatttcggcgtatgcggctccgatctgcgccgattacggggcgtacggcatcgccaatgtcatggtggagaccgccgacaaactggtgtccgccgaaggggagcgggccgtcgcgcagtaccgtctgctggtcggcgggctgaacgcgctggcgcgtcacgcgcatccggcgacggcgatcggggaatcctatgtgctgcgtgcgttggctttggccgggtggactccgcggctgcattcatgcgtggtgtgcggacggcatgtcgccgtctcgccggtcgccggggagagcggcgatgacgggggtgccggggagagccgcatgtcgggcccgatgttcttctccccgtccgccggcgggctgatgtgttcgatcgaccgcacgcccgatgcgaaacgcatcgacccggacgaggtggtgcagctctcggcggcggtcgacggggattggggagtgcttgacggggctccgccggatgcgcgggtgttgcgatttgttgaagactggggcgagtattatctggaacgccccattcgttccttgcgcttgctagattagcggtatggcttttgaaaacgtcgattacacgtcgctggacattccggcggcgccattttccgatcctgcgcgtatcccggatttcccgaagaacaaggtgccccgtcatgtgggcgtgatcatggacggcaacggccgttgggcgcagcagcgcgggctggtgcgcacggacggccatcaggcggccgagcccgtggtgttcgacacgatcgccggtgcgatcgaggccggcgtgcggtatctgagcctgtacacgttctcgaccgagaactggaagcgctcaccgcaggaggtgcgcttcctgatggggttctcgcgtgagatcatccaccgtcgtgtcgcgcagatggacgattggggcgtgcgagtgcgctggtccggtcgccgtccgaagctgtggaagtcggtgatcgacgagcttgaggtggccatggagcgcaccaagcacaacaaggtcatcgatgtggtgttctgcatcaactacggtggccgcgccgagatcgccgacgcctgcgccgagatcgcgcgcgaggtggcggcgggacgcatcaagggcgaccgcgtcaccgagaagatgatcgccgaccacctgtacaaccccgacattcccgattgcgatctggtgatccgcacctccggcgagcagcgcacgtcgaacttcctgccgtgggaggccgcctacgccgagcttgatttcgtgcccgaactgttccccgattgcggccgcgatgtcctctggcgctccatcgaccactacatccaccgcgatcgcagattcggcggcgtgaagaaataggattcccgtttcgccctgtgttggcgggtctgttgtgaggtgaccgggagagcgctcctcgggcgtcaagaccacccccagtttcgctccgctcaacagccccgccagcgggggcgagaagaggaaagctgctcagtagcagtcccaggtgtagaggacgcgtgagaagtcaagccgttccagatcgctgggggagatgaagaagttcgccacgccggagtcgccgaacgacacgtcgtcggtcgaatcgatctgcagcagcaggtcggtcgccttgttccacagcggatccctgtcatcatgcgggtcgctttgcgtgaagatcgggtatccgccgacctggtgcccgcccgacatcagcagcgcggcgagcgagtcgcgaatctccgcctcatgttcgcggaagaagccgtggtcgtactcgttgagcgtgctgacgcagctttgcagccgtccctcgaaccggtagtcagtaggcgtgatcgtctgcttgccggcctgtgcgactagccgtcgctcggtgttggggtcgttgaacggcagcaccgtgtcgtcatgccaggcgggtttgacgacacggttggcatgcagtgcggtgaccggcacgttggggaggtagcgcacgcgccacgagcgttgcgactgcgggttgtcgtagtccgctccgtacagggtgtcctcgccgtcgatgaagaactgcagcagtccctgggcggggaatccgcgcagctgcggcagttggctgaagttcagctgggccagcagatacagcgggtccccggtgtcgagattgcgtggcgccttcatgccttccggcacgtagaacgcgccgccgagcttgctgtcggtgatctgtgcgggggagtcgtcctcggtcagacgcagcaccggcatttcggtggaataccgcagcagttgcgaaagtttctcggcgacgtagtcggtgatcctggggatgtgcgcggtgtcctcgtaggcggcgtttcgctgggatctgccggtgacgccaagctggtcgatggggttgcggggcccctctttgtccactttccctacgatttcctgggacggtgtgtcacgaccgaataatttgtccagcaatcccatgtgattccccgttttcagatcatcatccttgcacaggaaagcctagcagctgaaaggcgatttcgctgacgcgattggtgaaggcttggtaccgtcttgcggcgtgtcttcccgatcgcgtcagcggattggcctcagtcagtccaggccgattgacttgagatgatgcagcgtcagcgaggtgacggtcagcgagccggattcggcgacgagcccgatcgcgcggggacccttgggcgcgtagctgtacgagctcatgacctgcttgccgccgttgacgtagacctcgacgctgccgcggtccacgaacacgcgcaggcgcaacagccgtcgtcctgcatggggatcggctcgacgaaggggctcatccacccgtacatgatatgccgcccgttcgtgttgaacgactgcggcgcgtagaaattgtggccgcagtcccacgggcggaactcggtttccggcttgaactcgccgtccttctcctgttcgagggacggggcgaaggcgatgggctcgcggcgtcaggtgaccatgtcctcgctggagacatgaccccaatggcacaggccccactgggtgccgtaggggtgcagctggtagaacacgtgccagcggcccttgtagtagcacaggccgttcgggtcggcctccttgcggagctcgtccttctgctcggacgggacccggaacaggtagatgagcagcatgccgaggccgcaggcggccatgaagccggccgacagcacgatggagccgatcagcgcgcccgtgcgggtaggtcttgttgggtgctgagggttctccgcacggctgccgtgccgttgtggggaatcgttttttttgtactggaacaatagaacgtcaatcgatttacgtcaaacgattgacgttgtgtgtcgtgctgcggaagagggtttccggcgaggattaacggaacatatctaccggtgagtgcggcatgaggtaaggtggaacgcatggctggaaacttcgtgcaactgcataaccacacgcactactcgctgctggatggggcatccaaggtgcccgatctggtcaagcgcgtcaaggagctgggcatgccggcggtcggcatcaccgaccatggcaacatgcacggcgcctacgagctgtggcgtgcagcggtcgattccggcgtcaagccgatcatcggcatcgaggcgtatgtgacccctgaaaccgcgcggcaggacaagacgcgcgtgtcatgggacaccaactggaccccggttcccggccatgcccgcaaccccgacgatgtctcgggcggcggcctgatcacccacctgaccatgtgggcggagaacgacgaagggctggtcaacctcatcaaggcgtcgtccgtcgccaacctcgaaggccgtgtcatgcgatatccgcgtatggacaaggaggtgctgtccacctactccaaaggcgtgatcgcctcgtccggctgcccctccggcatcatccagacccgtctgcgcctaggccagttcgacgaggcgctgcgtgccgcaggcgagttccaggacatcttcggcaaggacaatttctacatcgagctgatggaccacggcctgtccatcgaaagcaaggttaccggcgatctgctgaccatcgccaagaagctcggcgcgcccctgctcgccaccaacgactcgcactacgtcatggaggcggacaaggacgcccaggacgccatgctgtgcatcaactccggcgccacgctggacgaccccaaccgcttcaagttcgaaggatcgggatactacatcaaatccgccgaggagatgcgcgagctgttcaaggaccatcccgacgcctgcgacaacacgctggagatcgcggaacgctgcaacgtgatcttcgacgaccatgaggatggcgcgttcatgccgcagttcgactgccccgaaggttgggacgagacctcgctgttcctcaagaaggtcgaggagggcctggagaagcgctacgacggcaacccgccgatggaggtgctcaagcaggccgactacgaatgcggcgtcatctgccagatgcagttctgcggctacttcctcgtcgtcgccgactacatcaactgggcgaaggagcacggcgtgatggtgggcccggggcgaggctccgccgcaggggccatggtcgcctatgcgatgggcatcaccgagctcgatccgctcaagcacggcctgatcttcgagaggttcctgaaccccgagcgtgtgtccctgcccgatatcgacgtcgacttcgatcccgaaggccgcatgcgcgtgctgggctatgtggccgacaagtacggccatgacaaggtcgcccaatgcgtgatctacggcaccatcaagaccaagcaggcgctcaaggactccgcgcgcatcatgggattcccctttgagatgggcactcgtatcaccgaggcgctgccgccggccgccaccggaggcaaggacatcagcgtgcacgacatcttcgacccgagcgccaagcgctacgccgaggcgcgcgaataccgcgagctgtacgactccgatcccgaagtcaagcgcatcaccgaggaggcgaagggcatcgaggggctgattcgccagaccggagtccacgcgtgcgccacgatcatgggttccgcgccgatcaccgacacctcgccgctgctggagcgcaccgacggcaccgtcaccaccacgttcgagtaccatacgtgcgaaacgctcggcctggtcaagatggacttcctcggcctgtccaacttgacggtcatccgcgacacgctcaccaacatcgagcacaacggcaagggcgtcatcgactacacgaagatccctctcgatgaccgggagacgtaccagctgctgtcgcgcggagacacgctcggcgtgttccagctcgattccgatggcatgcgctcgctgctcaagacgctcaagcccgataacttcaacgacatctccgcacttattgccctgtaccgaccgggcccgatgtcgatggactcgcacaccaactatgccaagcgcaagaacggcctgcagaagattacgcctatccaccccgagctcgacgagcccctcaagcaggtgctcgatgagacgtacggcctgatcatctatcaggagcaggtgcagtcagccgcgcgtatcctggccggctattcgctgggcaaggcagacgtgctcaggcgagccatgggcaagaagaagcccgaggtgctggccaaggagaaggtgccgtttttcgccggcatgaaggagcatggctattctgaggaggccgcagaggcgatctgggagatcctggtcccgttctccggctatgcgttcaacaaggcgcactccgccgcgtacggcctgatctcctactggaccgcatacctcaagacgcactacccggtcgagttcatggccgcgctgctgcagggcgcggcgaccaacaagaacaagaccgccctgtatctgggcgaggctcggagaatgggcatccaagtgctctccccggatgtcaacgagtcggtctacgagtactccgcagtcggcgacgtcgtccgattcgggctcggggctatccgcaacgtcggcgagaatgcggtcaaggacatcatcgcggaacgcgagacgggccgtggcaaatacgtgaacttcatggacttcatccgccgcgtgccgttgaccgcgctgaacaggcgactggtcgaatcgctgatcaaggcgggcgcattcgattcgatcgacccgaaccgccgggcgctgttcaccgtgcacgagtcggcgatcgactcggtggtcggcctcaagcgcaagcaggcggaaggacagttcgacctgttctccgacacggaggattcgggcgccgacgcgatgggggatgcgacggtcgccgtgccggacatcgaggaatgggacaagaaggacaagctcaagttcgagcgcgatatgcttggcctctacgtgtcggaccatccgctgagcggcatgcaagcagtgctcgccgggatgcgggagatgtccatcgcccatctgattgaccgtgcgcccaccatgcccagcgggcagcaggtcacgctggcgggactgattaccaacgtcgatcgacgagtctcgaagaagggcaacccgtgggcgatcgtcaccatcgaggacatggaaagctccatccagtgcatgttcttcggcaaagtgtacgaggcggcgagcacggagctcatacaggatgcggtcgtgcaggtgcgcggccaggtcgaggttcgggacgagaccgtcagcatgcgcgccacggaaatgcagccggtcgcgctggagaccgatgacgagcgtccgttcctgatcaccttgccgctggtggccctggggcgcggcaacatgcagcagcttgcgcagatcatcacgcggcatccgggattctgcgaagtgcggcttgccgtgctcgacgccaagggcaacgcacaggtgatgaccttcggcgataggttccgcgtcaaacgcgacaccagcctgttcgccgagatcaagagtctgttcggcccgagctgcctgccgacggcctgagaccatcagccggaatgtgaccatatgcgctacggaatccgctgacgatgggcgtatgcaggtagaatgagagcgaaacggggccgctggctgccgtcaattatgggcctggacctagaagggaagaacgatgatagtgtgttcacattgcggcgcagacaacgccgatggaagcctgttctgcagggcgtgcggtgcacaattgacggcggcgacggcggtgacggcacagccggccgctgcggcaccggcgacgcctgcgtacacgacgcagccgcagacttcggcttcgcaggttcctcaatcagcacaggttcctcaatcagcgcagtatccggcgcagccgccgcaaccggtacagacgaccgggatgcctcccgttcccgcgcccgccgttcccgcggcgcccggcaccgcttaccagcagcagccgcaaatggccggataccagcagcagccgtatcgggctcagacgtatccgcagcagccggtcgattcccagcagtacggccaataccagcagccgggcgtccccggagtccccatggctcccgtggcaccggtcgcgcagaagaaatccaagaagccgctcatcatcgtgctcgccatcatcatcgtggccgcgctggtcgtcggtggcgtgttcctgctcctgcacctgtcccagccgggcgtcaacggaacgtattcactcagcaccggcggcaacaccggcaccctgagcgtcgacgggaagaagatgtcgcttgacctgccgggcaatgacgacggaaagatgacggtcagcgccacgatagacaaggtcacaagtggcaatggcagccattcatacacgctgaaggatctgaagttcagcgattcgatcggcaattccctgatgtccgaggtcatcggcagctccggtctgagcgaggaacagggcacggccgttctcaacgcgctcagcccgaccgtcaccatccccgatggcgcgtccaagggcgagccgaacggcacctggtcggtctcctgctcggtcatgggactgggcatgggcatctcagccaacttcaaggatgatggcacattgacgatgtcggtacaggcccccggtcaaagcgggtcgacggttgatggcacatggagcaagaccggtgacgcgacattcgacgtttccctcgatgattccgatatgactatgacactgtcattgaagaagtgacctgcgcgcgctgaaaatatggttgtggccccgacgcgataccggtgtcggggccacaaccatattcgcgcacgagaattcggccgccgtcactcgcgcacgaggcggatgtgctcgatgtcgttgcgtgagctcttgcggtacagcacgaaccggttgccgatgacctgcaccacctgcgcgccgatctggccggcgagcttgtcggcggcctccttcgccgtcagaccggagccgtcctgcacggcgaccttgagcagctcgtggctgtccatcgtctccgatgcctgcttcaccgcggcgtcggtcaggtcgttcttgccgatgtagagcagcgggttcagctgattcgccatcgcgcgcagctgcttgacctgcttcttgctcaatgccatgttcggtcctctccgtcaatctgatgtgctgtgtacgaggatagcggagcggcacgatgaacggcatggacgcttctggaaatccttcaaaacaccgactaatgtctatggcggggacgaaagaaatgcgacatcatgtctggtaatgatgtcgcagacatccacaatatcctcaaggaggcggaatatgtattattccagtggcaactatgaagcgttcgcacgaccgaagaagccggcgggtgtcgacggcaagtcggcgtacatcatcggcacgggacttgcggcgctgtcggcggcctgctatctggtgcgagatgcgcagatgccaggcaagaacatccacatcctcgaaaaggacgcggtggccggcggggcgtgcgacggcgccgacatccccggcctcggctatgtcatgcgcggcgggcgcgagatggacaaccacttcgaggtgatgtgggacctgttccgctccatcccgtcgatcgagaccgaaggcgtctccgtgctcgacgagtattactggctcaataaggacgaccccaactattcgctgtgccgcgccaccaaggaccgcgggcaggatgcgggactccagggcaaattcgggctgagcgacaaggcctcgatggagatcatgaaactgttcttcactccggacgaggaactgtacgacaagccgatcaccgatttcttcgacgacgaggtgctgaaatccaacttctggctgtactggcgcaccatgttcgcgttcgagaactggcattccgcgctggaaatgaaactgtacatcaaacggtacatccaccacatcggcggtctgccggacttcagcgcgttgcggttcacccgatacaaccagtacgagtcgatgatcctgccgatggtgaagtacctcgaagcgcacggcgtgcagttccactacaacaccaaggtcgagaacgtcgagtttgcgatcggtggcgggaacggacccgaacgcgagcgcaccggggtcggacaggacacgatccagaagatccaggccacgtccggcttcttcaagcgcaacccgtacggcacgaacacgaagaaactcgccgtccgcatcgacatcgaccacgaaggtgacaagtcgtccatcgacctgacgcagaacgatctggtgttcatcaccaacggcggttgcgtggagaactccacgatgggctcccagcattcgtcggccgcatggaatccggacctcaagcccggtggcggttgggacatgtggcggcgcatcgccaagcaggacccgagcttcgggcatcccgacacattctgctcggacccggatgccaccaagtggatgagcgccacggtgactacgctcgacgcagagattccgccgtacatcaaacgcatctgcaagcgcgacccgttctccgggcgcgtggtgaccggtggcatcgtgaccgtggaggactccaactggctgatgagctggacgctcaaccgccagcagcagttccgtgaccagcccaaggaccagctgtgcgtatgggtgtatggcctgttccccgacaagccgggcaactatatcaagaagccgatgaccgaatgcaccggcgaggagatctgcgaggaatggctgtaccacatgggcgtgccgaccgacaagatcgaggcgctcgcgaaatcccacgcgaacaccgtgccggtcatgatgccgtacatcaccgcgttcttcatgccgcgttcggccggtgatcggccggacgtggtgccggatggcgccgtgaacttcgcgttcctcggccagtttgccgagacaccgcgcgacacgatcttcactaccgaatactcgatgcgcaccggcatggaggccgtgtacacgctgctcgacgtggaccgcggcgtgccggaggtgtggggcagcgtctacgacgtgcgcaacctgctcaacgccacggtcaaactgcgcgatggctccccggtcaccgatatgaagctcaatgtcgtggagcgcgccgttatgaagaaggtcctcaagaaactcggcaagaccgacatcggcatgctgctgcgcgagtacggggcgatctgacggcatcggcctcgcagcgaaccgttctcattaggaaacgtgtgaggattcctcacgtaaccacacaagtgaacatttcggtaaggcccggaattccgggcctctgaagggttccgtgttcgtttggcgggccgcagggctcgcacgtttcccaatgagaacggttcgctgcgtatcgcgggctgtatcgccccgcctgatgcaatgctctcagcgtctgcagcagttgctcctgcaaggccgtcctgccggcgaagtactggaagtcgtcgatgagtaccatgtcgatatgcctaaaccggttgccggacagggtgatccggtcttgtcgcgggtcggcatcctgcgccgtcatgacgaattcattggcatgatcctcactggtgagatagaggcacttcgcggaagggagtcagcgcgagcgtttcgaatgtctgatccctgttcagacatgcagtcagattgatggcgggcatgatcgtctcctgtgggttgctctccattcggtagacggattcgcctcaccgaatgcggggattccaacatagggtccgattcacttatccggtagatatgttcctcttattgttgcgcgtatgtcgacgccagatattccccggtatcgtgcagcatcttgcgcaatgaagccggcgacaatatctcgatgatgtgcgaatccgcgtactgcaacgcccaccaaagggtcgcgtgttcgttcgcgacgacgtgcacatcgtattcgcgctcgccggtctggacgacatcggcgtcggcgaaccagtcgtacagcggttcaagcgccccgtggatcttcatgtggatcggcgtcgccttgccgtccatcggataaggtcgctcgttcatatgccgcacgatgtcgaacggttgccccggcgtggggctgaagctgtcgagcgtgcgtttgagtgagtggtccggcccctcgatggacaggtcccggatgcgttccacatgcaggtaggacagcgagtcataccggtgcatgtggcacagcaggtagtatttgctgttcttgtacatcaggtggtaggggtccgccagatatgtcttgatgtcgccgtcgccgttacggcgggggacgagattgccgttgacgtcgtacgtgcagtaccggaaccggatcacgcgcccgtatgcgatggcatcgttcagaatctcgatgttgttgaggaactccgtattgtagttcttgggcgtggtgagttgttcgaggccgcgcaattggccggatttgccggcgaacgtgtagatcttggcgatgagttcgcgtaggtattcgccgtccgagctcgacagcgccgcgccgtccacgagcaggcgcatctgcgcgatgtcgaagaccggttcgatgtaccagccgggtcgggggttggcgctttccgcgttgaccagatcccgccggtcgaggtggcccacatggcggtcgaacggcgtcatggactgcaatgccttgagatgcccgcgcacggttttgtcggatacattgatgcgtttgctgatttccgcggcagtgaggccgtgctcggggtcggtgtgcttgatgagctgttccaggatttcgatgacgatctgagcggtggggagtgccgatgatgcagccacgatgtctcctctcccttgacggataccgtgccacctgggtgattaaaacggtagataactaccggtaatcatatcatcgcctgttgcgtgtggcgtatcgctctcaatgagagcgatacgccacacggataaggatccatcagaaatcgaaattgtccgggtcggcgctgttgcgcttgccggtgtccatggcactgatcgcagccatgtcatcgtccgacagcacgaagtcgaacacgtcgatgttctgcctgatgcgatcggcgtgcgtggacttcggcagcacgacgacgccgcgctggatgtgccagcggatcacggtctgcgcagcggacttaccgtacttcgcgccgatctcggccagctcggggatggcaagcaggtcgccgccggtgccgcccagcgggctgtatgcctcggtggcgatgcccttggcggacagctcgtccaccagcggctgattggtgaactgcggcgaggattcgatctgatcgacggccggcgtcacgtcgctgttcttcagcaggtcggcgagatgatgcggctggaaattgctcacgccgatcgccttcgcacgcccggaggcatagatctcctgcaggtcgtcccacgcctgctgccagacgtccgccggccagtggatcagatacagatccacataatccatgcccaggcggtcgaggctctcctggaacgcttctttgccgcggtgcgcgcgaatgtcgtcgttccacagcttggtggtgacgaacaggtcgcctcgcggcacgccggaacggcggattccctcgccgacagacgtctcgttgcgatatatcatcgccgtgtcgatatgcctatatccgttctccaacgcggcctgcaccgcgtttaccgtcgtgtcgccgtccggcgtgcggaacacgcccagaccgatctgcgggatgaccgtgccgttgttcagcgtgatcgtcgattgaatcgccatgaccattgtctcctgtgatattgccgatgatgcgtcgcagacaattgtaatgatgccggcgaaggcgaatcgacaggcgagcaggcaatgctgcgcccgcaggacgtcccaaatcgcaggtcccggccgggactggggggcgtttcctcgccgtgcccgaccgcgggtgggcaagagatgaacgatgacgcttgcgcatgcatggccgcgtattaccatgagtactggttcgcaggtgtggcgccgtggggtgccgggcggcggcgatcgtccgccgcgaatccgtggggaaacgaggcatatggtgagtgatgacacgacgcgggggcagcaggggagtgccgaggctcaggagctgacgctgaacgacaaggcgcattcggtgattcctcagatagggttcggcacgttccagattccgccggaggacacacagcgcgcggtcgaggaggcgctggagatcggctaccggcacatcgacaccgcggccgcgtactacaacgagaaagaggtcggcgacgcgctgaaggccaccggcatggccggcaaggtgtgggtgacgaccaagctgcgcaactgcgaccaggggtatgattcgacgatggtcgcgttcgaccgttcccgcagcaacctcggcgtcgacgtggtggacatgtatctgatccactggccattcgccgcggcggggttcttcaaggagacgtggcgcgcgctgctgaaactgcgcgacgaaggcgcggtccgtgtgcccggcgtcagcaacttcctgccgcagcacctgcgtgcgctgatcgaggattccggtgagaccccggccgtgaaccagatcgaggtccatcctcggttcaaccagccgggaaaccgtgcgttctgcgcggcgaacggcgtggccgtcgaggcatacagcccgctcggccacggaaaggacatcgaatccgagcccgtcgtcgccgcggcgaaggcgcatgatgtcacgccggcgcaggtggtgctgcgctggcacacgcaggaggggcgcatcatcatccccaagtcgaagcacgtggaacgcatgcgggtgaacctcgccagctccgatttcgatttgacgtcggccgaactggcggcgatcgatgcgctcgacgacccgcatggcaacgtcagcgccgatccggcgaccttcatgcattcccagtcgtgggccgaccagcacgtgcgcggcaatatctgattgtggcggggagggacggtcggcgggatcacccccagtcggctgcggcttggtctgtgggcgagatgtaagcgggcgtgggttgtgcggaggtgtgcggtatggatggtgaaatggagcgggtcttgccggatgatgcggacgatggtgccgaacgccggtggatcgatgacacgctgaaccggctttcgcgctcctcattccgtgcgaaattcgagttgtcggcgaaggaccgcgcgtatgcgcgggcgaagggcaaggccatgatcgatcgccatgcccgcgagctgctgcgcgcccgcatcggggcggcgaatccgcgcaacgacgggcgccagacgccgtggcgcgggcatccggtgtttaccgcgcagcatgccaccgccacgtgctgccgcgggtgcatcgccaaatggcaccatcttccccaaggcagggagctcaccgatgccgaaatcgatcgcttggcggacctggtcatggcgtggatagagcgcgatctcatacgtcatcccgccgtctgagttcgtccatcgtgctgcatccgccgcgggcgaggcatacggttcggggccgatgttgccgccgccgaaaaaaatatgaaggcgattacaatcgtgattttttgtgaaggtgttgcgtcgctgctggataaatgaccgtttctcagtcgcagaggaagttatggcgatgatggcacaagacggaacctgtctcatatcacggtcgtcgcgaaaggaaaattactggtttgtaatggaaaaaccagacaactattttcaaggaaagcggtgcgtggtggcactgatagtggccatgacgcttctttcgggagcgggattcacggcgtccgtagcatccgcggacaccgacacggtgggctatgagactgatcgcattgcattttcaggggctcggaccgtatgcggggagggctccatcgatttcgcggctctgacccgctcccggatgttcctgattgacgggggccggcgtggaactgaaggggcctgacaccgactatcagtgcccgggtggcatcatcggctttgacaattgctcgaatgccggttacggcagtgcggagatcatccgtccgacggatgtcaagggaaagaagaagccggattcgtcgcgtccctatctatgtttcctggccgaacacatgaatgtgcctcctgctgacgatgccgtgtactatctgcaggaatgaccgggcgcgggcctgcgccggaccggtgtagaggtgaccgggctgtcgaagttgtgccacaccagggcaatttcggcggttttgagcgtggtgtggccacgtccgtatgtagggatgtttacacgtggcgagcaaaccgttggaaaatggcggtttgtggtttcagctgtctacccgcgctgtaccataccagagaatgataaggttaacatcgcattgtgaggcacgcgaattgccacacaatgcctaaaagacgtgttttctcgctggtgtggtacagcctcgacgccgatcgtctcacattgcagacggtgaatctcgaagcatggatggcgcggccctgccggtgcatggcatgatgatgcgactcgtgtcagaccgcggattcacgtcgcttttttcggtcagccgccttttcccggcgtgccagctcctcgaccgtcatggcgatcacacgaaaatcgacgtcacagccgcggagggtaagctcacgcgcgacattgagcgcgaattcggcacatgcgacctcgtctctgatgtcatcggctgttatgacgatgatcgtccatcccaattgccgaagccggtctcgttttttgcgatccctgcgccattggtgcttgtcggtccgatgatgatcgccgtcgtattccaccgcgaccttgaaatgcttccatgcaatgtccaggctcattggcttgcccgaatcgaacatcgccctgtcgacatggcagttgacctccgcgtcgggcaggccgtgccggaggagtaccagtctcgccttgctctccttcggcgacagcacgttggccttgaccagttgcagtgcggtccggcaagcggtcttcccgagaaagtatggcgcattgtcgatgaactcgcgcaaggacgacaagaccagtcggggatatctgcccgatgatttcgatatggcggtgatgatggcctccgccagtatgatgagttcctccaaggacacgtgtgatgacagctgcgcccaggcatggaagggatgcaacgcgaatacattgcccttgatcggtacgcacgcatcaggatgagtggcgatcagcttccatacatgcggatgcgtgccgggaatgcggcgccgcctcctgtcgggagtgctggaggtgatgtgcagcatctccgcgtccagatcgcaggcctccggcaacggcacctgctgcagggcgagagcggtggtcatgccgaacagcacattgcctccgatgcgccacgccaatgcggcgcagcacatgatggcatcctgggcgcggtcgcgcagcgattgcgtcatgggcgttctctcgcccatcggctggagcatcacatcgttcatgaatgtcacggtagcgtattcgcgctgtcggtgtgatgaaccatggaaaaaatgtggatatgtggatgaatgcatggatatccacagctatccacatcgccgacgagcctgcgatttctcacgatgcgggtgatacggcgattctgggaggattacgacagcgtgcattggtacgatagggcgttatgagcgagaacatcatgcgaatcattgatctgcggggcaagaacatgtcccgcgccgagttacttgccgcgatgccgcgcgccgcgatgggcacttccgaagccaccgatctggtgcggcctattcttgacgacgtcaaggaacgcggcgccgcggccctgcgagacttcgaggagaagttcgatcatgtgcgtcccgagcacctgcgcgtgccggtcgaggcgatgaccgcggcacttgagacgcttgatcccgaagtacgcgccgccatcgaggagtccgtgcgtcgcgcacgcgccgtcgccgccaaccaggtgccgaaggacttttacactgatctggccgaaggcgcccgcgtcgccgagcgttggattccgatccagcgcgtcggtctgtacgtgcccggcggcaaggctgtctacccgtcttccgtgatcatgaacgccgtgccggcgcaggccgctggcgtcgagtcgctggccatcgccactccgcccgcacgcgacaacgcggaaggactgcccaacaagaccatcctcgccacctgcgccatcctcggcgtcgacgaggtctacgcggtcggtggcgcccaggccatcgccatgttcgtatacggagccaagggctccgagccgcaggacggcgacgtgctgtgcgacccggtcgacaagatcaccggcccgggcaacatcttcgtggccaccgccaagtcgctcgtctccgcgttcgtgggcatcgacgcggtcgccggccccaccgagatcggcatcatcgccgacaagaccgccgacccgagcctgctggccgccgacctgatcggtcaggccgagcatgacgagctcgccggctccgtgctgttcaccgattccaccgagatcgccgagaaggttcaggagtccctgaactaccgcgtgccgcgcaccgaacacgccgagcgcgtccacacgtcgctgtccggaagccagtcggccatcgtcctgaccgacagcctcgaccagtccatcgacgcggccaacgcatatgcggccgagcatctcgaaatccagactgccgacgcggacgccgtcgtgccgcgcatcaagaacgcgggcgccatcttccgcggcccgtactccccggtgccgctgggcgattacatgtccggctccaaccacgtgctgcccaccggcggcaccgcccgcttcgctgcgggactcggcgtgcacacgttcatgaagcccgtcgaggtcatcgaatacgacgaggagggcctgaaggccctcgccgcgcgcatcaacgccttcgccgtctccgaggacctgcccgcccacggcgagtgtgtcctgtcgcgcttcgtcaaggatccgtacgacaaggccacgctgcgcgaacaggagaaggaagccggtctgcgctaagggctgcttgggtggttcgacccccagtctgccgcgcagacagcccagccagcgggggcgatgagcggatcgaatgtgccgcgtgcgaatgcgaatacaacccccgtcagcgggactatagacggaaagaacagagagcaatgagtgagaacaacagcaatgcgattccggcgagcctgccgctcaggaacgatctgatcggcgaggagccgtacggcgcgccgcagctcgacgtgccggtgtgcctgaacgtcaacgagaacccgtatgcgccggatccagccgtgtgcgacaccatcgccaggcgcgtgcgtgagatcgcgcccacgctcaaccgctacccggatcgcgagcatatcgaacttcgccaggcgttctccgactacctcgcccgcgaatccggcacccgtctcgacgtggacgaactgtggggcgcgaacggctccaacgagattatgctccagctgtttcaggccttcggcggcccgggccgcaccgccttgggcgccgacccgacctactccatgtaccccgaatacgcgcgcgacacgttcactggctggaagctcgcccaccgcaacgccgatttcacgctgaacgtcgacagggtaatcgaggccatcgccgaggtcaagccctcgatggtgctgctcaccagcccgaacaaccccaccggcacgccgctgccgatggccgacatcgaacgcatcctcgccgcctgcgagaccgccgacgtggcgggcgcgggcgaaggcgtccacccgatcctcgtcatcgacgaggcgtacgtggagtttcgcaagcccggcacgccgagcgcggtctcgctcatcaagaaccacccgaacctcgccgttagccgcacgatgagcaaggcgttcgcattcgccggcgcacgtgtcggctatctcgccgcgagcaagggcatcatcgactgcatgcgcatcgtgcgtatgccctaccacctgtccgccgtgacccaggccgccgcgctcgcggcgttcgaacacaccgacgagcagctgagccgcgtcgagcacttgcgtgagatccgcgaatccaccgccgaatggctgtcacgtcagacctacaagggcgagccgctcgaagtggccgagtccggttcgaacttcctgctgttcggtgggcatttcgacgaccgcgaggccatcttcgacgagctgctcaggcgcggcgtgctcatccgcgtggtcggcccggacggctggctgcgcatgtgcatgggcaccgacaaggagatggaacaattccgtaacgcgctgaccgaagcattgcgtattgtagaaagcagataacaactcccgaaacgccggcggcgcgcgcgaccatcaacgtcatgacccgtcgtcggcgaccgccgaccggcacactggccggcaggcaaaccgggacttatcgggacatatcaggatcaaggaccaaggagcacatcatggcgcgtaccgcgcacatcgtccgcgagaccagcgaatcgcacatcgaactcagcctgaaccttgacggcaccggcaagaccgacatcgacacctccgtgccgttctacaaccatatgatgaacgcgctcggcaagcattcgctcatcgacctgacgattcatgcgcacggcgacaccgacatcgacgtgcaccacaccgtcgaggatacggccatcgtgttcggcgaggcgttgaagcaggcgctcggcgacaagcgaggcatccgccgcttcgccgacgccaccgtgccgctcgacgaggcgctcgccaaggccgtcgtcgacatttcaggccgtccgtactgcgtgtgctccggcgaacccgacggcttcgaatactgcatgatcggcggccacttcacgggctccctggtacgccacgtcatggaatccatcgccttccacgccggcatctgcctgcacatgcaggtgctcgccggccgcgacccccaccacatcgccgaagccgaattcaaggcgctcgcgcgggcgctgcgcttcgcggtcgagccggatccgcgcatccagggcctgatccccagcacgaagggcgcactgtgatgagcggcaacgacgacaggcacggcggagacgacggtttcgacgatgacatccatttcagcgacgaggaacttgaggccgcgctggacggattcgagaaggaattccgcgattcgaacgcggctgccggcgaaccggcgaacgacgccgcggccgacagccccgcagacgatgcgggggccgcggattccggtcaggcgcaggaggccgacaccgcggccgcgttcgacgacgagctgcaagggcttctgggcaacaaggcgaaggccgccgtgctgattacgcgcgtcgcgtccgcccgcctgcttgccgcgttctgccagctgtcggacgtgtccgccgactgcatcggatcggcggaaggggccgtggccatcctgcgcaaccttgacggcgacgggcccgaagtcgcggcacgcgacctcaccatcgtcgtgtcgggcatgtcgctggtgctcgccgtcaaccgtgcggacaagttggaggcgaccgtctatctgcaaggcaagccggggcagacgatcgccccgccgctgctgttcacatcgacggcgccgttcgtggaggatctgctgcttggcatcaccgacgaggacggcctgatcggcaccggcatgaaagtcgaacagtccgcggatctcgaccatgaccaggccatggccgtcatcgcggaacacacgaagttcgggcgcggctcgtcgcgcatcgaataatcgggcggccggcggacgccgcccgtgcccgtgcagccaaggattttcagactgaaggagacgacatgacatcggtggtggtattcgactatggattcggcaacgtgcgttccatggtgcgtgcgctcgccaatctcggccttgacacgacactgacctccgactaccggcaggcgcttgaggcggacggcatggtcgtgcccggcgtcggcgcgttcgccgcctgcatgaccggcctgcgcgaggtgtcgggcgaccgcgtcatcctcgaccgtctgcgtgccggccgccctgtgctgggcgtgtgcgtgggcgagcagatcatgttcgagcgcggcaacgagcacgcagacaccaccgaaggacttggactgatcggcggtaccgtcgatctgctggatgccgatgtcgtgccgcacatgggatgggacacggtcgaggcaccgtccggttccgcgctgctcgaaggcgtggagaacgaacggttctattttgtgcactcctacgcggcgatgagcgccaccgcgaaggatctgagcgccgagcaggtcgatctgggcggcgacgagcatatcacgtggtgcacgtatggctgcagcagattcgtcgccgcctatgagcgcggcccgctgtcggtcacccagttccaccccgagaagtccgccgacgccggcaaacagctgctgcgcaactgggtcggcacgttctcgaagtagccggctgaacggcatgaccagccggcgctgccgggaaccccgactcacccggcaacgcggacggcgggccccgagcctcaacgacttcaacgattccaaaggagaacaaccatgtcactcacattgcttcccgcggtcgacgtgcgcgacggcaaggccgtgcgcctgcgccagggcgaatccggctcagagaccgactacggcagcccgctcgaagcggcccgcacgtgggtcgaggctggcgccgagtggattcatctcgtcgatctggatgcggcgttcggcacggggaacaaccgcgcgcagctgcgtgagattgttcatgagctcggcgacaaggtcaacatcgagatgtccggcggcgtgcgtgacgacgactcgctgtccgccgcgctggaggccggagcggcccgcgtgaacatcggcaccgccgcgttggagaaccccgaatggaccgcctcggtcatcaagcggtacggcgaccgcgtcgccatcggacttgacgtgcgcggccacacgctcgccgcccgcggatgggtcaaggagggtggcgacctgttcgagacgatgaagttcctcgactcggtcggatgctcccgctacgtcgtcaccgatgtggcgcgggacggcatgatgagcggcccgaacatcgacctgctgcgcgaggtcgcggaacgcaccgatgccaaggtcaccgcttccggtggcatcagcaagctggacgacctgcacgatatcaagatcctctccgatttcggcgtggactcggccatcctcggcaagtcgctgtacgcccgcgcgttcacgctcgaagaggcgctcgaagtcgcccgctgaccgatacggctgtcgacaggggccgcccccgctacccgtcaccgtcggctgggcggacggcggcccctgctcacttcttcgcgccgcttttcttcgagcaggggagctcgcccttcttgatgagcttcctgaacagggagtaatcctcctcgttctgctccgcatacgcctgggcgaacgcggctatcgcctggtcgaactcgtcggtgcccccaagatagttggcgatggccacgctgtcgccggtgcgggcatgcgcgtgcgccaggcaccatgcgcacatgcggcccaggtccgacaatcccagcgcgttcagatgatcgatgtcgatcgagcccttgccgttccagaattggcgcacgtaatagtcgcgcggccggccgtcctccgccacgaaactcgcccagccgagcagcacgtcggcggtggattggatcagcttctgcccctgcaccacacgctcgccatgcgtcgcatacggcgagcggccgacgaaccgttcgaagaccgactcgttggcctccttcatctgcagcatcagcgggtcgtcaagcccccgtccggtgagaatcgacacccaggcgcgggttccgaccgagccgacgcccacgaccttgcgggcggtgtcatggtaccggtaacggttcagcacgtaacgccggtcctcgtacaggctttgccggtagctgtcatacagtgcgtccagcctctcccgcagcaccccgagatccgcatagtcctgcagctcgctgatcggcaccagctccggcggcttcgagcggaaccgcagccgcctctcgccgctgtcaagataggtgagcttcgcggccgcatggtcggaatcacgcaccgacgcgcgcagcgcggcgtcgcgcaacgtgcggttgcgcttgccgttcaccgtgctttcgtaatggtcgagcgccgcctccacgtcgagatggtcgtaccagacgtcgaggaagtccatctgcgagaactggcggatatggtcgcggtacgagtgcacgcagcgtgcgaccgcgttgcgccggtccttctccttgatgccgttcgcccgcccgcagatctccacggacaccgcgagccgcttcacgtcccattcccacggtcccgtggttgtctcgtcgaagtcgttgatgtcgaacacgagccggtcgctgggggagcggaacatgccgaaattgccgatatgcgcgtcgccgaccgcctggacggggatgccggtggtcggcgtgtgcgcgaggtcgttcgccatgatgagcgcggtgccgcggtagaacgtgaacgcggaatcgctcatgcggtagtacctcagcgggatcagatccggcacccgctgcgccgactgttcctccaaaagcccgatcacgtcgcgccggcgcgacacgatcttccagtcggcgtggctctccaacggtgtggtcttgcgcagcgcgatgccggccttggcctgccccagcggcgtgtcggccatgtgccatgacatatcgatgatgggatggttctcgctcatggctccacgataacgccgacgcgggagcgacattccggcgatgccccggcgtgtccgatggcatgttaacgagtctcgtaacacggacgtgaaaccatgagggattatggataagcagcaagagtttgccctgcgcacggtcgaggaacgcgacgtgcgctttattcggttgtggttcactgacgtgctgggcacgttgaaatccgtggccatcgcgcccgccgagttggaggcggcgttcgaggaggggcttggcttcgacggttccgccatcgagggaatgacgcgcgtgtcggaggacgacatgatcgtgcagcccgacccgtccacgttccagatactgccgtggcgtggcggcccgcagggtaccgctcgcatgttctgcgacattctcacgcccgacggcgagccgtccctgggtgacccgcgccacgtgctcaagcgtgcgctcgccaaggcgaaggagaagggtttcacgttctacgtgcacccggagattgagttctatctgttcgagaaccagaccgactggtcgaaggcgccgactccaatcgacgagggcggctatttcgaccatgtgccgcgcagcccgggcatggacttccgccgcgccaccgtcaacatgctggagcagatgggcatctccgtcgaatactcgcaccatgaggcgggtcccggccagaacgagatcgacctgcggtatgccgacgcgctgaccacggccgacaacatcatgacgttccgcacggtcgtcaaggaaatctcgctggagcgcggcatccacgccagcttcatgcccaagccgctcgccgacgcgcccggttccggcatgcacacgcacctgagcctgttcgagggtgattccaacgcgttctacgaggccggccaggagttcaacatgtccctgaccgcccgacagttcgccgcgggcatcctgcatcatgcggcggagatctgcgcggtcaccgaccagttcgtgaactcgtataagcgactgtggggtggtgctgaggcgccgagctacatctgctgggggcacaacaaccggtccgcgttgctgcgcatcccgcagtacaagcccggcaagggcaactccgcgcgtatggagttccgtggactcgacccggtggcgaacccgtatctggcgtattcggtgctgctcgccgccggtctggacggcatcgaacagcagatgacgctgggagagccgaccagcgacgacgtgtgggagctgaccgacgccgaacgtcaggcgatgggcatcgagccgctgccggattcgctggacgccgcactgaagatcatggagaagtccgatttcgtcgcggacgtgctcggcgagcatgcgttcgagtatttcctgcgcaacaagcatcaggaatgggacgaataccgtggccaggtcacgccgtacgagttgaagaagtacctgcccaagctctgacgtgacgtgaaaccggccgactaccggcaaacaagaaacggtgtggggatgatggctgctgatccggccatcatccccacaccgtttttgcttgccgaaccgaccgccgcaggatgccgctgcggtcactcgaccttgcgcggcgtcatcttcttggtgaccatgtcgttgctcccgtaggtgctggacaggcgaaccgtgaccggctggcccgggtcttcgaccacataggagaccgtcgccttggccaggacccccggctggacggagcggctgaaactcatgttctcgtacccttgtgggagcggcggctcggtgtagtagttcatttccagctgggagccgtcctgcgtgacggtgagcttcgcggcgttggacaatggctcattggcctcggattggttcacccatgtgatggtgacgatgatggtgtgacggccctgatagtcgtcggggcccgtcgtcacgtcgtcgatggagacgagggcgtccccgctgtagctgctgatccgcttcatcttgcgcttctccgcctcggcggctttcggggcgggagcgatgtcgtcaggctggacctgctcgtattgcgtgccgctggtcggtgccttgaacgcggacacgatgccctcatggtagcgggtcgcctgattggctacgacgtacaggtcgcccgtcgcgtcgtccagctggtacgcgatggtcgcgtcgctttcctcgcccttggcgatcttgatgtcgtccgactgcgtcttgtacccttcgatggatgagccgccgcggctgtgcaggtaggttttgttcaggccgatgccgctctgatacacctgcaggtccatggcgagttccccgaaggtcgtattggcatcgccggtgttcttccaatggtaggtgatgatcaccgtcttgtgcccgtcgtgatccgtggggccggtggtcgccttggctatggtgaccgtggccttccggttgccgaacgatgtcgtctcgccggttttcacgcgggtcggcttgttgtcttgggagggcgacttgaatgagtacgatgagtcgtccgagtcgctgctgccgcctgtgctgatgatatgactcaccaggtttgatcccagcgcgaacacgattatggcgatgacggcaacccaggatcggcgctggcgcttcgtggctccgccgggtttgcggtcgctcttggactgcacgtgtccgtagccgccgcgatatggatggccgttgtagggcagattgaggggagcgtcgcccgctccggtccgtgccggccctggtttgtctgcggggctcggggcggccggcttgcctgccggtcggcgacgatcggcatcggggctgattcggccgcttttgggctgctgatacgccggctcgtcgacctgcgaggtctgggaatcgatgctgatgtacgccggcgaatcgtccacatcgaacggcgatacataatcgtcgtcatgatgcctgctgaacaatcccatgcctgttcccttgtctctcggccgcgcacggtgatgcatgtcttctcctattgtaggcggcgtgccggtgcagcgcgagcgccggaaggtgaagaccgtcgaaatcgccggtgaatgatgggccgtgcgtcttcggcgcgtctcctgcgtgtctcggggccttgcgcggcaggaggtgccgctaatgtatgttccgtctggaagaagagaaaaacagcaggggtacggtcatgtccggttccgccatccgtgggcggcaggggagcgaacgcttcttcgcgctgccggtcgtcacgctgatcgcgtccagtttcgtgctgggcatgagcgatttcgtggtcgtgggcatcctgcccgacatcgcccacgggttgcgggtcttagaggtcacggtcggcaatctggtgtcgcggttcgccacccatctgacgttgccggcgtgttcctcgccggcaacatcctgtgtgcgctcgcgccgaattacgcggtgctgccgcattacagccacatggcgaaggtcggttttctgccgcagttccgcatgcgggccggcaatggctgtctcagtgccttgcgtctccgaaccatccccggtagatgatcgagaagttcctgttgccgtagctggagcaggagtctccttccccggctccagcggcgagcgcggcctcgttcggctggtagggtgtgtagatgtacagcagtgcggtcgccttgttgccgatgaccacgttggcgccgccgcagcccgtgttcggatggaacctgacgaagttgagcttgccgacatggtaaccgtatgatgcctcatgccgcacgtaatacctgtatcgatgcgccgcgccgtagacctgccggaagaagcctgcgtactgcgggttgcagtcgttgtcgtcggggcagctcaggcccatggccgccttgaactggaagtcggtcggcttgctcgcggtgacgagctgctgttccttctgcagtacggtgagcagcactttctggctgatgccgcatgatcgcgacgatttgtcgatgatcgtcgccgcagtctctcccttggcgccgtcgtatccgtcgcagtaccggtcatcgggctggtccgtggtgtcgaacgtgcggtttttcaggcatcccgtcccggtgcagtcgccgccgtgctcatcgaggaacgattgcacttcggtgcggctcatcgcatagccgttgaagaactggccgtcggagatgatgttgcccgggtcgaaaccgtatcggtcgcccagattctgctgtcgttcctcggccgtcacgagcgcgatgcgctgtccgacgaacgaggtggtgccccacgccagcgccacggcgcacaccgccgccagcgcggtgcccgccaccgcgaggatgcgcctgcgccatccagcccgcttccaccagcggcgcagcgtgttgcgtcgggccttcggcttcgggcggcggatcgcggaccgtgccgctgtgccgtgcctggtgtttttggtgttgtttcccctgatgtttttcttggcgggcgtaccgggccggcggttgcgttgcttgccgccgttccgtcctccggtccgcccggtgttgttcccctgcttcttacgtgttgtcatcgtccgtcattgtagcgcggggatatgttggatgcgcggactggccgtgcgcggcgacgggggagaggccgcgcacagcgctatttgccgagcgttttcttgattcgctgcaagctgaccggcttcgcggtgccaagctcctgggcccacagagagacgtagaactcctccagcatccagcgcgcgtcgtcggcctgtttcgtcagtgcctcatggcgtgggcccgcgggctccgtcttggcacgctgaacggccttgtcgaccagctgtcgcgcctcgtcggcctcccaggcccatcgcacgtcgcggttcttgtcgttcttcgccttggtgagacggatcaggtcggcctccagatacttcggtatgcgcggcagggcggcgggcggcgtcgcgccgatgaacccggggaacaccagcgtggcgatatgctcgcgcaccgattgcagcaccgacagcatcggcaggtcggccttgccggaggtcgccttgtcgacattcgcgtacgcacgcaggatggcgatgacatcatgggcgagtgcgtagacggtgtcctcgtagacctcggtcacccccatcaccgcatcggcgagcgcatcgtcgtcggggagcgtgtcgatgttcggcagcagacgtttgacggtggccagctgcaggtcctccaccagcgccttggtggaggggtatggcgccgacgcgagcatcagcgcctcggtgccgagccaccgagacgagatacgctccgaaggcatgcgcagcgcgtccaaggcgccccgccacagcatcaccgcgcgcgactcgctcgtcgccccggccttgtgcagcaggttggcctgttcgaccagtttgccctggctggcggcctgttccgccttgtgttcgaccatgcgccgagcggatgcctccgcctgttcggcgaactgccgttgcaacgcggtcagggatttgccagaacccagtaccttcaccgggccgcgtgcatgccgccgtccgcgtgcgttgcgcggcgcggggagttgctgctcgatggagaacgtcatccgcaggtaggcgggcagcttctcccatagttcgccggtcagcacctccgggtggatctgagcgttcacggtgtcgatcgccgcctgggtgaacacgtgcggcaggtcgggccatgcgtggccctggccgtcggacgtgccggtgccgggcagggccggataccggtcgtctatccatgcgcggatcttgcgcgcggtgtccggtgcgggcacgaactgcacgcgcagtgatttcggcagggacttgatcagccccacgatcagctcgtcgagcagtccgggaacgttccatgtgaactgttccggtgtcagacgggacagcgccttgagcggcacgtgcacggtcacgccgtcggcggggtcgtgcgggtcgtagatgtagctgagccgcaggtcgatcggctggccgtccgtgccgagcgcatgccaatggtccggatagtcggcgaggctcaccgactccgccgatgacaggcgttcgaccttgtccgggtcgaaatcgagcagatgcgggtgttcgccgtgctcgcgcttccaccatttcgccaggtcggcgacgcaggtcacgtcattggggatgaccgactggtagaagtcgtagaggtcctcgtcgctgacggactgcgagacctgcctggtgcgactggcgtcctcggccgcctcgtccaggatgtcgcggtttcgggccaaaaaatcgtcatagctgaaccgctgctggacgtccccctcgacaaggccctgccggatcaggaagtcgcgggcctccatggggttgatgcgcccccattgcacggtgcggtccgagatgatcggcagaccgtacagcagcaccttcgccgtggcgacggcggagccgcgcgaaccagaccagtgcggctccgcatacgtggtgcgggtcagctgcccggccagcggctcggcccacgccgggtcgatggcggcgctgtacctcgcccacaggcggctcgtctccaccagttccgtgctcatcacccactgcggggtggatttggccacggccgaggccgggaacaatgcgaaatgagtgcctcgcgcgccctgatagtcgttcttcgccatcttctgagcccgcttgatggccttggccttcgccgcgcccttgagaccggcgaaatcggaggccttcggctcgcgcacgatctgcatgcccatcatcgacagcaggccggagagcatcgacgtgtgaatgccgcggtcgtcccacgagcagcacagcgaatgggccgcctgctggttgatcggcagctggcgtaccgccagatcggggcgggaggccggctgcggggagccgaccttgaacttgagttcgcggcacatctccgtcagctgattgaccaggtccttccactggcgtacgcgcagccagctgaaatactcgctcttgcagatacggcgcagcgcattgttgctcggctcgccatcggcctggaagatacggtcccagatgttcagcgcggtcagatagtcgctggacggatccgcataccggttgtggatgcggtcggcctcatcccgggcctcgtccgggcgttcacgcggatcctgaaggctcaggaacgccacgatcaccagcacggcagccaacgtgtcgggcgtgctggatttcgcagcctcgatcaccatgcggccgagacggacatcgatggggatgcgggcgagctgccgtccgacatgcgtcagcgtcacctcgccgcgcttgcggccgatcgccttgagctccgtcagctcgttgaagccgtcggagaccgccttcatgtccggcgggtcgatgaacccgaaattcgtcacatcctcggccgtacgggcgacgcccaccgacagcatgtgcagcaccacggcacccagcgatgtgcgcaggatctccggctcggtgaaccgaggacggttctcgtagtcctcacgcgaatacaggcggatggcgatgccgtccgcgatacggccgcaccggccggaccgctggtcggcgctcgcctggctgatcggctcgatgggcagccgctgcaccttggcggtcttcgaataccggctgatgcgggccgtgcccgggtcgaccacgtagcggatgcccggcacggtcagtgacgtttcggccacgttcgtggcgatgacgatgcgctggtgcgtgtgcggctcgaagacgcggtgctgctccttggacgacaggcgggcgaacagcggcatgatctcgatggcgtcggagtggcgcatgtcgtcggcgcgcgggccgtaatggcggcgcagcgcgttctcgaactcgtggatgtcgcgctcgccggaggcgaacacgaggatgtcgcgggcgccgcgctcatggctggaatggatgatgagctccgcgcacgccctggcgaccgccgtgggcatgtccatgtcgggttcgcgagatgagccacggtcccggccgccgtcggagggcgccgccgacagttcggcatacgattcctcgccgggcatcgcgccggtctcgaatccgggcacgtgccgcatcagcgcgggcgcggtgcccagcggctcgtagacgacctgcacggggtaggtgcggccggagacctcgatgaccggaaccttctcgtgcagcgcatgctcgaaatgctcctgaaacttcaccgaatcgatggtcgccgaggtgatgatcagcttcaggtcgcgacgtttcggcagcagcgcggtgaggtatccgagcaggaagtcgatgttcaggctgcgctcatgcgcctcgtcgatgacgatcgtgtcgtattgccgcagctgggggtcgcgctggatctgcgccagcaggatgccgtcggtgacgacgcgcagccgggtcttcggcgacgtctcgtcggtgaaccgcacctgatagccgatctcgtcgcccagatggacgcccatttcggaggcgatgcgttcggcgacggttcgcgcggcgagcctgcgcggctgcgtgtgcacaatctgccggccgtgcgtaccgcggccgagctccagcaggatcttcggcagctgcgtggtcttgcccgaaccggtctggcccgagacgatgacgacctggcttgatgacaccgccttggcgatgtcatcgcgagccgccgagaccggcagctcggaaggatatgtgaatttcatccgtttacttgttcctcaacacttcaatgacgcgatatcccttcgcggaatgatacttcgacacctcataatcgtcgcccagcgcggtggcgagccaggggatcagcgagtcggcgcccaagtttttctgcaccaccaggtacgcggcgcctgcggggttgagccgcggcagccacgtcatcagcaggtcgtgcagcgcgtccttgccgatgcggatcggcgggttcgaccagatcgcgtcgaacgtcagatcggccggcacctgctccggcgacgcggcatggatgtgctcgcagccgttggacttggcgttggcgcgggtcaggtcgagcgcgcgttcgttcacgtccacggcccagacgtcggccttgggcgaggcgaacgccagcgcaagcgacacgggtccccatccgcagcccagatccagcagcgtccccgtctccggcggctccggcacctcgcgcagcagcaccgacgtgcccagatccaggcgcgagccggagaacacgccgttcgacacctcgaccacggcatcctgcccgcgcagcgtcaccttcatgcgacggcgaacgtcctcggaggacggttcggcggcgaaatactgttcggtggcgttcccgtcccgcttcgaggcgtccgaggcatgctgcgttttcattcgttctcccgcatatagatgagtgatggcttccgacttggaaccatgatagtcaaaggcatggttagcgggggagggctgcggattcctatgccttcgagagcgctgcgcctcttcgagaatgctttctggcgcaattatccggtagatatctaccgcagtgacattgcgtggtgcacaatgcaattgtcgggcggatggattccgccatcaatggcgaaaggatgggatcatgagtggtgcggataaactgggatacctgattcgtgcgctttcgaggacgaagcgcaaggattacgagaattacgtcgtcaatgccatatggaaccggttggcgatggacgatgtcaagccggtcacgcaacagctggtgttgtggcctgacgggcgtcggtcgttcgtggacctgtattttcctcaggcgatgatcggggtggaatgcgatgaggcctatcatcagaggcaacgggaacgtgaccgcgagcgcgagataaccatcacggacgtgctgcgtcagattcgcggcgaggactatcgggcgttgcatgtggatgtttccggatcgtatgagcaggtggagcgatccatcgacgactgcgtgcggcggatacgtgcagagatcgaacggcgcaggcaggcgaacgagttcacgccgtggacggaagcctacgtcgattacaaggagttctacaagacgagggacgccgtcagcgttgcggatgacgtcggctttccccgaatcgccgacgcggtcaacacgctgtgcggttccgagtacaagagatttcaggaatcctggttcgtccccagcgtgatgcgccaatggtacggcgaccgatatcgagtctggttcccgaagctcgccataggcgggaaggccgtggcaaacggttggaacaaccggctgtccgatgacggcacctatatctacgaatacaacgaggacgccgatctggtggatccggtcggcgacggcgaccccaatgacatccgtataacgttcgccaagtccgccgacccggtgacgcggattcaggcgtatcgattcgttggcgtgttccgccggatctcgaacagcgaggacggaacacgaaagcggtaccagcgcatcgaaaccgtcttcccgattcatcgcacgccttgtctgccaatccacagataatggcaagcgtttggagaacgtcgttccgtactcaccatcgtgcatgcgatgcggatcacctgcgatgcggaccaccgtggtgtggttcatgcctgcaggggcgtttcgtgtcggatgccgagtgacagatgtcgagtgacggataccgagtggcggatgacgagcagagagcatgagtgacagcagaggtgccattgagccaacagaataccgttgatgcgaatcaggccggtcagccgggcgaacaggaagagccggtgctgaccggtgtgctggccgaccagtcggacgtcttgctggacgagaacggcgatgggcacgtcgggcaacgggacgccgaggagtgggaggagcgcgaatcccgcaaccagctcaagcatgtcgcgggtctcggggagctgcaggacgtcaccgaagtcgaataccgcaaggtccgccttgagcgtgtggtgctggtgggcgtgtggtccagcatgaccaccaccgcggctcaggccgaggagtcgcttcgcgagctcgccgcactggccgagaccgccggagcggtggtgtgcgatggtctgctgcagcatcggtacaagcccgactccgccacatacgtgggttcgggcaaggcccgcgagctggccgacatcgtcgccgtgaacgaggctgacaccatcgtcgtcgacgatgatctgccgcccagccagcggcgtgcgctggaggatgccaccaaggtcaaggtggtggatcgcaccgcggtgatactcgacatcttcgcccagcacgccaccagccgtgaaggcaaggcacaggtggagctcgcgcagcttgaatacatgctgccgcgtctgcgcggttggggcgggtcgctgtcgcgtcaggcgggcggccgtgcggccggggccgacgcgggcatcggatcgcgaggcccgggcgagacgaagatcgagatggatcgtcgcgtcatccggagccggatagccagattgcggcgccagatcgcgcagatggccccggcccgtgaggtcaagcgcggttcgcgtcgacggtacgggctgccgaccatcgccgttgtcggatatacgaacgccggcaaatcctcgctgacgaatcgtctcaccggttccgcggagctggtcgagaacgccctgttcgccacgctcgacactgcggtgcgtcgagcccgggccaaggacgggcgactgtatgcctacgtcgacaccgtcggcttcgtgcgaaacctgccgacccagctgatcgaggcgttcaaatccacgttggaggaggtcgccgaagccgacatcatcctacatgtggtcgacggttcgcaccccgacccgttctcgcagattgacgccgtcaacgacgtgctcgccgacatcgaaggggccgaggagataccgcgcgtcgtcgtgttcaacaagatcgaccgaatcgatgcggccacacgcgagcggctggcggcgctcgaaccggaggcgagtctggtgtccgccgccacgggagagggccttgacgacctgctgcggcgcatcgaatctatgctgcccgttccgggcgtgcacgtgtctgcgctgctgccctacgacgccggttcgctgctgtcgcgcgtgcgcgaatacggcaacgtcgattccgtcgactatcgcgccgatggcatatggatcgaggcggatgtggaccgccgactcgccgcccagatcgtcgatagggcgatcgatgagacggacggtgatggcagcgatcacatcgatgccgagcatgatgtcgattgagtgttctacccattgccgctgacgcaatgtctgtgagcgttcacaacaatgtgacgcaaatcaccttgccttcggggcgataatgactacggcaatcagcgcaaacgtcatcatgtgtagatacagtaagtgtgttgtcaaaatgaaccccgccaaacacggggcactgtgctaagagaggtctagcaaacatggtggattcacccattaagcccacaaagctcgccatcgtcggtgccggcgcagtcggttccacgctcgccttcgccgccgcccagcgcggtgtcgcccgtcagatcgtcctcgaagacatcgccaaggagcacgtcgaagccgaagtcctcgacatgcagcacggctccagcttctaccccaccgtctccatcgacggttccgatgaccctgagatctgccgtgacgccgacatggtcgtcatcaccgcaggtgcccgtcagaagcccggccagtcccgcctcgacctcgccggcgcgaccatcaacatcatgaagtccatcatcccgaacatgatgaaggtcgccccgaacgccatctacatgctcatcaccaacccggtggacgtcgtcacgcacgtgtgccagaagctgtccgacctgccgaccaaccagatcttcggttccggcaccaacctggactccgctcgtctgcgcttcctgatcgcccagcagaccggcgtcaacgtcaagaacgtgcacgcctacatcgccggcgagcacggtgactccgaagtcccgctgtgggcctccgccaccatcggcggcgtccccatgtgcgactggaccccgctgcccggtcacgagccgctcgatgccgccaagcgcgaggagatccaccaggaagtcaagaacgccgcctacaagatcatcaacggcaagggcgccaccaactacgccatcgccatgtccggcgtcgacatcatcgaggccatcctgcgcgactccaaccgcatcctgcccgtcagctccatgctgaaggacttccacggcatttccgacgtgtgcatgtccgtgccgacgctgctcaaccgtaagggcgtcaacaccgccatcaacacccctgtctccgaccgcgagcttgccgccctgaagcgctccgctgagacgctgaaggaaaccgctgcccagttcggcttctgatatcggattgattgacggggcgccggtgcagatcggcgcatgaaccgccctcagtcttgcttcgcgccttgccatgctggcgcggctgtcggccaggagccggcggtgctctcatcttgccccccggcgggaggccatcgagtgaagcgagactgggggtggttttgtttatcggcagggggtcctcctcatcctggtattcgcccgcatctgctcacagagaacgtcggcgcgccgttcgattcggtgtatagtgaaccctgttgtttgaaaacctcggcttcggccgaggttttcgtcgttctagggctattgaaaatgattgtaggaaacagtttcacatagcaggcagaaggagaggtacactatgccgcacacgcatggaacggtgaacgaggtgacgcgcggcagcaaggcgcaccagcgacggcttatgatgacgctgaccttgactggcacggtgttcgtggcggagatcgtcggcgccatcatcaccggatcactggcattgctggtggatgccgggcatatgctcacggacatgtcggtgctgattgcatcgacggtgacggcggtgcttatgcgtcgaaagcccaacagctcccgcacctggggttgggcccggcttgaggtgctgaccgcggaggcgggagcgatgatcctgctgttcgtcggattgtatgcgctgatcgaggcggggatgcgactgttcggaggatccgccgaacatgtggcggacagtgggctgctgctgttcttcggcattctgggtctggctgccaatgtcggctcgatcatcatccttgccgggcagcataacgacaacatgaacatgaaagccgcgttcctcgaagtggtgaatgatgccctgggctcggtggcggtcatagcgtcggccgtggtcatgatgctcaccgggtgggatggcttcgatgccatcgccggcggcctgatcgcgctgctgatgattccacgtgcggtgaagctgttgcgcgatgcgctgaaagtgctgctggaggagaccccggacggattgaatctcgacgaagtacgtacgcatctggagaatatcccccacgtcgtggccgtccatgatctgcatgcgagcaccgtgtccaccggcatgcccatgctcatggcgcatgtcgtggtggaacccggcatgagcatggatcaggcggcgaatgtgctcagccaactgcaggactgcctgcgcgagcatttccccgtctcgattccccacaccacgttccagctcgaaccgcaggggtaccgttcgcccagcgccgaacagctgcactcctgaatgggacgccgcattgcgcggcttgatacgacaatgggttgggtgattgcctgaaatcgggcgattacccaacccattgtcgtatcaagccgcgcgagtgtattgaattgcaaggtccgggacggttggctgcggtcagagtcgacgcagcacgctgacgaccttgcccatgatctgcgcgtgggtgccgtcgatgggggagtatgcggggttatgcggtatcagccagatgtggccattgtccttgcggaacgtcttgatcgtggcctcgtcgtcgagcaacgcggcgacgatgtcgccgttgactgcggacggctgttcgcgtatgaccacgtagtcgccgtcgcagatagcggcgtcgatcatcgagtcgccgtgcacttcgagcatgaacagtttgccgctgcccgtaagccgttgcggtagccgcatgacatcatcgatgtgctgttcggcggtaatcgggacgccggcggcgatgcgcccgaccagcgggacgtcacgggatgcgagaatcgactcgctggcctccgtgtccccggggaaggggagtaccgtggcggtttgcgagtccgtgccggaatcatacaactcgatggcgcggcccttgttggcgctgatatgaagatagcccttgcgctccagtgcatgaagctgatgcttgaccgatgacgggctcttcagcccgacagcttcgccgatttctcggaaggacggagcgaatccctgttccgcaatgtgcttgcgtatggcatcaagcaccagatgctgcctttcggtcagggcgtcatcgcgttgccgcgtggcgtttttcgaggtgggtgctggtgtgctcacgtcgactcctttcatcttcgttcaatcatagcgtgatttgttccatgaaaacaaacattcgttcgatatggcgtgttgcttttgtcgaaccgctgtgtcactatgagtacagttgttctatgaaacatgagttcgagaaggagggcgacatgatggaacaaatgattgcggcagcggggctccagtgtgcatcaagtcgtcatgatgcgatgcgcgatgtggcgttcgatgtcaaaaacagcgatgttccaacgtttttgaggaatatggattcttccgatgcgcgacggcgtgattcccgggtgattatcggagtgtgcgacgagcatggtgttcgcatggcgaagaggggtcattcgaccatgtgtttgactcttcgcggcaagatcgtgttctcgatgatgggcgccctgctgtgcctgtgcatgatcggcctgctgatgccgcaggtcgcccggtcggcgccggatccctccgcagtgtacagctataccgtgcagccgggggacaccttgtggtcatatgcctcggccatcactcctgatgggggcgatgtgcgcgacaccatcgatgatctgatatcgctcaaccatctcgatggtgtctcgttgcaggtggggcagcagctcaaggtgccgattgtctgattccggcgaattcggagcggtgcgtccccatgagtgctttctcgaatcgcttcttcggcatttaccgccggccgcttccggattcggacgtgaccgttgacatggggaaggggctttgtcaacgcttacgatattctgaggtcatgcattgtccttattgtcagaattccgataccaaggtcatcgatacgagaatcagtgatgacgggttctcgattcgtcgcaggcgtgtgtgtcagatatgccacaaacgcttcaccaccgtggaaagcaccatgttgttggtgcgcaagcgttccggaaacgtagagccgttcgaccgaaagaaggtggtgtccggcgtgaggaaggcctgtcagggacggcccatcaacgaagacgatctacgcacactcggtcagcgcgtcgaagaggatctgagggcgagggggcttgccgaagtcgattcggacgatgtcggcaaggcgatattggctcctctacgggagctcgatgaggtcgcctacctgcgattcgccagcgtgtatcagaattttgatggtcttgaggacttccagcgagccatagacgatctgcgcaaggaaaagcacgccgaggcggaacagcactgaaacggaacggtgctgaaacggaacggtgctgaaacgaagcagtgccggagcgaagcagtgctgaagcggaactgcgctggtcgaaactgcgctgacacgaatcaatgttgatgtcgatgccgacgtcgacatgtgacgcctgatatgcgaccggccccttccatgatcgaacagcggaaggggccgtgtggaaaaccgatgaccggcttgttcagctgatcacgcgcatgcgaatcgtgccctcgatgtggctgagcgcgtccagcgtggtctggctgggcttctgcgatacgtcagtgaccacgtagccgagttcgccctcggttccgagagactgcgcagcgatgttgatgttctccttgcccagcacatggttgacgcgggcgagaacgcccggcaggttggcatgcagatgcgcgattcgagcagcgctcttgcacggccccaacgtcacctggggaaggttgaccgaaagcatggtcgaccccttgtcccagtagtcctcaagtcgctgcgagacgaaatgcccgattgacttctgcgcctcaagcgtcgagccgccgatatgcggggtgagaatcatgttgtcctcgtcggcgagatcggtgtcgaacggatcgccgctcttcttcggctcgacggggaacacatcgaccgcggcgccggaaagatgaccggaatccagatgacgcttcaacgcgtccaggttggcgacgaagccgcgggacaggttgatgaaaatggcattctgcttcatgcgggcgaactggtcctcgccgaagaagccagtgttggacttgcggccgtccacatgcagggtcaccgcatcggactgctccagcagttcgtcaagggtctcgcaacggtgggcgttgcccatcgccagcttctcctcgatatcgtagaacacgacgcgcatgcccagagcctccgccagcacggacaactgcgagccgatattgccgtatccgatgatgcccaaggtcttgccgcgaacctcatgcgagccggaagcggacttgtcccacaagccatggcgcatgtgatgcgtgtgggcgggaatgcggcgcatcaggcagatgatgtcgcagatcaccagttccaccacggaacgggtgttggaatacggggcgttgaacacgccgatgccatgcttgcccgcataatcgagatccacctgattggtgccgatgcagaagcatccgaccgcggtcagggacgggcatgcgtcgatgaccgctgcggtcacgggcgtcttggaccgtatgccgagcaggctcacgccgtcaagcgcctcgatgagttccttctcgcccagggcgcccttgcgcgtctccacttcgaaaccgtgatcgcgcagcgattgcgccgcatccgggtgaatgttttccaataacagagcttttgccatggtacctaccttatagctgcaaagctgtttcgtcttcccctgtccgcactataaccaatcgctgcgttggtctggtcatagccacgtagagatccgaagccgccaccaggcgcgagggagcatcctgctcgatacgtccgggctgtacgaccactacggcgtcgaattcaagtcccttgaccgactccgtggaaccgacgctgatctgcgcgtcccactcgtgctgctcggacagccggtccgtctcttgctgtcccagcgtacccggaagcgttgaaaagatagtggatcggagcggatcgagcatgtgggaaggggcgatgaccgctacgcgaccggttccgtccgcatccacgaactgcttggctagctgcgcgacatgcgatgccgcggtcgcgatcgtgtcggattcgccgtcgacgatgatcctgcgcacggcgtccggtatcgtgcgcacggcgttgaccgtcgagatatacagtcccgccttctgcgcgaagtccgaggccaggtccgaaacctcctgcggattgcggtagttgatggtcagctcgttgagatcccaccgccgctcgccgaacagccggttcatcgtgcggtcccagcggcgcgtgccgccgagcgcagacgtctgagccacgtcgccgacgatggtgaacgagcgcgacgggcaccggcggatcagcatgcgccagtccatcgcggtcagttcctgagcctcgtcgacgaccacatgcccgtatgtccactcgcggtcggccgcggcacgctgtgcgatgaactcgccgccctcgccgttcatctggtcgaccagcatctgcgaggagacgatgcccgacccgagacctaccgagttcagggtgtcctgcgcgaactgctcctcctgggcgcgcttcgcgttcttggcggcgatctgcgccgcgatcttggggtcgggccccagaagctccatggcctcgtccagcagcggcacgtccgattgcgtcatcggggcgcccttggggcgggtgagcgcggcgatgccatcgtcgtcaagccacggcgcgagcgcgcgaagacggagcggatgggaccacaggttgtcgatcagccacgtgccgttcatcggcagccacgcgaggttcagcgtgaccctcaccttgtcgttcaggcgaaggttcgtcagcgcctcgttcagctcgtcgtcggacggcgtatagtccagctgctcggcgtaacggtcccgaagcgccatcagcatggtccgcacgaaggtctcccgcgccttgttgtgcggctggcgcgtgcgcttcgcctggtcgatggccgccctgacatcggtgtcgagcatgcggaccgcgaagccgttcacgtgcacggtgggcaggtcctgcggaacccgttcgcgcagcgcgatggcgttggccacgacctgcgccatgcgacggtcgcccttgagcttggcggcgagcggagtgtccgtcgcggtcgccttgatgcccgggatgaggtcggcgatggtgcggctgacgacgcccgtctcgccgagcgagggcagcacctggtcgatgtagtgcaggaacgtcgtgctcgggccgatgaccagcacgccggagcgctccagcttgcgccggtgcgtgtacagcaggtatgcggcgcggtgcagcgcgaccgcggtcttgccggtgccgggcccgccctgcaccaccagagccctgttgagatctgagcggatgatgcggtcctgctccgcctggatcgtggcgacgatgtccgtcatcttgccggttcggcgcgaactgagcgatgccagcagggcgccttcgccggtgagcgtcccggccttcgaggccttgtccacctgctcggaatggacgtcgagcacctcgtcctcgatgccgatgacatcgcggaagttcagtgtgatatggcggcgcatgacgatgtcgccgtggttggatggcgtcgcctcgtagaacgggcgggccgcctcggcgcgccagtcggtcagtatcggctcgtggttctcgctggacaggccgatgcggcctatgtaccggcgctcgcccttcacgtcatcgagtcggccgaacaccagacggtcttccatggcgcgcagctgggtgagccggtcctcgtacatggtggcgaacgagtcgcgttccgtgcgctgggtgggggacccgtgcgagccggccgcacgtaccgtatccaaccgcgtgcgcgtctgcgatcgcagggcgtccaagcgggcgtatgcgcggtcgaccgcttgctgttcctcgtgcagttgcgttgataatcccggcattgatgtccgttctctcggtgaaaactcaggcattcaaatgtagcgcaagggcaatacgaagccgtgtggatgtgtcctgccgcaacggcgctccgaagcggttgtggaggatacgcattaaaactatgtggaaaaaccatttcgtggggatttgtggtgagaagtggggtacagtggtggattggtgtatccggattcacggttaggaggtggaacgttggcagacgactcgcaagtccagaacgccacgaacccctccgcacagccggagccgatggccctgcccccgctgttgctgggcacgtacaccccgaaaatcgacgcgaagggccgcatggccctgcctgccaagctccgttcccagcttggcgcgggactcgtcatggcgcgcggccaggaacggtgcgtctacctcctgccgcaatcggagttccgtcgcatcgccatccagatccagcacacgtcgatgggcgacaaggccgcacgcgactacctgcgcgtgttcctgtccggagccgtcgaccaagacccggacaagcagggacgagtgctggtaccgcagatgctgcgcgactacgcgaacctcggcgacgacatcgtggtgataggtgtgggcacccgcgccgagatctggaaccgcgaggcttgggaacgatatctgaacgagaaggaacaaggctatgccgacatagccgacgacgtgcttccggtggtgggattctgatgactgattatgcttcgattcaccagccagtactgcttgagcagtgcgtgtcgctggtcgccccggcgttgcaggaccccggatccatcgcggtcgactgcacgctcggtctggccggccacaccatcgccttcctcaaagccgcgccgcaggcccgcgtgctgggcatcgaccgggatgcggaagcactcgccatggccaccgagcgcatcgccggggaaggactttcggaccgcttcatacctgtccacgccgcattcgacgcgttcggccaggtgcttgacgaccagggcatcgatcgggtgaatgcggtgttcatggatctgggtctgtcgagcctgcagatcgatgagacggaccgcggcttctcctacgcgcacgacgcgccgctcgacatgcgcatggacgtcagccagcccctgaccgcgcaacgcgtcctggccgagtaccccgagcgcgagctggtacgcatattccgcgcatacggggaggaacggttctcccgccagatcgcccgcgagatcgtgcgccgtcgcgcgcaggaacctctgacgacgtccgcccagctcaacaggctcgtcgacgaggtggtgccgcaggcgcaccgtcccgccggaaaccccgccaagcgcgtgttccaggcattgcgcatcgaagtgaacggcgaactggacaagctcgccggcaccctgccgcagatagcctgccggctcgccccgaacggccgcctggtggtcgagtcgtatcactcattggaagacaagacggtgaagtcgttcatgaacgaaggactgcgcgtggacgcgccggccgacatgccggtcatccccgacgacgcgcagccgttcttcgcgccgctgacgcgcggcgccgtccaggccgggccggatgagatcgcagccaatcccaggtcggcgtcggtgcgcctgcgcggcgtcgagctggtcaggcccctgcctgcgcgctggcgccagcgcttccggcagaacgcgcaagtcgcccgggaccatgagtcggcccgggacgcgggtgaaaaccgcggcagacacggtggccgcggcagacatgacgacatgacggcacgaaacacgacatcgagaaggaggggatgatggcctcgacattgcgaaccgcccgctccaacgcggcgcccgtggcaccggcggggcgcggctcggatggcgccgcacgccccgccgcccgcccgcagctgcacgtcatcgacggctcctcccagcgcaacggctcccggtccaccggcagcctggcccgtatcatcgcctggacccaggcgcgcggcgcgtcactgatccatgtcacggtcgccatcgtcttcctggtcgccacgttgctgataaccctgatgctgcgcacgcagatggttcagaactctttcgaatccaacacggtgcaaaacaacatcaacatgctcacccaggacgtgcaggacgatcaggcgaaacttgacgagctgatctcgtcgctgcccgacaaggcacagaagatgggcatggtgccccagcaggattccgtcaccatcgatctcaacgggtacaaacccagtaaggggtccgctcaatgatcggccgaataaccgcaatgatacggttcgccagatgccgcaagttcctcttccagtgcatcgccatcggcgtcatactcgcgatggtcgcctccgcatgcctgttcaagctggcctccatccagctgatagacggccagatggccgcacaggcggcgacccaggcccggaccaagaaggtgatcgtccactcgatgcgcggcaagatcaccgacacgaacggcaccgtgctggcgcagagcgtcgagcgatacacgatcatcgccgacccgtgggcggcctcgcagttcgagccgatcgactgcgacacgcagaaggcgaagcaggccggattctgccacaaggtcaacggcaagccggtcggggtcaagggatccgcgggcgtggcccgtctgctggcacccgtgctgaagatggacgcgaagacgctcggcgccaaactgaccggcaccagccggtacatgatcctgaagaaggacgtgacgccgacggtcaagcgggccatcgacgacctgaatctgggtggcgtggtctatggcgagttgagcagtcagcgcatctacgccaacggcacccagctcggcgcgctgctcggcggcgtggacgattccggcaagggcgtcgccggagtggaaagcatggagaactccgcgctgaccggcacggacggttacgtcatctaccagcaaggtaacggcggcgaggagatccccggcacgctgaccggttcccaagaggccgtgaacggctccgacgtggcgctgacgctggaccatgacgtcgactggtacgtcaagcaggcgttgctggaaggccagaagaagaccaaggcgacgtgggccatggcggtggtccaggacatccagaccggcgagatactggccctggaggacaccgacgaataccaggcgggcagcgaccaggccaagctgaacgcgtctcgcgccgtcagcgaaagcttcgaaccgggctcggtgggcaaggtcatcacgatgtccggactgctgcagaccggactgcacaaggcgaccgacaagttcactgttccctattcgtacaccaaggacgggcaggaataccatgactcgtccgcgcacggcgacgagcactggactctggccggcatcatcaagaactcctcgaacgtgggcgtggtcatggcttcgtcgcagtacacgaagaagcagcggtacgagtacctcacgaagttcggcatcggccagtccagcggcatgtccatcccgggcgagtcgcgcgggcagctcggcacgccggaatcgtgggacgggcgaaccagcaacacgatcctgttcggccagggatactccgtgaacgcgctccagctgaccaacgtcgtcgcgaccatcggcaacaagggcgtgcgcaagcagcagtcgctgatcaagtcggtcacccacgccgacggcacggtggagacgccgcaggagggctcttccacgcgcgtcatcgacgagtcggtcgccgaccaggtcaagaacgccatggaatccgtggccgagggatacagcaaggtggtgaacgtcaagggataccgcatcgcggcgaagaccggtaccgccgaggtcgcgggaagcgacggccggctgacctcgatcgtcgccgatttcgccggaatgatcccggcggacaacccgcgcttcgccatcaccgtgatcatgaaggacccgcagggcacctacggcggcatgacggctggcccggtgttcgccaagattggtgaattccttatgcagaagtacaacgtgccgacctccagcccgcgcaacgatgctattgcagtggactggtaaggggccgcgccggaaatccggcggggcgtcgacaaggaacatacggaagaaaggcggaagcgatgagcgcagtcagtgaagccgtcgcgcggcggatgacgttgggatatctggccgacacgtacgggctggaactcgacccggacttcgcttcgggcgtcaccgtcacatccatcgcggacgacgtcgattccgtggctcccggatccctgtatgttcccgcgcagagcgtggacgtcaagcggctggaggaggcccgggcccgcggcgcgtacgctgcgctggtccccccgtcgatgaagcacgaggacggccccgcgcagatgccactgctgcgcgcgcgcctgacgtcccggcagctgggcgacatcgccagcgacatcgcgggcaccccgtccaacgcactcgccattttcgtagttggctcggatgacccgaaacgcagtgaacggtacgcgtcatgcgtagcggatttcctgcacatgctgggcaatcctgtcggcgtcgtgaaatcatccggctcgacgtcgctggagcgcgagctcgacctgacctacccgctgtcgatactcgacgtgcagcagacgctgtcggtctgcgcggaggacggcgcggcggcgatggtgttcgcgctcaacgaccgtacactcaaatccgatgcgctgaccagcgtgaacgtcgacgtcatcggcctggactcggcacgagacctgcgccagccgacgccgagcggcaccggcgaggattcgcgtgctggcgaaggcggcgaagcggcatctccgtccgggcagtgggcgagcggggaggagcccgccgggtcggctggcgacgcccgggacgacctcgcacaggcgcggcagctgggggcgggcttcggcttcgaagtcgacgagcagacccacgtcgcccgtgccgacgcgcaatccgacctgctcgcggcgcaggccccgttcgcctcggaccgcgacagtatccgtgaattgtcgctcgccattgccatggttatggcggcggggattcgcagaaacaacattcgcagtgcgctgcgcgtatctcacgaattggctcatggagaggaaaacaaggcatgaacgcagaggcaacgatgatgcctatgaccgttcggcaggtggccgaggcggtccaaggcaggctgatcgtcccgcagacgggcgacggcgtcgaagacggagccgatgcactggccacgtcggcggtcagcgattcgcgccaggtccgtgagggctccgtgttcgtggcgatcgccggcgagcgtgtggacggtcatgatttcgtcgctcgcgccggtgaatccggcgcggtcgtggcgctcgtacaacatgaagtggacgcgccggtggcgcagatagtcgttcccgatacggtcgacgcgctgggcctgctcgcgaaggcgaacatcgccgcgcggcgtgcggtcggaacgccgttcaccctgatcggcatcaccggctcggtgggcaagaccaccaccaaggacctcatggccgccctgctgtccacgctcggccccaccgtggcgcccgtcggctcgttcaacaacgagatcggccttcctctgaccgcgttgaaggtcggccgggacacgcgcttcttcgtcgccgagatgggagcgagccatgtcggagagattacgcgcctgaccacgatcgcccctccggacatcgccgtcgtgctcaaggtcggatgcgcccatctcggcgaattcggctccgtcgagcgcatcgcgcaggcgaaaagcgagatcgtccaggggctggttcccgatgggctggcggtgctcaacgccgacgacgcccatgtggcggcgatggcccccctggcgccgcaaggacacgtattctggttcggcatggccggcgacgacgccgaagccagcgccggcaacgccgcatccgggaagtcggacgcactgttcgccagcgacgtgcggaccgacgacggcgaccgcccctcgttcaccttggagcgggccgatggcggaaccgcccatgtgcaactggcgattcgcggcacgcacaacgtgatgaacgccctcgccgcggcgagcgtcgcccacctgctgggcgtgccgctgcagtcgatcgccgagacgctgtcgcgtcagtcccgcatcagcccgcaccgcatggcggtgtccacggtccggcgcggcgggatgtctttcacactgatcgatgattcattcaacgccaaccccgactccatgcgagccggtctcgacgggctcgcccggtggcgttccggtgaagacccgtaccgtatcgcggtgctgggagcgatgctggagctgggcggtgacgagtccgcgctgcatgagggcatcggcgagtacgcggccggcctgcccatcgacgccgtcatcgcggtgggcaacgatgacgagcatttcgacgcgctggcttccgcccttgcgaagggcgcgcggaagcggcgtgacgacagtgacggcaacacgccggaggtgcattgggttcacgacatcgatcaggccgacaccttggtccgagctcttgccggagaccatgacgacacggttgtgctgctgaaggggtcgcacgcctcgggcctgagcgccctggcgcaacgatggacgacagcggacggacagccgtccgaccacgaataggaagcgaggaatctgagttgatcgcgttaatcattggcattctggtctcgcttctggtgaccatcgcgggcacgccgatgctgatccatctggtgcatcggctgcactacgggcagtacatccgtcaggacgggccgaagtcgcatctggtcaagcgcggcaccccgaccatgggcggcgtagcaatcgtgctggcgatcgtgctcggatggggggcgtcggcactgtaccgttacgtccgctcgggagcggttccctccctgtccgcgatgcttgtgctgttcgcgatgctgtcgatgggcctgctcggcttcatcgacgacttcgccaaggtgcgcaaaaaacagaatctgggcctgtcggtgcatgccaagttcatcggccagttcatcttcgccacgatctacgcggtcctcgcgctgatcatccccaccaaatcggggttccccagcgctcaggcaggcatgagcttcattgagaagccgttcttcgacttccggttcgccggcggcgtggtcgccgcgatcatattcgtcatctgggtgaatttcctcatgaccgcgtggacgaacgcggtcaacctgaccgacggccttgacggcctggcatccggttcgtcgatgatcgcgttcgccggatacgccatcatcgcgttctgggaaagctaccatatcaagggcggcacgcacgaagggttctcgtatgcggtgtccgatccgctcgacctgaccatcatcgcctgctgtgcggccgtcgcctgcttcggattcctgtggtacaactcgaacccggcgacgatcttcatgggcgacaccggttcgctggcgctcggcggcctgttcgccgcgctgtccatcgccacacacaccgaattcctcgccatcatcatcggcggcctgtacgtaatcgaggtgatgagcgacatcatccaggtcacctcgttcaagctcacgcacaagcgcgtgttcaagatggcgccgatccaccatcatttcgagcttctcgggtggagcgaatcaaaggtcgtcgtgcgcttctggatgatcgagttcctgttcatgatcgtgggcctgatgatgttctacgtcgattgggtgtcccgatccgggttgctgtttgtctgaacggtaccgtgacggctccgcgccgcacagcgtggcgtgaccgccgcggtataggcaggttcgcatgagagcgtccgccggttcggcggcgcaatgacaagggagacgatatggatctcagtgacaagaccgttctggtggccggtctgggtatatccggccgcagcatgatggaagtgctgcgttcccgcgcagcgcgggtaatcggcgtggacgagcataagccggaggccgacctgcattcgttcgacgacatcgactgggattcggccgacatcgtcatgacgtcgccggtgttcaacccgcgcacgccgttcatcctcgaagcccaacgccgaggcatccccgtgtacagcgaggtcgagctcgcgtggcggctgcgcgtggacagcgcccgcaccggccgccccgccccgtgggtgggcatcaccggcacgaacggcaagacgtccacgaccgagatgacctcggccatgctgtgcgccgatggcctcgttgcaccggcggtcggcaacatcggcaaggcggtgtcccacgccgcggtcgatccggacaacgacgcgctgtgcgtggagctcagctcgttccagctgcatttcaccgattcgctggcgctggattgcgcggcgatcacgaacatcgccgacgaccatctcgactggcatggcggcatcgaagcgtacgccgccgacaagtcgaaggtgtttcgcaacgtcaggcgcgccctggtgttcaacgccgacgaccggcgcgtcagcgcgctcgcctcggcggcgcataccgccgagggatgccggcacatcggattcacactcggcgttccccagcccggccagatcggcgtggacgacggctggatcgtcgaccgcagcggcgtggccggcggcgcattcggcgatgagacccgcctggcgccggtccaggagttcccccacctgtgtgagccggacggcaccgtgtacccgcacctgctcgccgacgcgatgaccgcgctggcgttggcgctgggaatgggcgtggacctcgataaggcgttggccgcgctgaaggcgttcgcccccggcggccatcgcatccagacggtggcgacggccgcgacgggcgacggcggctcgatacgcttcatcgacgattcgaaggcgacgaacgcccacgcggcgcgggcgtcgctgagcagcttcgcccccaagagcgtggtgtggatcgccggaggactcgccaagggaagccgtttcgaacagctcgtggcggatcaggcgcatacgattaaggcggccgtcatcatcggcaaggaccagaagccgatgcttgaggcgttcgccgccagcgcacccggcattcctcttaccgtgatcgagcccgagccctcggacacggtgatggcgcgcgcggtcgatgccgcaggcgcatacgccggcacaggtgacgtggtgctgatggcacccgcctgcgcctccatggaccagttcgtctcctacgcggaccgcggcacccagttcgcgcgggagtcctcacgatgggtgacgcagcatggcaagtgacgatccgcggcgacgcgcccgctccgtaagatccggccagccttcgcggtcggatgctggttccgcgggcgcgggcactggcacgggcagacgcacggggcaggattcgtccgcctcccgactggccgaagctcggcgggtcgaagagcgtgacgcccaacggctcggcaggttcaccggactgcgcagcctgctcaacccgctgtggtgctatcacggcttccgggccgccgttgtggtgctcaccggcttcggcgtgatcatggtgttctccagttccaccgtgtcgatggtctccgccggccgatcgccgttctcgcaggccatcagccagggcatgtactgcgtgatgggtctggtcgtgggcgtggttttcatgtgccttccggctcgtatgtacaggcgtttcagcttcgccgtggtgttattcgcgatgctgctgcagctgctgacgttcacgccgctcggcgtcgaggtcaacggcaatgccggctggatcggcaagcgcggcgtgttcacgatgcagccggccgaggtgatgaagctcgccttgtgcatatggcttccggcggccctgcactgggcgaagaaacacagcggtaagatcggcaagttgcgggcatacgcccccctgacggttctgtatctcctgtgcctgggattcgtgatgttgggcaaggatctgggcacggccatgatcgtcctgttcatcggattcgtcgcgtttcttctgggaggatatccaggcaaggtccttgcggcctttgccgccctgggcatcatcggcatcgtgggattgatcgcatacagtccgaacaggctgaaccgcgttctggccgcgtaccaggagtgcagcggcaccgatgcccaaaaggtctgctaccagtcgatacacgcgaaatacgccttggccgaaggcggtctgttcggggtaggcttgggcaactcccgcgagaaatggaactatctgccggaggcgcacaatgatttcatcttcgccatcatcggcgaggagaccggtttcatcggagcggccatcgtcatcatactgttcgtggtgctgggaggatgcatgatcagcgtggccctgcagaccgcggaccgttacgcgtcggtcagcctgctgtgcatcaccgtgtggcttgtcgggcaggcgctgatcaacatcggcgtcgtggtcggggttttccccgtcatgggcgtgccgatgccgttcgtctcggcgggcgggtcgtccctgatcatgtgtctggcggcggccggcgtggccgcctcgctcatgcgcgcccaacctcagatcaaggccgattcgtcccgcgcctgaccggaggcggggctgtcggcgaagccagctggggtggccataaggcccttccaacagggcgaaatatgtcaaagtcggcttgacgaagccgcgttttttcatcactcacgctaagctcggagattatgagttcatcacctgtgcatatcgttctggcaggcggcggcaccgccggtcatgtcaacccgttgctggccgtggcggatgcgattcgccgtatccggcccgaggcttccatcagcatcatcggcacggccgtaggactggagcacgaccttgttccccgtgccggttatgagctggacaccatcgaaaaggtcccgttcccgcggcgccccaacaaggccgcgctccagtttccggccaagtggatgcgcgagaccagcaaggtccgcgatatcctgcgttcgcgtcacgcggacgtcgtggtcggattcggcggctatgcctcggctccggtgtattccgcggcgcacaggatgggcatacccgtcgtcatccatgagcagaacgcccgagccggcatggccaacaagctcggcgcgcgttacgctgcgttcatcggtacggcgtacgagaacaccggcctcaagccgggatccgggtgccgtatggagcgcgtcgggctgccgttgcggccggcgatcagcacgctcgcggcgcagttcgcgtccgatcgcgcgtccgtgcgccagtcgggggccgaggcgatgggcatcgacccagcgcgtcccatggtgctggtcaccggagggtcgctgggcgcggtcagcctgaacagggcggtggcatccagtgccgcggtgctgctcgaacacgcgcaggtcgtccatctgaccggcaagggcaagatcgacgaagtgcgctcgttggtgggagagcgcgccaatgccggggtcttcaccggtgtgggccctgattcatacggcaagggcgactatcatgcggccgaatatctggaacgcatcgatctggcgttcgcatgcgccgacctggtgatttgccggtccggggcgggatcggtgtccgagctcgccgccctgggcctgcctgcggtgtatgtcccgttgccgatcggcaacggggagcagcggttcaacgcgcttcccgtggtcaaggccggcggcgggctgatggtggccgacaaggatttcaccgcgcagtgggtgcagtcccatgtgccgtcgctgctcgccgaaccggaccggctgcgcgagctgggcgacaaggcatgggagtacggcattcgcgacgccgccgacaccatggcccgtcgcgtgcttgaactggcgtaatgcggcgctctgattggcgtcgggtatgaccataatggtgaccagcatgaatcatcaaggagaatctgcagtgtctgaagcgcaaaccaatgccacccctatcgtcctcgacccgatgagggtcgcgttcgcgcccgacgcgacggtgttgcaactgggaaggacccatttcatcggcatcggtggcgccggtatgagcgtgctcgccgaaatgctccatgagcgtggcgtcgacgtcgacggttccgaccgtgaggaaggctcgaagaccgaacggctgcgatccctcggcatcaccgtcgaaatcggccagcaggccgacaacgtgcgtggtgccgacaccgtggtgtactccagcgccatcaagcccgacaaccccgaaatcgtcgcggcgcacgagcggggcatccgcatcgtgcatcgcagcgacatcctggcgttgctgatgaacggccgccgggcggtcaccgtcgccggagcgcatggcaagaccacgacaagttcgctgctatcccacatcctcgtccatgccggaaccgggaagctggccgatcccagctacgccatcggcggcaccatccaggcacccgggggagcggtactggacggcgggcatgccggacgcggcgacgtattggtcgcggaggcggacgaatccgacggcagcttctgcaagtaccgtccctcgatcgcggtgatcacgaacgcgctcgcagaccatctcgaccattatggcgacgaggcgcattactgcgccgcgttcgtcgaccatgcggggcatgcaagcggacatgtcgtcatgacgggcgatgacgagggtgccgtggccgtgctgcgcgacctcgacccgtccgtggcccgtcgaacgatcgtgtacgccaccaaggatgccgaccagatcggggacctgcgcggcgccacgctggtgcgcatcgatgccgagcatgagagcgccgacagcggccgggagaccttcaccgtccatgtgccggcgtcactcgcgtcggtctgcggctgcggcgacgccgatctggcgttgccggtcagcctcgccatcccaggcatgcacaacgcgcgcaacgcgaccgcggccatcctggccgcgatgctgttgggcgtgacacccgaggccgcagcccaggccgcctcgacgttcctcggagcctcgcgccggttccagatgcgcggcgaggagaacggcgtgacggtggtcgacgattacgcgcatcatcccacggagatcagcgcgctgctcgacgccgcccggcgccggtacccgcgttccgtcatccgggtgctgttccagccgcacctgttctcgcgcacgcgtacgttcgcccacgagttcgccgaggcgctgtccaaggccgatgacgtcatcgtcaccggcatcttccccgcacgcgaactgcagcgggacttcccggacgtttccgccatgaccatcgtcgatgccgcgcaggacgtgccgcacgcttcggcgcagggcgacgggacgtggatcagcgcggtcgacgacatgcaggtggcggctcagatgctggcgatgcgctgccgtcccacggacgtggtgttcaccgtcggcgcgggggacattaccgccatgggcgcggtgatcctgcacgcactgggggcccggcacaatctcggtgaccgctgatggcacggcgggtcgtttcctcacatggcgatgccggtcgtgaggccgggcaagggtccggctcgcgcaagccgcgcacgacggcagacagggcctcatcgtcgggtgccgaagccaatcgcgtcgccgtgacacgggaacgccagaccaggaaaaagcctcgcaccgcgtcgaatgacgtgtcccggaaggctgcatccggagaggcgtcgccggggagaaccacggtcgggaaggcgacgggccggcagatgacgtccggcaggaagtcggaaaaggccttagaaaaagagacttcccgacaggtaaagggcgggaaaacagtctcccgaaaatcgaggttcggaaagacggcgtcccggagcgtttcgtcgtcctcgtcccggtcggtatcacgcgccgaaggtttcgtcgacgcgcgtcgcctgcacagcgaggatgtggtcaagaagacgctcgatgagaacgtcggcgtgctcggcgtggcgacccgtcccaaagtgctggatttcgacgcgcgcctgaaggagcggaagaaggcgggcacccgggtcgccgccatccgcgtgctgattgtgatattggccgcggcgctggtgtccgcgctgatctggcttctgttgttctcatccgtgttccgtttggaaacctcgcagatcagcgtcagcggcggcaacgaatgggtgagcgagaaggatgtgctggatatcgcgaaccagcaatccggcagatcgctgttcctggtctccgcagacaaggtcagctcgcagctgaagaacatccccggcgtaacccaggcgaacgtcgtcaaacggtatccgcgctcgctggagattgacatcaaggcgcagcagcccgccgccatgctcaaggaaccagatggaaccctggtggcggtcgaccgcaaggcccgcgtgctcaacgcggtgggcaaggcgtccatgaaaggtattccggtcatcgaggtgagctcggtggacaacggtctgaacagccgcgccgtcaaggaggcactgaccatcctcggcggtctgcccgacacgatgcgcaccgtcatcaccaaggtgagcgcgaaaacgcaggattccatcaccaccgagctgagttccggcaaatatgtcgtcgtctggggtgattcgtccgagctgaaactcaagtcggcgatcgtcgacaagctgctcagcgacccgtcgctgataggagacaagcatcagatcgacgtgtcggccccgagccgacccatcatcaaatagcgcgcgtttcgccgtgggcaggacgcgaaacgtgggtgaaaatacgaaaagggccgcatgatcgttggaatcatgcggcccttggagtggagctgcggggaattgaaccacggtcgcccatgctccgggatgctatgagttaagccgttttcccttgtgcgagtagggctgagcggcttttctgtttatccgtgtttttccgtgtttcacactgtttttccgagggaatgtgggcaaaatgtgggcaaaaaggagcgcgccgtcatatgggtggcggcgcggcattgccctcgatctgtcagcaagggttagtctggcattgcgacacgcgcggtgtattgcctacttgataatacatcgcatgccatgggcatcgaggcgtccaacaacacgcccgtcaccatcaacgtgcggatcggttgaacgccgcaccggcgtataatcaaaatatgtcgcggacaacctgcaggtcactctggacgagttctggctgctctgccatccggcataggggtcggcaacgcacccgattgagaaccgcgtaacatcaaaatagcgcccctcgactccgggaaaatggagtcgaggggcgctgtttgttttagaatctgccggtgttgagccgggtctgtagggcgcgtgcggtgccggggccgaaccatgagtcctgcgcgacgccgaggtgctgttggatggcgcggatggtggcggggccgagcagcccgtccgcagtgaggttgaggcggtgctggacggcgcggatgaggttgctgccgccgcccccgtagcgcacgcacgagtccacgagcgcgggacgcccccacgtgcggccgtccggcctgacctgtccgctgatgatgccgtccacggtggtgcccatgacctgctgccatttgcggatggtggcggggccgcatgagccgtcgaccgcgagcttgcccgtgccgccgctgcttgcggagccgccgcccgacgacgtggcgctgccgttgtaggcggggcgcaggatggccgcgaccgtgttccatgcgcgggtgcggcgggctacgcgcccgttgttggtgttgccctcgatggtctggatgtacgagccgtggttggcctccacgaagccgatgtggtcgaccacgccgccgtcccagttgaagatcacgaggtcgcccgggcgggcgctgcgcgtgctgaccgcgcgggagcgtccggctgacagcacgtagggcacgtaggcggcgggcagtccggggaacggctggcccgccctgctcatgacccatgacacgaacatggcgcagaacgggactcccgacgcgccgtagtaggagccgtgggattgcgcgtaccagcggccgtatctggtgccgggctgcgggtcggtccagcggctgtagccgatttcgcccgccgcgatcctgaggacatcactcgccgtcgccataggtcacctcctcgatgggtgccacgtcggcggtcgcgtcggctcccttggagtcggacacggcgtgcgccacctgcgtggcctcgcctgtggtgtcggtagtggtggcgacgatgttggctttgagcgcgttggtgagctgctgtccctgcacggcggccgtggtgacgttgttgttgcgccaccacgcccagacggatgcgatgacggcgatgacgccggtgatcgcggtgctcacctgatccgacgtgaacggcagctggctgatgccggcgatgctcaggccggtctgcgcgacgctgaagagctggacgatcagcaggacgattgccttggtgcgttccacggtcaggccgggaatcgacgggctgacggccttgtggtcgggctggtttggcgtgtttgccatgatggttctccttacatgaagaagccccacggggtgtggggctttagttggttttatagagtcgggcgcccagatgggcgttcgcgtaggttttgccggaactggcgcggattttgagcgtgtagctgccggccgtgaggtgcgccgtgagcacggggttggcggggttgccgttcatggccgcgtcccatggcgcgaagttgcgcatgacgaacgagaacaggccggggcgtcgaatcggcggcgcaccggcgagaactcggcggaacccctcaccgggtcgaggctcccgtcagccttcggtcgcttgacgctcagattaatcgttgtcattgtgccgctcctttggttggctatcggtggtggacatggtttcgggcgcgatgtccgcgcgcagctcatccggcaacgacggcttgggatgccggacgaggaaatccggtttgaccagctcgcagaaatcctgcagccagtggaacaggcggcgcgtgtaccccaccgccgtgaaatacttgtgctgcacccgctccagatgcctgatctgctcctcctgataggcgacctgctcctgcagcgggtcgatgatgctctgcgtgaggatcttcacggccttgtcggcggcgtccgcggtgatgccgtctatgtcggcctccgtcttcctgcggttgctccacgctcccacaagaccgccgacaccgccgccgccgatgagcgcgaggatgatcgacgtccagaactcctggctcgcgaacaattcctggaatggtggcatcatgccttctttctgctaaaaaacgggaatcccacacggtgcggccgttccatgaggccgttatgcgtgtgggattttggaggttgagagatgttgttgcaagagttttggaacgaccggttttggccgtattgcgtcgataatctgcgcgagtccacgtgggtcggctacgagagcgcatggcggttgcatgtcatgccggttttcggtggcatggatctgggcgcgatcagcgtggagctcgtggacaagtggctggcccgattcgacgagccgggagccgcccgcaaagcatgggcagtcctacgcgccatgctcaggaaggcgatacgctggaacctgctggacgtggacatcacgagacgtgacatccggctgcctcaacgccgccgttacgagccgcggctgctgaccacgcggcagacgcgcgacatgctgcgcggcttctacgggcatgacttggaggcatggctgatctgcgccgcatcatgcggattgcgcaccgaggagggactgggactcgaatgggccgaccttgacctgcgccgtggcgtcctgcacgtggagcgcggcctgcaatgggtcaaaggccacgatgtcgtcgtcgagccgaagacagagctgagccgccgaacgttgccgttgccgcgtttcgcggtcaaacggttgcgcgagctcaaaccgcgcgacggtggtcggcttatcggcgagcgcacgcccccgcaggtcgcgagagcctacgtgtcatggtgcaagcggcataatctaccgcacgtgcccgcgaggaacctacgccactcgtgggcgacgaacacgctggcggcgggagccgatatcgccatcgtgagcaaaatgctcggacacagcgacatcaaaaccaccgcaaagtattacctcaaaccggacatctcagccctgcgtgacgcacagcgcctcttcgagcgagccttgatagcctgtgggattcgctaacccagtttgagacggggcagctcaagatgccgtacagcgacaggaccatcaccctgaccaaggtagggtgcgtggtcgtcgcgaacgcgtacatcacgctcaccggtagtttcaagagcgccggcaacgtggcggtcaacgagaagattcccgagggattccgtccggcggacggcgctaacgcggtgctgcacggctccgacaacggcggcgacgccacattctaccttgtcgtgagtcccgacggcagcatgcggttgaacggcaccggcaatgtcggccgattcatcggcgtctccggctgctggattaccgtgtggaaccgctcctaggcgaacgtgaccccgtcggggatgggtagcgtgcggggcgtgtgtatgcaccggtcaccattcgccagtcctccgatcaccgtgatggtgccgtccgtgttccaacgcgcctgtttgccgtaattaccgttcgggatcgaccacaggcaaccaaggttgattgtcttggacggccgcgggccggacgcatactggaacaccgggaagttgccgactgtgaccttgctgcggaaaccgctcaggtccacatgcaggagccggttgcgccggtccacgatgatcctcatgccgccgccgtaactgtccgccacgaacgaccccgtgtcctgccacttgaatttcgcgataagaagcgtctgggttagcgaatcccacacgtcgctcatcggcttcaacacgttgaacaacgcgacgggcgtgccgatggtgatgccgtcgagcggaatcctgtagaggggcatgtcgtaggtggtgccgccgtccaacgggctggtcgtgttgatcgtggggtccgtgggcgtgcccgtggtgggcgtgcccttgaccacgagcagttgagccgattcgatcgactgactgcctttcgtgtaccggcatacgaccagatcgttgcgtttcatgccctgcgagccgttcgtgacgatcaggtcctcgggcctgccctggttgacgtgtcggccctgcatgaccagctcgcccgtgccgatggtcaccttgttggccgagacgaccgagattttgaacttgtcgtgcacgttgagcacgtagtcgtcgaggccgaggatgccggcgttcaatcccgcggcctgctccggggtgacgtgcgccttgcccgcgtgtcctgttacgagttcagccattctgcttgcctccgttctgcatccaactgtcgaagctgttatcaaagtccttgagcttgttcgcgtattccttgtaatcctggtcgcagaacaggtagtcgtggcccgtgccggtggagtccagccggttgacgttgtaccacgtcttgatatccgggtcgtccaagtccttgtaccatttgtgtttcccgcaccggtcgcattgcatgaccgtcgcattgtcgatacgcgccatagcgtgtcctcccttgttattcggcctcgtaatcgacggacaagacgccgcccgagaccttgacgattttcttggtgatagaggcgttgacggtgatgccggtgagattgtcacgcgcggtcacggtgtcgcccacgtcgaacaccacgttcgcgtcatcacggacggtgaccttcacatcaccctcggactgcaagtcctgcaacttatcacgtgtcttctgattcagctcggcggtttcggcgttgctgtagtcgtagacctgcgttatctcgtccacgcccttgagcgattgggattggctgacattgcctttggcgtccgcataccagtggacgacggttctcgcggccaaatcgcccttgcccaggccgatcatgtggttcggcttgcgccacgtgcgggtcgcgtcgaaatcgatgaggtcgctgtcaatcgagtcgccataatgcgcgatgggttccgcccagatgttgacctgaccggacgcataggcgagcttgagtttcagtccgttggctgcgcacatctttcgcaaaccggtatacgcatccacgtaacggtcgaactggtagcttttgatggtctgcgcgccggcagtgggcgaatccaccgcgtcaaacacgccgtcaagaccaacacgtctgatgagcgaaccgatgaccgaggacgcggaaccggaaaccgtcagataatccttgcctgagtcgggggcgagaatcttattagccagcatgccgtgccatgtgcggccggaataggtgagggtggattcaccacgtttcagagagtccttcagcgcgtccaccacgccgccgcactcgccgccgtcaaggtagacgtagctgccggattcgatgagtctgccgctaacggtgagctcgaaatcgttttcgtcagaaccccatgcggagtccagcttgtaatcagcgacgctttcacggtcaacgccttgcgcgtcggtgataatcagttcggccatggcggttcgctttcctccgcgtagacggtcagatcaacaccgaagccattccactccacggtgctgtcgccgggcggaattggctggaatatgtattcgccgccgttgagcccggttccgcgccggcctttgtcgaacacgttggttttgtctccgttctcagcggtcatgacgatggtgcgaaggcctgcaatcgaagtgacggtcacgtaggagccggacggaatctccatgttgagcgcgtaccggttgcctcccaacgtgaactgcgggttcgacacgggcccgtatatcaccatctggaacggcatggccgtaggcatgggattgttcgcggtagcgtttcgagtggtcatcagataatcatgcgggtaatcgtgcggatagtcgaggtcgaggccgggcgtgagcgcgtccgaccagaaatgctgcacggatccggccttgcgccagatgccgtccaacaggacgacggtgagcttctgttggattatcgccggcgtgatggtctgcggttccgccttgaccacgtaggcgcgcgtggtccatccgtccgcgtcgaacgtgccgggcgttccggcggccacgtccgcgtcgaacaggcggcgagtcgaatccaccttctcggggcagcggacataggttaggtcaagctcggcctcgcgcgccgtgcgacttactccggttagactccggtatccgagggtgtacgaccattcgcggccgcgcagcccctccgccgtctgagcccagatatcgggcccttccagtgggatcgtctcaccggtcgaggcgcacacataactaagcgatcgcattgcgtatcacccttccgagttcacgaccatcgacttcgatgccaagtttctccataatcagtggcatatccgcgtgcagcgcgcgcagttccgacaggagttcgccgagcagttcgcccgataacggttcgccgccagtcgagacggaggctctggtcgggctcagaccgtagccggtggctacatcgggagtcgtgaaccgtgtggaggcgatgtccgaggccatgccgttcatgctggacatgacggcggcttggctgttgctgatgccctgggcgagaccgagaccgatgttccgacctatctggtcgcggaacaagcgtgacggcgagtggatgccgagaaagttcttcacgccggagatggcatctttcacgccgccgagaatggcgctgccaactttgccgatgctgcccgtgatgccgctgataatgccctgcacgatctgcgagccgatggacaccatgcgtcctggtatggatgcaagcgtgttgaccagattgctcaggaactgctggcccgcgcgaagcgcgccggatgccatgctgctggcgaacgagccgaccgcgcttatcgcgccggaaagcccggcaccgatgcgtccgggcacctgcgagatgtaggagccgatggacgaaaggaaccgtgaaccggcgttgaccgcgttcgacgccatccggccgacgaagctggctgcggcgcttacggccccgctcagccacgagccgacgttcgacggaagctgggagatgaacgtgccgacgttgctgaggaactgggagcctgcggaaagcgcgttggcacccatctgcgcggcccagctcgccaccgacgcaaccgtggaggtcagccagttccagatattgcccggcagttgcacaaagaacgtgccgaggttcgcgagaaactgctggcccgcagaaatcgcctgagagccgagctgcgcggcccacagcaccacgaacgtgatgccataggcgagccagtaggctatcgtcgccggaagattcgtgaggaagttcgctatgttcgagacgaactgctgtcccgcctgcaacgccgactggccgaagctcaccgcccacgtgccaatcgacgtaatcaggttcgacaacgccgtcccgatcgcggaaggcagttgctggaaccattgaatgacagactggatcgcgttcgggattgtctgcgtgaagaagttggcgatgttctggccgagactcgtgacgaacgaaaccaccgactgccatgcggaggagaggaacgaggtgaacgaggcccacgccttgcggcccgtctcggtctgcgtgaagaaccagacgagcgcggccacgagcgcgcctatcgcggtgacaacgagaacaattgggtttgcgttcattgccgcgttgagaacccattgtccggctgcggcgatcttcgccgccacgtcgaacgatttcaatgcggtgacggctgcggatatgaggctcgccgtcttgaacgctgcgaaaccacctgcgatgccagcgatgacggttcgtatcgcatcgccgtgttcgctcgcccaatcaccgaccgactgcaaggcggagccgagggatttgaccaacggcgcggcggcgttgaaggcgtcgcccacaagctggccgatggaggctgcgacgccaccgttctgaccgaccgcaaggaaaccggttactgcgtctgccaatccctgaccgagctgcgtgagccccttccagagttcgctgagcgacgcgaggaacgcctgcactccgccgctgtcggaaagcgtgccgatgaagatgctcacgttgcgggtaagcgtgatccaccagttgacgagaggtgagatgatgttgttcaatcccgtgaggaagttctgcaagcccccgccattcgtgacgacatcgagcagactcccgccgaacgcctgcgcgttcgacgccagacctttcagatacactccgagctggccgaaatcggactgccagatcgacacaagcggctgcgcggcctgcgccgccttgccgaaccagcctttcacgccggtgaccatgcccgccgccgcgtcgccgattttgccgaactgggagctgaaaccgttgatcgccccggcgatgttctccacgccgaccgcttcgatgaccttctgcacggccttggcgacacggttttgcacgttctccatggccgtgccgatgccctgagtcgcgtccttggcctgctgggcgaacgaggcgtatttgccgaaaccgttctggttcagttccatgaccttcttgttgaaatcatcgaaactgattgacccgtttttcatggcctcatacaggtcgtttgagttcttccctgtgcccagcatggcctcggcgacctgattgagctggccgggcatcgcggcctgaatcgaacgccatgcctgcatatcgaccttgccggcgctcagcatctgcgtgtactgggtgagcgcgttctcctgctccatggtcgaagcgccgcccgcaagcatcgcattgttgaacgcgagggcgatgttcgtggcctcgtcaagattcgaggtcaacggtgcaagctgctgcaccatgccggtcatggccgagctcgtggtcggcagaccgtccaaggcgttcgaaatcttcttgatggatgcggccgcgtcctgcgaactgtacccgaggttcttcatgaccttcgggaagttgttcatctggtcggcgcggctgaccgcgtttccgatgctgcctgagatgacgctcatggccttggtcgtgacggcagcagctgcaccgatgatgccgcctttggcgagcaggccggatgcgaaacccttgccggcattcacgccgcccttgcttcccgcgttctgggatacgtcgccgaacgccttttcgatggccttgccgacgccttccatcgaggggacgatgggcacgaatgcggtggcgagattatatgtcattgtttcgccttcctctgtttggctatggttgtccggtctgcggccggttctccacacggttcacggtcgtgaaccgttggctcatgaatcggtcgagctgttcgacgctcatgcccaccgctttgatggtgcgcgttcgccgcaccgtgcccccgccctcgttgtgcggctcgggagcagtctcctgcttgacttcgggcttccccggccgtggcagcggacatggtcgcgggccacgttttttcggatcagtgttggcccacatccacaggttcatctgttcgatgcgcagcacggcgagatactggtcgaacgtccacgctcgcgccgtgttcaactcctgccagaccagcgaaccgtccggcagattcacggccaatagcgctacctgcattggcggcagatcatggatggcaagcccgtactcccctctcatgtccgccgccagttggtttgggcagcggacgagcaggagcacgagcgtcatgagtttgggaaagccttgcccatctcctcgaacagttcgttcaggaaggctcccatggtttcgccgtcgatacgaccgtcagcgcctcgtaattcgttcttggccttgccgtatgagtcgccgagaagtcggcgcaggaacgggatgatctgcaaggcgttgcccttcgggtcggcctgaaggtcatagagagattccacgaactcccaatcgtccagcaccttcgggtcgatggtcagggagatgcccttgacggtgacggtgcgcggcttgccctgcgcgggcctatgatcctgcggacggttgccggggacgttgttgctggcggtattaccgtaacgatgatgacggtttcgtgacataatgacttctccaaaaaaaccatggacgacttcgagggttgaaaaaatgagggttcccgcgtcacggggaagtcgtcgaacgcatgacgcgggaagaaccgttattcggcggcctgggtcccttcgccggtttcggcggtctcgtcgccgttgaccggatcaatgaccttgccgaccagggcctcggtggcggcaatgctacgggacgcggcgatgccgatgtattcgatggcggtgacgccgttgcccatgtcgttggcggagacggtgatgtcgtacacctgcgggtcgccggcatgcacctgacggtcgccgaactcggcgcgggtcgcgttgccgatcacgagacgatccttcacatctccgctcatcgcgatctcgaacaccaaaacgaagtcctcgtcggagggcatctggtgtttgatggtcatgctcttgtcgttgccggtgaccgcgtccgagttatagcggagcttcgcggcctcggctcgcagcacttcgagcagggcgaactggtaggactcggcgtagctggtgatgatcttcatcacggtggcaccgttcgcgtccttgatctcggcggtgtcggtgtcggtcgtgttggtcaggccgtcctcggacaggtagccgagcagcttgtactcggcgggcagtgcggtggcggagtcggtgggcagtgtggtgccggcgggtgcccagtaggcgtagccgccgaccttgaacttgcccaacgacaccatggtggaatcgttggttgtggaattaaccatgatttacagcctttctaatcgtctgatttgataatcaactggagaatgatttggtaacggggccgcccgtcgagcatggggaaatgcgtgcgcccggtgatgtcgatatcggcgacctcgggcagttcgacgatacgtttgaggcgggggagtatgagtttcgccgcagcctcggagaccagccagcgcgactcgccccacacctgcaccgcgataagcggcagactgcggaacggttcgtccgagcctcccacctgttcgacggtgacgaacggtatcggatgcgtggcgctggactcggccggcacatcgaacatcgccggatattcggccctgatcgtcgtgtccgcgttgagccagtccatgacgagtttctccgcgttcactgccatcagccaccgcctcccatagccttgacgagcgtgttatgcacggcattatcgatgagcgcggcggtgttctccgtgtgcacgagcgcggtggctcccttggggttggcatgagggcccaacgccgtgtacaggggctggcccgcgtgtgtgggcgagcccatggcgttcgccctcgccgcgagcttccgagcctcgctgacggcggccttggaaccctcgttacgccggtatgactgaaacgccgaataatggagtttcactcgtttcatgcctatcccttcgtgtcggtgacttcgatcgtgaggttccatgcggtgggtttcatgccaccgtctaatggcctcgggtctccgatcaccttgtagtcatgctcgtcgatgcgtatgctcgccccgcgcaggctccggtatgcgtagctgcgcgggaacaggcacgtgaacgccacggtcactccgtcagggcgcagcgaatcggttgcattcgacatggcacccggcgagacgagcacgttgcccaccgattcgatatcgtccttcgtgacgggcgagccgcccgggtcggtctcgccggtgggcgtgtagcgcaccactgtcacggtctcgcccctcatgacgcctccccgttcgacaggtcgatgctgtagaagcgttggccggtgagcccaagcgccttcttctgtcccttggacagatagaattcgccgcgaggattcgagaaggtcatcgactgggtgaaactgcccgccgtgagactgagattgctggcaccggtcgtatcgaaaccggcgccctcggtctgcatgtcggacgagatcacatccttggcgagctcgcaggcgatgcgttcaagcgtcgcccgcgatatgttccgccaatcggggcactgttcgcggatgaactgcgatgcgtcggccagacgctggtcaacataatctgggtcgtccggcatctgcttccagcgtttggccaattccaaatgcgtggcaaatgggttttcttccgtttcgtcggccatgacggcctccttaatgtcaggatgcgatgatgccgaagccgcgtgctacggccagcagcttcagtcccatggccatcactatgcggccactgcggagggcggcgcgatgacgtatgccgggaagcgcttcgacttgtcgggctgcacgtcgttgatggggttggcgatctggaagccgacgcggaacacgacgcgcatggcgacgcagtcctgctgcgcgaggttcagaatcaccttgccgttatcgtccgagataaccgactggtcgagcagcttgtaggtgatgtcctgacggatgccgaccacgaagttcgaccagtccgcgccgagcagcacggccttggtggcatcccacgcgccgttgtcaacctcgttgagaccgaaaccgtacagggtggacggcgctccggcggcgagcgagggcacgtagatcggggtgccgttggcgttgcgcaggccgataagctcccagttcaggcccggcttgctggcgaagccgttcatggcgaagccctgttcggcgagcttctggcccatgctggcaacgtccttggcgaggtccttgccctgggtgagcgtgttgtgcgccgcgatggcctgcgggatgatgccgtcagggaagctggaaggcttgtccacgccgaacagtgtcgcctgatccagcttgtagccgagcgcggaagccagacgcggcatgacctccggccagatggggatgccagaatccgcgatgacggcctccgggatgggcacgatggccgcaagctcctcggccgtgatgcttaggcccgaccatttcatcttcgtggtctgcttcaggccggtatcgccgccaacccagtaggcgatcggcttggagtcaagcaccggctgcgtgcgcgtgcgggtgctcatgcggatctgacgcatgcgggtgagggacacactcgacttgggggcgtcctggataatctgggtggcgtattcggtggggatgagtccgccgccgaggtcgccgctggtgatgatggagttcacggtggaagccatcgtcataccttctttctatggagtggggaggttatttctgcttttgtttgaggaactggtcacggatccagtcgccggatgtgccggatggtgcgggcggctggttggattcggaggaggcgtgcaccgtgggcttggttttgtcggcgatgtagtcggcgagcgccttgccgttggcctgcatttcttcgagcgtggagccgtggagcagtgcgatgggcacgccggtttccttggagacctgcgtcttccattcgttctgctgtttttccgcctcgtaggcggcgttcttggcttcaagctctttgatgtgcttggcggtcttttcggcttcggacagttgggcctccttgagctgttgcagttcgtcggcggctgccttgttgtccttggcgcgtttctcccattcgcgggaatgggcgacggcctcccggtatttggcctcgtaatcgatttcgggcggcttcgctccgttctcggtcgatgccgcctgctggttgccgttggcctcttcggtcatggttcctcctagtgggttgggcccgtttcgggcataaaaaaccacccgtgcgggtggttggggaaaatctcagttcgagtgcgacggtcgtggcaccccgtagccgtccttgtaacggtcggggtagagtcggcgcatcacataggtgatcgtgttcgggtcgttgggattgtcggggttgccttttgtggtggcctttatcatccgataggtgtcgtcgtccaggccgccgttctcgatgaggctgcgggcgtgcgtgtattccgagtacatgcggtcggggtcatagccctcgatgtgggcttggttcctgtcccattcgggtacgatctggcagtcgcagtcgtcgtgaaacaggctgaacgagcctttggcgtattttgcggttttctcgctgcggtacacccagccgcgcgagcagagcatcgtgcagaacgcgcacgtcttcgcgcctctcggcacgcgcgcgtaccggggttcggacgggtcgtgctcgcacaggcgggcgatggtttcgcgccccgaatacatgacccagcgttgcatcgcaccgacaagatacgcctgcatggtctgcgggtcggtccacaggtggccggcctgccagcgtatcgtcttgtcgatgccgtcgccggggaaagaatcggataggtcgtactcccatgattcgggcaccgattcgccacggacgcgcatataccattcgtaggcggcctgtgccgcgaggtcgccgtatttggcgaccagttgcggcacgtagtcgagtagcatgtcacgttgccattcaggactgagctgttgcagcgtcccccacagtttcgccagatcgcggcgcgccagttccaccgctctggcttggctggcttgcagctggtccagttgtcggttgtccgtcatccttgttgcctccgttcacgagggagtcaagcacgctgcgggtctcggccttgcgcttgtcgaccaacaggcgtgtgatgtcggaatccgtgtagccgagcttctccagaataacgtcggagttggcgagccacggcatggccgtcacctgcttcacgatggcatcggagagcgcggcctgcgatgggcgttcggggtcacgccagttgacctgcaagcggtcgagctcgtcgctgtcctcgctggtgccgttgagtatggcgatgtccctcgcggccttgcgtagttgcactccgatggcgcggcaggcgttcttcgcctcgatgacaagttcgctttccgccgccatgatcgcgtcggacgaggaagggccggaatccgtcatgacgccgaactggctgagcggcacgccggtcgcgccgctcatgcgtgccgcgagtgcgcgaagcatgtcggtgtgcggctgcatggtcatctgcgtgaactggccgatggcgggtgcctggccgtcctcgttgaggctgatgttgagcatcttcgagatggtggcttcccagccggtcagcttcttgccgttcttgtcctcgggcggctcgtccgcgccgatgaggtagcgttgcgggctcgaatagaattcggcgcttacctccatgcgcagcatggtgcgaaccgccgtgtcggtgatgctcatgacctcgcggctgatgcgcgagcggccaaagggacggttcaggtcctgatggtaggggatcaggtaaacgggcacatgatccatgtacgtgttccggggagcgtccgcatgatagcggcctgattgcgtgcggcgtatacgaatcgtgtagccgggcatgtagagcatgagttcggaaggcacgatggtgttcgcctgcgcgtactgggagcggtcgatatcggttatcgacaacgccgccgacaggccgcgacgggcgtaatcccacaggccggtctcatagagcgcgctgcggaacgacacggacaccttggaacgcagaccgtcttccggttccgcgctgcgcacattcaggaacgagcatgagtgagtgagcgcgctgcggatggcctgcggcaattccacgtcgaagtcgttgtctgaaagaatcgaatccaaacccaacggatcgcggctgtcgtcgccgactccgacgaaaccatcgaacacgatgcggtcggccaaagcgtccaccgatttctgcggccagcccacgacctcgcttatccccgccatgctgtccggcacagcgatggacagattcttaagctcgtttcgcccgtcgtagtatttggtgcgcaacaggttacgttcgagcttctgggaccattgacgtatcatcaaatcccacggttctcggcactcgtcgggcagattatcgacctgcacgttttcaagactgggaatctgcatcagaatgccaccgccttcgctcttcttcccggatgacgcttggaagtcttgacgttccaatacgcgagagccaccgcttccacgggactcacatcgacgttctccatggacgtctcgtagccgaacccgtctccgattttcctatgcttcgcatgacccaccgcctcgtcaagcagaggctggccgaaatgggtgagcccatggtcgttcacggcctgttcgagcatcgaacaagcgtccgccacgtcggaagggcgcggaaccacgatcactcttttggacacgcccttgtctatgaggctgttgaccagagtgggcgctcccacgcgcccgtcgacgatgatgccgatggccttgcgccaccgttccgcaccgtccttctcggcggtcagccaatcggccagccaaccggtgccgccgcgcatgctgcgcgaggcgatgacctccacgtgcggcaattcacccgacttgcggggcgggcgcacgcacgccacgagagtgacgttcgcgccgtccgcgctgaacttgaccgcatacgagttgtagccatccatgcaggggttgtcggtcttgcacttggcccactcgtcaacatcgatatcggacagcgcgccggcctgatcgttccaccagccgagacgctcgcgggcgaaaccgtccggcgtcatcttctccgattcggaaacgaccacgctcttcagcagtcgggtgccgagcgatggattgtattggtaccagcgttgctggtcgtgcacgtcgcctatctcgtccgccgcccattcgaaccagcacaggttcttcggcggcttgtccctgtgcgcgttgcggcgcatgcgcgcgaacaccgtgcccggcgaggtcggcggtgtcggcgttcccgtgtagatggtcaacggattgcccgagggtgccgacgagatggcgggctgtatggcctccatctgctcgtcggtcagctcctgcgcctcgtcgcacaccagcacgtccaccgtgaaaccacggcccgaactcttcgaacgggcgatgaactcaatactgccaccgttcttcaacacgatggcctcctggccgttcgtggcccgaatgtaggtgaccagttccgccagttcggggaactttcgcgcgttctcgaagtagtacttcatgcgcaggaaatgcttgcggcaggtcttcacctcatgcgccgtatgcagaatcttcatgccgaggatcgcggagagataaagctccgtgaactcgagaatcgcgttcttgccgttctggcgcggcaccgcgcacccgcaatccgacgccgcccattgcagcttcgaatccgtggcgagccacccctcgagcacgatgcgctgccacttatccggcttcatgtcgtagccggctgcgagcgcgcacgcctcgcctccctcggactgcgcgtgcttgggaaccagagcgaagctaggttcctgtacgcctcttcgccttgccaccctgaatcaccctcagcttccgtcgttcggctatctcatcgagcggcgtatgccgctcctgcttctgggctttcgccggcatgatctggctgcgtgcggctggcgtgatgccgtaatcctgcagcagcttgttcagtatgggcacgctggcgaaattgccggaaccccagatgtccgcgtggatcagtgcggcgttcatgaggttgtcccagtcggcctccgtccacgaatccgcgccgggggtggaagccaaatgctcccaccatcgcacggtcgcctccggccactcgatgccgtcaggcaactgtggctgcgttatcgtggtcttggccaactggatcacctcgaatcaatgtctaggagccgctggagcgactcgcgcgagcggaaccggcggcacgagagaaatcaaactcgccctgcacgtatctcggacgcatgacaaccacctccatcgggaaaatcaggagccggacgaacgcgagccgccgcgagaaaaagcgctgcggatacgaccgtccccattacgcaccgcattgccggcacgctggaacaggttacgcacgatccacctcctctccagtaacgatgtggacaagaaaaatcgggatctaccgtttccagcctgcactgcggtatctgttccattcgtcgttgaaccgcttgtcgaacgcccggtctcggcgtgcctgggcgttcttccatgactgagaaacgccggcttcaagatcgttgactccctgttccttgcgtttcttcatcaacgcgcgcatcttgagggtatcctgccatatcttcgagatacgttcatcggagaaaccctgtttgcggtattcggatattcgctctttcgagaagccgacgccggaaagcgttgagcccttcgagcgtgagcgggatgagttgccgccgctcccgctgctggacgagcgggaagccgaagaagagccgcgtcgcatgagaacctcctaatgaaaaagccgccccatagggacggcttgaacgaaaaaaatactgtttaccggttcacgatccgctcgatcgcgacgcggaacgggacgcactcacacgcagggcggacacaccgccaccggatgaaccggaagagcgacgcccataccccgtatagcggatatcgttggtgctcgcgtaacggactcgcctcataactcacctcccagcttccgagctacggccataccatcgaggtatttatctccgagtttgcgaagaccatactcggcaaggaaagaatccttgtcgtctcgcaaggggaacgcgatggcgaaccagtgttcggaatcggtcggctccacgagcttcctgggactgcgagcctcgaccagcgccctgtgcagggcggcgaactcggcgagacaatccttttccagatcatcggagtacttgacatcggcgagcgggtcaggcgtcttctccgcgaacccgaggccaccaccgaagccgacgccggcaccgaacgccacggcggacgacttggccggcctgtacggggcgagtagcttctcgatatcacggtacgcatagatccggtggttttcgccgaagccaaaccgttcacgccaccgcgccatctcaacgggggaggggaaacagaggcacagccagaactcggtgtcggtcgcatccacgaaacgcttgcgctccgcacgggcgcgctcccggtactccttcgcgttctcgtccagattttccggcaccggcttcacagccttcttgcccttgggcttcttggaaaagtcgaatcggaaatcacctgacatgatccacctccaacaggggaaaccattcaagcagcgtcgcgtaatcggctggcgccttgtccttgagcaccttggtgaacctcttatcgatgccgtcgaacgaacgcccgaaccacgcataatcacacggcagctcgatatgatgcccgctgatgcagtccagcacctcgcccttgagccaatccccgataggagagaccttcttgagattgcgccgccagtacccgtactggacgaacgcgccacgacgctgaatcgaatctgcggcacgcacgccatccgcacaccacgtgttcttgtccaagccgatgtcggcgcggatgaaatcccacatctgctcatacgacggctcaggcaaacgcgccgcctcgatatatcgcagccgttcgggagcctggaacaccgcattgttcagccaacggtacagcgacgggtgcggataccttttgattctggtctggaacttctgctcgaaataatcaagctcctcgtccacgaacctcaaaccgggcacatagtacaggtacgcgggaacgacctcgatgcccatatcccgcatcgccagccacgcggctatggaatccttgccgcacgaaaacgccaacaacacgggcctgccatcagcggccagcttctcacgcaccgccagactcgtaccctgattgcggataaccgtggtcacttcggccacctccttcccgtcatgcgaataaaccgcgaacgcgaataaaactcaacaccggcacgccggaaactcgactccgacgaacggacgaacacatgcaacccatgtccgctggtcgaaacctccgcatagatcgcatccggcaacagctccaacgccttatcgggcggactggtcaaatcaacatggtcgaaatcccagcacgcaagcccatcgccgagcattatgccataaccgtcaccggccctcgagcgcatgatctccgaatatgacgcccaggtacttgagtcagtcgaactggccggcgacccatcgcaccggatcgggcgcttaccgatggcgcgcacccaacggtgcagtgccctgagcgcttggggtatctgatgtttgcggctccacgccttgcggcacctgtccgagcaaaacagtctcggacgcctagggttcggtgtggattggaagaaatggccgcaattcctacattgattgaccatagccataactatagcatatattccaatgattcgcaacaccaatttcgtgacatatcaaaaccgcggagaatcaaacgtaacagcctcggaaaacaacggggcaaaaacatcaaaaccatgccggaacggcttccacgggcgctcgcagacaccccagcggccaaacgtacgaactccacgcgggttgcggggggatgcgggcgctatgttctgtggggagccttgcatgggagggggagggtatggcccccggttaccattggcggctgattgggatggtgttttgtggttgtttttttgtgttttggtggcctgtggtgttggcgattattttgttgctttttctttggttgcagattctgtgtgtgagttgtgtgttgtcatagctggttggtgatccgcctcggctgtatgggatgatctcatcgagttcgcagctgagtgggtgtggtgttttgagtgtgaggtctatgggtttgccgcacagcgggcagatcggtattggtccttcggttgcgatgtgtctggccttgcatttgcggcgggctgctccattttggtatcggcctgagcctgccttgttgctcatgttcccatcctgtgtgtttggtggcttgggcgagattctagttcgcggaccggttgtcgtgtttgcgggtcgccgtgctgtctcggcatggccggctggtcctctgcggtacgcaagccgtggcatgcgcggttggcttcgatccaacgacctgcggttttggagaccgccgctctaccggctgagctacgcgcataggtgggtatggtaaagcccctgagatgtatgtcccagaggctttcgcacttatcctgatacggagtataccacggggtggcaacagcctactgccggctggaatatgccattgccatgctgactatctccctgatgctgaattcgtagtatccgtcttccactggcttgctgctggggagtttgccacggcgtatccacatgatgattactttgcggctgacctcgtatccgtagttctcacgcagccattcgctcatgcccgcaggtgtcttcgtgagatggattgcctcggccttgtcgcggctctgctcgcgcagctcggccacgtcgatgacggccccgcatttgcagagtctcagcgtctcgcccttcgcggcggtcacctcgcgtccgcattcggggcatacgccgattatcctgcgtgtgcgcggcttgcggtcgatgagcggttcgatgcgctcgcaggcgtgggtgagccatgtcagccaatgtcccgagcggctggcgcggcataggtcgggcagtcgtcgtggagcgtccctgagcagggtctgccatctcggacggctttccacgccggtttcgttccacatgtcctgcaggccgtcctcggtctggtcgagcatgtcctgcgcgtggaggttgatgggcgcgggtgccgcgcctccttgcggtttgccgcccgctccgggttcgccgagcttgtactcatgccgcgcgacccgctgcaatagttgcatgttgcggcgcagctggtggagtgttttcgcgtactgtcgtcggcagtcccggcagagcgtccacggtgcctcgacctgctggctgccgcagtgttggcatggttcggtttggatgatcattgtttgaagccctccacgttaagctatgattggtgcttggtgagcgtgccctccgccattttggtggagggcttcgttttatttggtattgcgggtcattgctcgaacaatggaggttcgatgaattcgaccttgcgcggcggcttcggacgaccgtcgccctcgcggatgatcgcacgcacttcctccaacggaaggcccaattgacgggccgtttccgttgcgctgtagccgcgcttatgccatacgagcactttgtcccgtgttgtctgactcgtcactgcacgcctcccgccattgggtcgataagctggcagctcatggcgtcgatgcgcccatcggtcttggcctcgatgcacaggcgtttgatgtcgcccgtggtctcaattttttgcacgatggtctgctccggctggtcgggtgtctgcacggaagcccagcagacgaagcagatggccgtcaggccggacaccactaacaggatcacagtagcgagcatcgctaacccgacgaaattctccaacgtccagtccttgaatggtttcctcatgattcctccttgagcgtggcgacatattcgatggccttgcgctcacgtttcgcgtatttctcgcatttgcgcttgagacgtttgaggctcatggcgtacaggcggcctcggaagtcgccgtcctcgcggatttcggcctcgtaccggcttatggttgatgccatgaattgcgcggtcagatggtttgtaagctgaatctcgttcatgcgttttccttccggtaggggttgttgtccttgtacacgtgttccgcctcactgctgatgatgctcataggcggcctcgttcctggttgtggacgaggcagtcgccgggatcatcctggcgtgcgtacacggtgccttcccggtcgccgtccggcgcggtcaggtcgatgggactgtcttcgtcgtggacgttcccccgctaccgggcatggccgtgttcgcggctcatgagcgtcagggatgcgccgtcgccaaggctggcttccagtaggctcatatatctgacgtcttcgccgtcccggatcacgcactcctcgcgcccgtcgtccatcatgccgaccatgaggaggggcagtcccgtcccatcggggcgataatgctcgtcgtcgcgtatgatctcgaacgggcgggatgcgccttcgccgccggtcgggttctcccacgtgatccaacccttgtcgccgacgcgcggcgaatccgggccgtaccacccttcgtcatggcggtcatcgtactggaaccggtcgagtagttggtgttccagttgttcgtcaagtgctttcatttttttattccttccgttgggatggtttcaccggtgtggctccatgtattcgagcccgtgatagtgggattcgtgtgcgtaccgttcgttgatcggggtgttgaggatacggtccacgtccaaggtcacgttctcccgttccgtcaggtcaaggtattcgcgcagccggtcgcccgcatccttggtcgtgtagaggcatttcgcgggcgtatgtgcgtagtcgtagatggcggccatcacgcgcctcccagcatcgagccgagcgaggccatgccgggtcgcgaggctcccgcgaaacggctgaccgtggaacgcttcttcggtttggcggcgggcagaccgagcgtgctccgctgggtgagcgccgtctgctgcgactgctccgggccgttgccgagcatccgctggcggcggtacatccacgactcgtcctcggataggcccagcctctcgcactcacggccgatctgcgcctccgagggcttcgactcgttgcgcatccggcgcaccatcgcgttcacatcgcccgaaccgcaccagcggcccgaatcgttcgccgcgtagaagcgcttcaccgcctccaacgcctctcccagcgtcatgtccgctcgaagctccgagtggaacgcttcaagctggatgtcgtcccattgggcgttgccgtgatgcgagttgatgagcgacaggatcgccgccgcctcacccttgctgagcattgtttcctccttgggttcgctggtattccgccctctcggcgggggtcatgtactgccacgtgcgcgccatgttcgcttcaaggttctgctgcgaacggggtttcgccgatggcgaggggcgtgcggtcggctcgggtttcgccggcagcgggtcgtcgtcccaatgctcgccgtccagccagttggccggggtgagcgtgtagccgggctcccggttcgggtccgccgcgtactgggcggctttcgagatcaggaacgtgttgttggttttccgtcgcgccttgcgccaagcctcgaaggccttgcgtttgccgttcttgcgcggataggtttcccagaactgctcgaacccgagcggataatcctcgtcggcgctctctgcggccccctcggcttgcgagggggtttgggggagagagaattcttcgtcagaagaattcttttggttcttggttcttggttcttggttaaaagacatgggcgtgacagactcattgtcacggcgtgacatgggcgtgacagactcattgtcggagtcggtcacggtcttgttcgcgtcgcgttcgcgcttgcggcgctggcgttccttcaccttctccttcgcctgctcgatctgctccgcgctgttctggtacttcagatagttgcggatcacgtaacagccctcgtcgctgcctctgagcagcagcccggaggcagcgaggtcggagacgtcctcgtccgaggcgttgaggacatacagcagctcatcctccgcgatgatgccgtcggaggcgtggtcggagcaccagctgatggccatgacgtacaggagcgcagcagacgggttgcgtcggcgcagtttgagcacgtccctgtcctgccagaagtcattgctcagtctcgcgtaaccggccatgtcagctcctccctcctagatatgcgatgagtatggcggcgatccagaagtaccgccgccaatgtgtgttggcggtcactcggaaagccccaacgggagtccgcagttcagcaggagcgcgaaccgttcgagcggcatccacacgagcgtcggattgttgggcaccggtttcgactcgcggcgcaggcgcacggcgaaaagcgcgttctcctcgctcagctccgaaaacacggcgaggaaccgttcgagcacgtccacgctcagaatcgccatctggcttgccatgcccctgaggctcttcacgcccacgcccttgcgatgctggacgagcaccccgtagggagtgtccatgttcgccatctccaccagcagttcgcgccagtgtttgcggtagttcggctgtttcgtgtccttgcattccacgcacaccggctcgccacagaaccggacgccgatcagatcgccctggtcggcgttgccatgcaacggcatgcggtcgatgcgcgtgtcctgcaaagcccacgcgaggtaacgcaccgtccacgtctcaaggctcgtgccctttttcttggcggggttaaccattctgctcaccgtcctcgtgtgcggcttcgatggcgatggtctcgaagttcggctgctcggtggggaacatgcttttgagcgtgtccatcgtctccgcgatggagaactcggaactgcatgagatgtggtcgcccatcgtgtactcgaaacgctggccgcagacacggcaccagcgcggcaacgggttccgtttcagcagctgctgcgtctccctcaggtcggtggtgccttcctgagcccatacgggtttcttgcagcgcgggcacagcgaccagggggggcgtttcacgaccggtttggccggcgcgaacagcttcttcatggccttctccgtggaaccgaacaccaagggccacgagtccatgatctgctgatatcgttcctccggccggtcctcgaaatcatcacggaaccggttgaattcctcgatgccgcggaagatatggctcgaggcgagccacagcagggtcacggccacgtagtcggggtaatagcggttaggttgcacgctgacgcgcacggtggtgtcgtaggagagtcccgcctccgcgtccaacgcgctgtaggacacctccatcgagtgtgcgagcgtaatcaattggtctttttcagcgttcaatgtgatactcctcttcggcttcctcttcgcattctgggcatggaatcggccgtgccgggtacagcgtgcagccgtgcttcgggcagaccggttccacgtccgtcggcgtctcatcgtgatacaggtgcaacatggtcagaactccgggtcgccgccgccgttgccccacgggtcggaggctggtggctgcgacggctggtatccgccctgcggctgctggccgtaaccaccctgagcgccgtaaccctgagactgcccgccgttcttatagcgcacgttcgtgatggcgacggcgctggcgttgacgttgcaggacgcggccaattcgccctgcttggtctggtagccgttgaaaccgttgacctcgcccacgatggtcacatccacgaactggtcctgattctgacgcaactgcgctatctggtcaaacacgggattgaggttcgcgtaacccgcaggccacaccgaatagttctgctccggctggctgacccagttgccgttccggtcacgatagcccggcgatacagagacgcgcagaaaccttttcccattcttcgtctcctgcacgccccacgccgtgccctggatgatgatgctcgtcctgcccgccatggtcactcgccttccttcacgctggccttcaactggcccagcaccttgtcaagctccgcttcggtcagctcgtcgctggctttcacttcacggtccagaaccttcgagatggtctcgcacgcctccgcgtccgaagccacgcccagaccctgaaaacggcgaatcatctcagaacgcttcacatccacggaagacggctccggctgcgcttccggctgctgcggtgccggagcctgcggctgttcttcctcctgtgcgggttccacgtcgatggcgggtgtcatggcatcgtcgatggctggtgccagcacgtcggaatagtccggcgtggtctcgtccaccgtcgcggcggtcttggtctccacgctgaccggaaggtacttgaagctgcggcggataagcgtcttcatgcccatctccacgaagttcgtggcccacgggccggttaccgcgttgcccttgtacttgctgcgtggcgcgtaacggtcgcggtacgcctccaagtccttgcggctcatgtagctcgcgtatgtgttgccgttcggaaggtcgatggagaggaacacgaacttgagcttgtcgggggagtgatcggcgtcgaggttgatgtcttcggggcattcgatgtacggcgtgcccttcgcgtccatcttcagcttcacaccgtcgtcctcgtacacggccaccggctgcgcgtagatgccgctgttctccagcagcttcaacatgcctttataaccgatgacgaacgtggcgtccggctggcctcccttgtggttcttgttgccataggggaggatgaaggcttggccgaggccgtccacgttcgagggtttcaggccgagcgcggcgcactgcatgaagcagctcaacacgctgaccggcgtgcagttgcgcagttgaggttcgcggttgatggagctgatgcagtattgcagcagcatgtcgggcttgaggttaccgccgatgaccttctcgatctgcggccatgcgctgcgcaccatgtctcggatatcacgttcggggttcatggcctgcatctgcacgttctgcgcctgtgttgcgagttgtcccataatcggttctccttacttggttttcttcggtttgatttcggtaaatcggaaggtgcggccctcccatggctggaccacgcgcgtgtagcccttgcgggtcgagtgcttgtaggtggcttgcatgttcccgcagcgcaccccctcgtggtctccgatgtaggtgaggatgcagtcctgcaactcctccttgcgttgtttcagtgcgttgaggtcgctggtcacctgcctgtagtcggccatgagctcgcgcagatcagtgctgtcgctcatgtcctcgatgccctccgaaggctccgggtaggctttggccacgtccacgccggtgagcgctggcatttcgtctcgggcgacgaaaccccagaagtcctcggcggctttgattacagcgtgaatgtcgtcctcgtcgcgctcgaagcgcacctcgaccggctccgcctcgccgatgtccgcgtagaaatacccccagcggaagccggtgaccgccatgtaatgcgtgacctgagccatgtagtagtcgggggcgatgagctcgccctcgtcgttgtgccagtcggtgcggccacggttcgcgttcgccgtcttgatctcgaggatgccccacgaatcgctcgcctcgtcgtagatgaagccatccagcgaggcgtgcatgaccgggtgggcgtcagacacgaggctgatgtcggtgccgtcgatgacctggaactccgggtggagctggcggaagcggcggcgcagttcgacctcaagcgcgttgcccttgatgatcgcccacctgccgctgatgtcctccggctcctgacggccagtcttctccaaccacaattcgtagggcgtcttgtaggtgttgaagccgaggatggtgctcatatccgacccgccgacgccctcggtgcggaaggagagccacgcctgatggcggctctccttcgtggtgcccgccccgccgaagcgcctgattgagaacatgtcggtgctttcgcgggccttgtcgatggtcatgcggctcatagctgatcgcctcccgtccgcgtggcggcgagcgcgagcaccggctccatggcgcgcaatgcgtggccggcggccgcgtgtatctgcgtgcatggcgtgccctgctgcccctgcctgaccatggacgcctcgacctgcaggagcgcgtcggccgcatcgcgcaggatgcgcagccagcggggtgcgagcagcctgatctcgtcggtgtcgagcagcgacttcacgccgggttcgatgctcacgccgctctggagcgacgcgatgaacaggaggttgttgagggactgcgcgtccggcttcgccgtgagcgagtccagcccgtacagcagctgctcgctgagtcgtcgcatcgccatcatccagtcgtcggcgtcgccgaaatcgttggattcatcggtgctgttctggttcatcgttgacctccgtaaagatattcggcgcggctgcaccggttgcgtttgtccgcgtcctccacgtcctcgcgccgccagccgatgacgcggccgttcttccggaccggctccggataggggctgggacgctccccggagctccacttgtagaccgtcgaacggctgtagccggtatgctcggcgagctgcctgaccgtgaccagtcccggcagcgcatttgaaaccgctgtgcccatggcgtatcctttctcttgggtattcctttcggacagttcccgtgccagcggggactgtcttttttttcggctgaaaccttgtggtttcgtggacggcccggaatcgaaccgggtcccggcctttgccccgcgtcatgacccgcgtgatctcgtccgggggctacctgcgccgccccatgatgccgcgccggataggttcgaccccgcaggggtcccggcgcgacaccggtttgagaactcttcagttatggttatttggttttaacgactgacctttgtcgccggccgcgcgtcggaagatgaagaagaaacgacgcccggccaagacctattcgcgctcggagtcctccgggaacagccacggggcatcgctcgcggcgagcatcagcagcggcgcgaaagcgcacaccccgcccacggcgagcagcagcaccgccacgaccgccccaatcgggcgggagcacccgtcatgcgagaggatccacgcgagcgccgcgatgacgagcgcgagacccgccgtgcaggatgccagcagacagagcaccggataacggtcgaggaaacgtcgggtggcggggcgaacaccggggccggcaacgggtgcccccatcgctgtaccggaccccgccgcccgacggggcttgatatgctggccgtgaaggtcatcggctctcattggacgcctcccttgtctcgcgcagggcgcggttgatctcctgcttgatggattgcaagccgcccttggtgaccctgaccgccgtgtgcccgtcgagggtgaccgcgaagaggcacgggtagccggccgactccacttgcggggtgcgcgtgaccgtgaactctcggccgtcgttgtcggtgagccgtgtcatcacgccactttcttatcggcgagcgcggcgtttttttccgcacgctcaagaactttgtggggagaaatccctagggattgcgcgatgttgacgaactccgtgaggcgcatgtctccagagcggaacttgacattcacggtttgcctcgactttccaatgacctgcccgatgtccgcctgaggcacctcggctgcgcgagcctcgcgcctcagtccatcgactgccatctcagcgattctgtttgaatttacggtcatgcttaacagtgtacgaatttgcggacatctgtcaagtatgaatttacggcgtgtcgcaaaattcggacatttaacattgaggcatggcaagaacagcgagaatatggagcgatatagatgtcgcaatgattgacttcttcgcagagaagaaggccgacgagggcaacccatcgttgcgtgttctcgcggcaaggctcgggatgaaacatacccgcgtcggggacctgttcaacaagacgaacggtactccaaccttgcaggaattcatcgacttatgcctaggctttaatgtcaagccgtcaaatgttttggacgaggtgattgctaaagccgcgcgggcccgagctgaacgcaccgccgatgaggtggctgaccgaatcgccgccaatcctgatgatttcgacgtggccgcaagcatcgatccgcacaagcgggacgaagcgaacacccctcgagaataaggacaggaccaatggcctcactcaagaaaaccgtgcaggaaacactgagcatcaacgggctcgacgtcgcgatacgcggcaacggggacgaaaacgactacatttcgctcaccgatctggcgcgcgaaaaggtcggaccggaaggcgacccgcgattcgcaatcggcaattggatgcgtctgaaagacaccatcgcgctgttgggcatctgggaaaagctcaacaacccggattttaaacgtgtcgaattcgacacgtttatgggtgaggccggacgcaacgccttcaccatgacgccaagccgatggataacggcaaccaacgccatcggcatccaatcccgccgcgggcgcaatggcggcacattcgctcacgtggacctcgccctcgacttcgccgcatggatcagtcccgaattccgactctacgtattccaggaatacaagcgactcaagaaggacgaatccagtcgcctcaacgccgaatggaacgaaaagcgattgttcgccgccatgaactaccgcgtccacaccgatgcgatcaaggacatgatgcctccacatctgtcccgcaacgaccaacgaatcagatacgcacaggaaggggacgtactcaacatcgccgtattcggccgaaccgcaagacaatggagagacgccaacccgaacgcaaaaggcaatatgcgcgactacgccagtatcacgcaaaacctcgtgctgtccaacctcgaaaaccttaacgccgaaatgattcgggacggcaagtccatccgggaacggatgctcaaactcaacgagatcgcacgtcgccagatggaactcttcaactcacatcctaccgtgcgaaaactcgaagccgaagagcaccaccatatagaaaaaccggaggtgaatgaaaacgacgacctacgctgatttgctaggggaagccgaactactgggtgtcgacgtccgcgagcgttcactaggcagcgatctcgccggctgctactacgaccccaatcgtctcatcatcatcgacgagacgctacccgacttcgcccggcgttgcacgctcgcccatgagctcgtgcatgcgagataccacgatcgaggctgcgacccgaacgggtcaaaagccgagaggagagcccggcgtgaaaccgcgctccgactcatcaacccgaccgaatacgcgatcgccgaacgcatgtacgaaggggatagctatctcatcgcccaagcgctcgacgtgaccgtacaggtcgtggaagattacaaggaaatgctgcacgatagtgtggccgtataaggaaggagaaaaagtgggattgttcagcagaaagacgccggaggaaaaagcccgagaaaaggccgagtttcaagcaagattacaggagcagatggccgaagcgaaggcgaaggcggaagccgatcgtgcgctcactcccctcaacgagcggattgcggagttcaccagcaaggaaacgaaggaaacgtatcagctgtacaggcgtgcgatcatctacaaaaaggggatgttaacgacagaggtgcatccactggacggtgtgaccgtacatctggagtccggcactgaactcgaagcccgcgtcaccgtcacccgcatactcctcgctgggccgttcgcatgggcgttcaaaaagaaaaaaggcggcgagcgatacatcaccgtggaggggccggatttcgcgatgataatggaagtgccacgcaagcagattaaagatgccatcaaattcgtagcgaaagtcaaagacgctgcggcgaaggcatcgtgattttatgaaaaatcgccccactgacggtgcaacgtcagcagggcgtgaagaaccgccagaccaccagagaaatggaaaggaggacgcttcgcctctcatcctacacggggcgaagcacacccgaaaatgctatttgcgtcagttgttttaaccgagtacgggattaggtgcctgttcaggtacgcagaaattaacatatgcggcatgagcgtcatcgccgtcgatagtgactctgaattggtagtcgccgggggaaagcggcatgccgttggcgaagtcgagcgtattcatcgaacgtccgccgatgtggttcttctgctcgagattcagcccggcgacactttcaacggtgacgatattggcgacacgaaccggctgaggaacaggccctgccatttcaacgacggctccggaagcgtcgcgcagcgaatattccacggtcatctcgcacgggcacaggctaccgggtatacgaatttcggcgaatacggaaaaacgggcggtaaggccggtcggagtcagtggtatgattccgccgcccacgccgacaaggttggccttgccgccattatccacattcgcgtaatcggcgatggtcagattgattacggcctgttcggatacgttactcataatctatgccaccatcatcttcggtgtcttcgtcacgacggacgcaacataggtggacaaaggcttctgaacgggcatattaacgcgcatcctgggatcgggattaaacagcacgatattgtcggaaagaatctcggccccatcgtcagtgtattcggtgatgctggtcggctgatggtcgttgaaatagaagtccacgccttcccacacgtttttgcgggtttcggcgaacgtgtcaccggcggcggagaatcccggcatgtcatcggattcggcccaccatacgccgtcttccctgtgataggtgacattcacctgtcgtgtatccatgttgcgcctcttcatttctgtccgaggatactacggatctcctcttcggataacccgacgtccttcaccagtgtcttcttcaccaatccaggcggaacagtctgtccgtcatggaaggcaaaagtcaacggtggacggccctccgccttcattcttttatgcgaaccattcgcgcggtcaatcccgtatcccagaccacgaaggatacggaacaggtccgaggccttcatcgatgggtagacgatcggcatgcgcgattgcctttcggttggttcaattcagcaacagtcctattaaatcacattaaaaccggttaaaacgtgaatcttccattattaagcaggtaataaaaatggcgaacgtcaccagatacaagaccagcagaggcgagacgcgctaccgcgtccgatacaggaagcccgacggcacgcaaaccgacaaacgtggcttcaaacgcaaatccgacgcggagaactgggcggcggaacacgtcacgctggcgaaggccacggggagctatgtcgacccgcaggcggggaaggccactgtggaatcgctctggccggcatgggtcgccgcgaaacgtgtcagatgcaaggcgagttacatcgagtcgctggagcgcgagtggcgatgccgagtggagcccatgtgggggagtcgcgaactggcatccgtcacgcgccgcgaggtgcaggaatgggtgaccgtcctgcatgagggcaggagagacccgagaggcgaggtcgtggccaagccggtgagcgcgaccgtgatattgcgggcgagcggcatactctcggggattatggagcaggccaaggatgaccgtctcatcgccgcgaatccatgcgagagggtggagaagccccggaaaaggagaaaggagcatcggtatctgagtctggatgagctgatgaggctggccgacgaatccgggtggaggaggccgatggtgctcacgctcggactgtgcgggatacgatggggtgagatggccgggctgcgtgtcggcgacgtggatctgcggcgtcatcgtctctgggtccgtcgcagcgccaccgaggtcagtcacaggatcgtcgaggacaccccgaaaagcgacgaatggaggcaggtggtcttcccggatgtccttggcgggatgctgcgcgaccgatgcagtggccgcggggacaacgacctgctgttcaccgacccccggacgggcggatacgtccgtcgcacgcatggccccaacaccacgtcgtcatggttctactgggcgcgtcggcgcgccggcatagagggagagatgaccgtgcatgacctgcgccacaccgctgcaagcctcatggtcaggtcgggcgcgaacgtcaaggcggtgcagaaccagctggggcatgcgagcgccgcgatgacattggacacctacgccgacctattcgatgacgacctggatctggtgggtgacgcgatgaatcggatgctcctcgaaaaaaatgtgggcaaaatgtgggcaaaagaaaaagcagaggccgcatgatcgttggaatcatgcggcccttggcgagtggagctgcggggaattgaaccccggtccgatgaccgaaccctcagtcttctacgtgcgtagtctgctggccatatggcggtttttctgcccccatcgatgtcgcagacaactgatggcgggcatatccgcagttaaagtccccgaatcaccctgtggctcaatgattcaggcgagtcttctaaacgacgctcagcatccccccaaagacgagagggagtgaacggagcggctgctcactgtttaaccctggcgcgaagctcaggcagcgagagcgaactcagtgcggttagatttagcacttattcttttgcaggggacatccacgagcggaccctgcgttctcggcacgcttccctgcgacgaacaggtcaccgtcgaaaccgatcagccccgatattgaattatcaattcgcattccggtttatgaccggacatttcattatatcccagctgctcgaaaaagcaagtcggtcatcagtcggtcaccatacgcgcttggtgccggtctggacgcgcttggttcccgtccgcacctttttcgtgccggacttgatgctctgcacctgatacgagccgtgatcctcctgccgggtcccgacctggatctgcttgtcctgccagaccttttcgtaccggtagttgtcggggaggccggacttgagcaggtagtcaccgtgctcctcgaacgcggggtcgttcacgttcgcagtgaaccagtcgtgttcaaagatggcgcgtccggtcggcacctgcacccgttgcgtctcatagaccggccgggtctcccagtgtccggaggggccgccgttcgggccgctcctgtcgggctgtgcagtggaatcgagctgcgcggatttgccgtcggcattgtcggcgtcggtgccgtccttacggatattgtccccggttgcttcgttcttgccaccggggccggacaccccccccctcggtttccggagaggttccctgttctccggaggcgacggtgccggccggcttcggtggacgcggcataatcgcgtgttcgttcgcgcttatggtttttttgggggggggtatgccgtggtatgcccagttcggatgcggtggcggtgggtgcgatagaatccgatacatgaaagtggtattgcagcgtgtgtcgcaggcgtcggtcgatgtcgtcaatgagctgggggatttggatcccacgttcgaccttcagcagatcggtccggggttcctgctgctggtcggcgtgaccgatgaggacggcgatgacgagatcgcatggctggcgcataagattctgcgtctgcgcgtgttcgaggacgagcagggcaagatgaaccggtcgatccaggacatcggcggtgagatcctgtccgtgtcgcagttcacgctgttcgccgacgtgcgcaaggggaaccggccgagcttcgtcggcgcgggcaagccggaacatgccgacatcatgtggatcaaattcaacgaggcgctgcgctccgggggcgttgcagtacgcgaggggcgtttcggcgcccatatgcgcgtcggcctggtcaacgacggcccggtcacgatcgtcatcgacaccgccgaccgccattgatcggtcgggccgcggctgcgccgtcaccgtgcgagggtaccgtcccgcgtgacggtgcccgtgacgcaacccgtgcaacccgcgcggagtattgccgtgtccgtgtcggttctcgaatatgcgaaaacccgcccgaccggctgccggtcgtaaccggtcagtcaatcgggcgggctctgcggggcggtcagtcagcgccgaagtgccttgaccctatcaggcttccacgggtttcttgccgctttcgagcaccctgtaggcgaagccgacgacgagtacgtagaggcagccgatggccatcacgaggatgccgccgaactgacccgcgacgtcggccgcggcacccatgatgggcgggaagatcgcgccgccgatcaggcccatgagcatcaggccggagatctcgttctgacggtccggacggtacatgagcgcgtgggagaggaacagcgagaacacgttcgagttgccgaagccgacgagtgcgaccgcgacccagaacagccagaccggcggattggtcggcacgagcgtgaagatcgcgaagcagatggcggagagcgtcatgatgacgccgcagatgcgcacgccgagcttgttgctgatcttctggagcacgatgccgccggtgaagcagccgatcatgcgggcgacgaagtacaccatcgtcgcggaggacgcgatggctgtgaacgtgtcgccggtgtgctcggtcaggatgcgcggcgcctgcgcgttgatggcgacgtccacgcccacgtgcgccacgatgccgaggaagcacaggagcacgatgcggtcggagaacagcagcttgaagcagcggccgatggtagtggtgccggcgtcaggcgcgggctcctcgatcttgtcgaacgcgagcagcacgtagccgaggatgccgacgatgaagtagatcacgaacagtatccaccacatgccgacctgcttgccgtcagcgttggtgtaggtgaaggcggagatgctgttcgcgccccacatggcgatccacggggcgaacagggaggcgaacgccttgacgaactggccgagggtcagcgtggaggcgagcttatcacccttgacgaacacggtcagcagcgggttgagcgacacctgcatcagtgtgttgccgatgccgaggaacgcgaaggagatgacgatgagcaccagctgcacggtggacttcatcgggcacagcaggtaggcgatgatcggcagtgccatggcgacgagcgtcaccaggatggaccacagcacggtcttgcgccgcccgatcttgttcatcaggatgccggtgggcacggagaagatcaggaaccagaagaacaccatggtggtgaacaggttggcggttccgtcggcgagaccgaactcggccttcacgtagttcgtcgcggtgccgaccaggtcgacgaagcccatgacgaagaaggcgaacatgacaggcaggatcttggcgaatcccgcgttgactggcttggtggtttcgttgctcattgcgatgtttcccttttctctgataatgagctgtgattatttgatcgtcggtgcatcctgcgggcgtgtcactgcgcggcctgcgcgaggtagtcgggcatggtgtccgggtactccggccaggcgccgttggcggtgcagacgtacgcggcggtgttcacggccttgcggtgcgcctcggccagcgtgtcgccgagcagcgtacgggcggtgaacgtgcctgagaaggagtcgccggcgccgacggtgtcgacgacctcgacgtgcggggtggccagcgtggaggactcgccgttcttggagatgatggtggagaacgtggaaccgccggtcaggataacgtagtcgaggccgtactcgctcatgaaccagcggcaggcgtcgtcatcggaggtgccgcggatgtcgaacatgtcgcgcaggagcagcagttcggcgtcgttgatcttgaagacggtcgccgcttcaagcagctcctcgatgagctccttggagtagtggtcgccgcgcaggttgatgtcgaagaacttcattgcgcccggcttggtgtgcttgagcagctcgatgatggtgtcgtgggtctcgggggagcgcagggccagcgtgccgtagcagatggcgtcggcctgctccacgacctcgatgagctggcgggtgagcagcagatggtcccaggcgacgcccttgacgatggtgtactccgggatgccgttcttcaagctgacctcgacagtggaggtgggccatgcgttgcgctggatgatggagtggatgccggccttctcggcttcggcgagcagctcgtcgccgagcgcatcctcgccgaccgcgctgattgaccagccgtcggcgccgttcatcttcgcgtggtaggcgaagttgacgggggcgccgcctgcgcgctttccgctgggcagcatgtcccacaggagctctccgagagacagaacgatgggcttggtcatgatggtttcctttccgggatggttgccgtggttgttgtgttgttgtgttgctgcggggtcctccgttgtggggatcccggaaatccgtgatgttccgcgggcggtcacgacagttcgaagaactgtgacgggtggtcgaggaactggttgatggctacggccgcggcgccgttcagggcggcgtccgcgggcagggcggacagggtgatggcggtggtgtcgttgagctcgtggatgacgtgcttgtcgatgaccttgtgcacttcgtcgagtaagagctgcccggcttcggcgacgatgtcgccgatgacgatctgcgaggggttgaaggagttgaagatcgtgatgcagccgaaaccgacgtaccgtgcgacccgcttgatcagtgcgatcgcgcgcttgtcgccgccgcgggccagtgcgaacagcgctcgacatgcctgcaggtgggtcatcgtgccggcatcggcgatcagatcgccttccttcaggatcatctcgtggatcgcgggggtggagcagtagcgttcgaggcatccgacgttgccgcagtcgcacggcttgccgttgatgtcgatgctgacatggccgatttcggtggccgctccgagggcgccgttgatgatgttgccgtggtcgatcacgccgaggccgacgccttcgccgacgaggtagtaggcgaggttctcggtggtgatggtgggatcgaacaggtattgggccatcgcgccggcgcgggcgtcttgctccacgaacacggggacggtgaacgcgttgctgaattcgtggatgaagttgactttctgccatccgcgcatcgaggacacgacggcggtgcgtcccacgttgcgcaggtaggggccggggacggccatgccgatggcgatgatgcgtcggtcggcttcgatcagcgaaccgatggtgtcgtggagctgcatgatcgccgagtcgatggtgtcttcggtgacttggggcagttcctgcacggtcagcggtttgccggcgaggtcgaacacgccgagctgtaccaggcttcgcgcgaatttcacggcgatgacgtggaattctgcggtgtcgagagtgagcccgatggagcggcggttcttgcgcccctcgaaatcgccggtctccttgatggcgccgacttctatgagcttggcggtgatcttggtgatggcggcgggggtgaggtcgagggctttggcgatctgcgcgcgagagctgatgccgtgctggtacaggtgctgcatgatccgcgaacggttggtttcggacactgatgccagggttgcgttggcgatggtgttggtcatcactgctccttcgctgtcgtgccgtgtgcgcggtcgttgcgtgttgttgtcatgctcgtcattgaatatgaacgatgtttatatattaacactgttaatcaaaaaaagggaggcgcgccgttgttcggcgtgtcgcgctttgtaccacggtttgcgcgtgtcggggcgtgggatggttcgggtgccctcgtgcgggatggtacggtgatagacaaggtatgtgacgcatcgaaggagatgacaatgacggttgaaatcgcggtgcaggacgtggagggcgcccgcatcgcacatgaggagggggcggatcgcgtcgaactgtgcgccgctctgatgggcacgggcgggctgaccccaagcttcggcatgatccaggcatgctcccatgtcggcgtaccccaaggcgtccaggtgctgatccgtccgagaggcggttcgttcgcgttcaccgatgaagagaaaaacgtgcagatcgccgacgtccgttcggccatcctcgccggggcgtccggcgtcgtcgtcggaggcatgaccgaggacgggcgcattgacgtgccgttcacccgcgcgctggccgaggccgcccgcaacgaggccgtgcgctgcaatcgcaaggtgcaggtcacgtatcatcgtgcgttcgacatgctcgacgatcagttcgccgcgctggataccctgatcgaacttggcttcacccgcgtgctcacctcgggtggcgccgcatgcgtcccggatggtctgggccgcctgcgggagctgtccgaatacgccgcggggcgcatccagatacaggccggcggcggtgtgaccgtcgatctcattcccgccttgaaggagacgggcgtgtcggcgattcatttgtcggcgaaacgcacgatgacatcggatgggggccccggaggcggaggcgatggcgtcatggtatgccgcaccgatcgggatgtcgtgcgtgccgcagtcgccgccgcgcgctgaaaatccaaatcctcccgctggcgggaggcggcgcgcagcctgatcagcggttttccaggtaatcgtggaggactgatagggcttcgccacgcagggtgatttcgccctcgcactcgcatcggcggatgatggtccgcgtgtggaacgacgagccggtcagcaggtcgagctgcgcctgcgcggccgacagcagggtgtcgttgacgatgtcgctctgcccgtacacgcacacgtcggcaaggtccagcagtcccacgggcatggacagcgccgtgcccagataggtgccggcctcgcgcaggatgctcgcgcgcatccgttcgtcgctgcgctgcagccgtgcgtgcagcgaggtcgccgagaccaggcgttcgaggcaccctcgcttgccgcaggcgcacggagggccctgcgggtcgagggagatgtggccgatctcgccgccggcgtggttctcgccgaacaccggcacgtcgcccagcagcacggcgcctccgacgccacggcgcaggcggacgaacatcatattggggccgcccttgccgaacagtcgctcggtgaacatggcggcggtcgcgtcgttgttcacggtgacgggaagtgagaaacgccgttcgatgggcgtgcggacgtcgacgttgcgccagccgagcagcgtggagcgcttcaccaggccgttgccgtcgaccacgccgggcatggcgagcccgatgccgatgacgttctgcgtggcggcgtgcaggggagtgatgacctcgttgatggtgtcgaaatccacatggttcaccgcccgcagcgcgtgttccacgtgcatgaccggctcgccgagcaggttcgtggcctcgccctggatgagatgcggctgtgacaggtcgatgctgatgatatgcagcgtgtcggggtcgacgctcagcagcgtgcctcgcttgcccttgccgccgttggactcgcggccgttctcgcgcagcaggtgacagctgagcatgctgttgaccacatcggagaccgccacgcgggacagtcccgtgcgccgccccaattcggcgcgtgaaagttggacgtcggggaacagcaggctgaagatcaatgaccggttcgtgcgtcttgcatcggcgggacttgccttgccgctctgtcccgggttgtgggggccccatatcccggattgctggtaagcggtcataagtccctggatcctttccgtggctctccgcgagaccatttccggtcacgcaatgttcattctacggtcgctcatgttcaatgtccgttgtgtcgccgaagatgcggatatacacattagttagtatcattaacaaatagcggatgcgcatgtcacgggaaacgcaagaatcgcgtgacggcacggctggtcgctgatgacaacggggtggccgaaccgctgaagaatgaacaacacaaggaggttgcacatgcctgaagtgattatcgtgaaggatcaggatgaggccggcgagctgtacgcccgctgcgtcgccgatctgatcaagggcaagccggacgcggtgctgggtctggcgaccggttcgagcccgctggccgcctaccgtcacctcgccgccatggtgaaggccgaggacatcgacgtgtcgaaggtgcgcggtttcgcgcttgacgagtacatcggtctgccgctgacccatccggagtcctaccacagcaccatccaccgcaccgtcgtcgagccgctcggcctcgacccggagaaggtgcacgtgcccggtgacgtgctcgacggcgccccgctggaggacggcgagcgtatcgcccacgccggccccgagtacgatgcggccatcgaggccgccggcggcatcgacgtgcagatcctcggcatcggcaccgacggccacgtcggcttcaacgagcccggctcgtcgctggcctccggcacgcgcgtcaagacgctggccgagcagacccgcgtcgacaacgcccgcttcttcgacgacgacatcaaccaggtgccgacccactgcatcacgcagggcatcggcacgatcctcaaggcccgtcacctggtgctgctggccttcggcgagggcaaggccgaagcggtcgaggagacctgcgagggcggcgtgagcgccttctgcccggcttccgctctgcagctgcacccgcacgcgacgatcatcgtcgacgaggccgccgcctcccgcctgcgccacaaggactactacaagtacgccttcgagcacaagccggcttggcagggcatctgatcagcgccctgacaggcatatcgatatgcgctcccgaaccggggcgcatgacggatgggttccccgtctgggggacccatcctcgcatggggcggtcatcatcgcgccccgaatcacatacaaagaggtaggacaatatgactcaatcacgagaacagatcgtcgcgcgggtgactgatgcgctgaagggcgaggcgggtcgcgtcgccgttcgcggtgcccgcaaggtggatgcgtgcggcgtccaggatcatttctggctgaccgcggcggacggtgtcatcgtcgccaccggcaccgacgacgaggcgttcgagtcggcgtgtcgttccatcggccttgatccggccgacgagacggccatcatcgatgcggccgggcagctgatcaccccgggctatgtggacattcacgcgcatggcgcatgggagcattccttcgatgacggtccggaaggcatcgacatcgcgcgtgccggccacgccgtgcacggcacgaccaggcaggtgctgtcgctgatcaccaatcccatcgacgtgatctgcgcgaacctgaagaacgttcgcgccaagatggacgagcgccccgacgtgctcggcgcccatctcgaaggtccgttcctggcgctcgcccgcaagggcgctcatgatcccgagtgcctcaaggacccggttcccgagctcgtcgacgagctgctgggcgctgccgacggctgcatccgccagatcaccatcgcgcccgagctgcctcacggcatcagcgccatcaagcagttcacgaaggcgggcgtcgtgccggccgtcggccactgcgacgccgattacgagaccgccaaggccggtttcgacgccggcgcgggcatcatgacccacatgttcaacgcgatgaatggactgcaccaccgcaagccgggcccgatcccggcggccgtggaggatccgcgcgtcactatcgagctgatcaacgacggcttccacgtgcaggacccgatggtcaagctgggcttcgagttcgcaccccaccgcacggcgttcgtcaccgacgcgatggcggccaccgactgccctgacggcccgtacaagctgggtgcgctggacgtgaacgtcgtcgacggccacgcccgtctggtgtcgaacggtgccatcgccggctccacgctgctgcttgaggtcgccgtgcagcgcgccgtcaatgagctgggcatctccccggtcgacgccgtcgaggctgccacgctggcgcccgcgcgcgcgttcggctacgacaagccgaacgcggtcaccggcgccccgctgggtctgctcgcgcccgggtacgccgccgacctgttgctcaccgatccgtccagctggacggtcaaccaggtgtggtgcgccggccgcaagctgaagtaaggcgcagccgcaaggcgttgattgcattcgtcacgggaaactgtgataggtcgcgatgagggccgtctgcatatgcaggcggccctcatctcatgtacagccttgtcgcccccacctcttccggtctcataatgtgggcattgtgtggcgaatgtcgcaaaataccggaatagttgcaattccaagggtcattcggccacaagccgcgcccttgcacatcacagccgattcgtatggaaacacatggctaacacagtaaccccatagtcttggtaaccgtgccaatgaagacggcgcggagagtagttaaagaagaggtatttcccttgaagaatcatcgcaagattttggcgactgtcgcatccatcgcggcaatcgcatcgctgaccgcatgcggcggcgtgaaggacgacaacaatacggcgagcggatccgcgatcaccatcggcaccaccgataagatcaccagtgtggatcccgcgggctcttacgacaatggttcgtatgccgtgcagattcagattttcccgttcctgtatgcacaggattacaatacgtccgaattgagcccggatatcgccgccgatgacggtacatggaatgatgacggcaccgaattcaccgtaaagatcaaggaagggctgaagttcgcgaacggtcatgacctgaccgcatccgatgtcaagttctcgtatgaccgcatcaagacgatcaacgacgcgaacggcccgagctcgctgctcgccaacgtcgaatccgtcgaggctccggacgataccaccgtcgtgttcaaggactccgtgccgttcgatgtgacgctcaagcaggtcatgtccagcccggccggccccatcgtcgacgaagaggtcttcgacgccgacaagctgaccgacgccgacaccatcgtcaaggggaacgcgttcgccggcccgtacaagctcaccgcgttcaagatgaacgagaccgcgtcctacgagaagaacgacagctacaagggcctgaccccggccaagaacgacgccatccaggtcaagtacttcgccgacgcgtccaacctcaagctcaacgtccagcagggccagatcgacgtggccttccgctcgctgaccccgaccgatatcgaggacctgtccaaggactccaaggtcaaggtcgtcaaggggccgggcggtgaggaacgcttcctgaccttcaacttcaagatccagccctacggcgagtcccagtccgacgccgacgccaacaaggccaaggccgtgcgccaggccgtcgccaacctcatcgaccgcgatgagctgagcaagaaggtctacaagggcacctacaccccgatgtactccttcatccccgacggactgtccggccatgacgacacgctgaaggccgcctatggcgacggtgagggcaagcccgacgccgccaaggccaagaaggtgctggaggacgccggcgtttcgaccccggtcgacctcaagctccagtacaacggcgaccactacggctcctcatccgccgacgagtacgccgccatcaagtcccagctggaggccgacggcctgttcaaggtcgacctgcagcagaccgaatggacgcagtacaacaaggaacgcgtcgtcaccgaagactccgacggctcgtacccggtctaccagctcggctggttcccggactactccgatccggacaactacctgtccccgttcttccgcgacggcaacttcgtcaacaacggctactccaacaaggaagtcaacgatctgatcgtcaagcaggcaggcgagaaggacgccaccaagcgtgaggagatcctcaagcaggtccaggccctggagaccgaggacctgtccaccatcccgctgctgcagggtgcccaggtggccgtcaccggaacgaacatcaagggtgtcgtgctcgacgcctcgttccgcttccgctacgcatcagtgaccaagtcctgatccagtcccggctcccgccgacgcggggcgacgcccgtgaagccggtcatggatggtgcagttgacgccaagccatccatgaccgccgcgggcgatcccacacgccgcgggagcatcatccgtattcgatcgtttttccccagaaggagcatcgcgtgtccgaaagcgccacggcgtcggcacctgcgaagacgcagccgaaagccaagaaaaaccgtttgtccagtgggtttttccgtttcgtattgaccagattcctgctgatcatccccactgtattcattctcgtcaccatcgtgtttttcgtgatgcgtgccaccggcgacccgatttccgccgccatgggcggacgcctgactcccgaagagctgcaacgccgtatccacgccgccggctatgaccgtccgctggtcgtgcagtacctcgactatcttggcggactgctgcgcggcgatctgggcaccacgctcaccgacaaccagccggtcaccaccatcctgacccgctacggggcggccacgttcgagctcgcgttcctgagcctgatcgtcgctctgatcgtcggcatcggactgggccgtctcgccgccaggcgccgcgaccacgccgccgatgcgggcatccgcgtgttcgccatcctgtgctatgcgacgccggtgttcttcctgggactgatgctcaagctcgtcttcgcggtgtggctcaacgtgctgcccccatccggtcgttccagcttcgccagcgacatgcaattccagaggctggtgtcgcccacgggcttctacatcatcgacgccttccagctgggtgacatgagcgtgctggtcgatgtgctgcgtcacgcggtgctacccgccctcgcgctgggtctgctgaccgcaggcgtgttcatccgtctggtgcgcaccaacgtcatctccacgtacacgtccggctacgtcgaggcggcgcgctcccgcggcgtgtcggagggccgtctgctgtccaagcacgcctggcgccccgcaatgatcccgatcatcacggtcatgggcatgcagatcgcgctgatgctcgccggcgcggtgctgaccgagaccaccttcgagtggaagggcctgggattcatgctgtcccagtacctcaagcagcgtgacttcgtcgccgtgcagggcatcgtgatcctaatcgccatcatcgtcgccgtggtcaacttcatcgttgacgtgatcagcgcgctcatcgatccgagagtgaggtactgacatgaccgaaagcactgcaaccaaagtcggcgtgcccggcgataagcggctcggcgacctcaaggtcaacaagccggtgccatggtacggcaagctgccggtggtgcgcgacctgaagatcgcggtcggctggcagaaagccatgctggtcacgggccttgtcatcaccggcgtgttcctgctcgtggcggtcttcgccccgctgattgcgccttacggatactcgcagatcaaggacgcggacggcgtgtcgttcccgacgcaggccgccccctcgtccaagcacatctggggcaccaccgtcggcggattcgacgtgttcagccgcacggtgtggggagcgaggaccgcggtcatcgccatcatcgtcgccgtgctgctgtcgatcttcgccggcgtgctgctcggcctcatctccggatatttcggcggatgggtcgaccgcgtgctggtcgtgatcgccgacgccatctactcgttcccgtcgctgctgctcgccatcctgatggccatcatgatctccggcggccagtccggcctgtggagcggcatcctggcatcaggcatctccatcaccgtggtgtacatcccgcagtacttccgcaccatccgcgccgaagtggtgcgcatcaaagggtcggcctacgtcgagtcggcgaaggtcgtgggcgcctccacatggcgcatcatgaccaagcacctgctgaagaactcgacgcgcacgctgcccgtcatccttacgctcaactcgtccgaggcgattctgacgctcgccggactgggcttcctcggcttcggcatcgagccgacggccgcggccgaatgggggtatgacctgaaccgttccgtcgccgacgttacggccggcatctggtggacggccgtgttccccggcatcgccatcgtgctgatcgtgctgggcatcacattggtgggcgaatcgctcaacgatctggcggatccgcgtcttcgtgcccgcaagtccgccggcgaggtcatcggatccatcgaagacacgtccgtcgaccccagtgagaagccgagcgccgacaacgaggtgatcgcggagctcaaatccgaaggcaagccccaggtcagtgtggagaaccctgccatcgcgcaggtgatggaaaaggagaccgaccatgagtgactcgaccaacgtcaaggacacgtccggcaatctagccgaaatcgagaacctcagcgtctcgttcatgaccgatgcgggctccatcaaggccatcgacaaggtgaacttcaccatcccgcgcaagaccgtggtcggcgtggtcggcgaatccggctccggcaagtcggtgaccgcccgttcgatcatcaagctgctgcccgagaccgccaccacgtccggtgcgatctacttgtcgaaccgtgccgactccgaacgtcttgacgtgctgagcctgtccggtgaggatctgcgccgcatgcgcggctccgaagcggccatggtgttccaggagcccaactcggtgctcaacccggtgtacaccatcggctggcagatcgaggagggcctgcgtgcccacggcatgaaagacaagaaggagcgccgggcgaaggccatcgacatcctcaagaaggtcggcatccccgaggccgagacccgcatcgactactatccccaccagttctccggcggccagaagcagcgcatcgtcatcgcgatggcgctggtgctcaaccccgggctgatcctcgccgacgagccgaccaccgcgctcgacgtgaccgtgcaggccgaaatcctcgacctgctgcgtctcgcccgcgacgagttcgacgcctccgtgctgatcatcacgcacaacatgggcgtcatcgccgacatcgccgaccaggtggtcgtgatgtaccgcggccatgtcgtcgagcagggcgatgtggaaagcatcttctaccatcccagccatccctacacccagcgcctgctggcggcggtgccgcgcatcggccagaagctggtcgtgcgcgatgtcggcggcaagccgatcgaccgcacgtcggattggcatgacgagccactggccgtcgaggcgaagggactgacgatcacgtaccccgggcacctgatgcagcccgacttcgtggccgtagacggcatcgacttcgcgatccaccgttccgaagtgctcggtctggtgggggagtccggttccgggaaatccaccaccggccgcgcgatagccggcctgcagaaagtgagcggaggctcgctcaatgtgctcggcgtcgagatgaacggcgtcagggagcgtgatttcaagcccaagcgtgccgacatcggattcgtgttccaggatccgggcagctcgttcaacccgctgatgaccatcgcggagaacgtcgccgaaccgctcatcgtgcaccgcaagtactcgtcggtcgctgacgcgaaggagtacgtgggcgacctgctggagatggtgcagctgccgagggcgtacatgagccgattcccgcacgagctgtcgggtggccagcggcaacgcgcctcgctggcacgcgcgctggcgctcaagccgtcgctgctgatcgccgacgagccgacgagcgcgctcgacgtgtcggtgcaggccaaggtccttgaactgttcaagaagctgcaggttgagatcggattcgcctgcctgttcatcacccacgatctggccgtggtggacatgctcgccgaccgtatcatggtcatgcacaagggacgcatcgtcgagcacggcgacgccgacgacatcatgcagcggccgagcaaccagtacacgaagaaactgctcgcctcgctgccggttcccgacccgcgcgaacagcagaagcaccgcgcccacctgcacgagctcctggccgccgaaaacgcggcctagccgctagccccagcaggattaccggttccgccccgctggcgggaggacacatatcgactccacgcgaacgtcgtatgggcgggcgtggtgcgactagtatagggaaggaattgtcagtcggttttcgaacggcacaggttttcgaacagtacgaaggagcgtcacacgatgagcgaagtcatcaccgagaaggacaaggaatacgaggcccgcgaggaggcgaacgcccccggcgcggatcaggcgatgagcgaccgtgtgaacaaccgttcgctgcgtcccaattccagcgccttcattgatttcatgaagaccggttgggacgccagcgaaccggagatcgagccgctcgaatcctcgaagttcacgccggcgcgactcgccgcactgggcaaggcgttccccggcgagcgtctggtgattccggcaggcagtcccaaggtgcgcaacaacgactgcgattacatgttccgcccggacaccaccttcgcgtactacaccggcctcggccaggattacgaggcgggtgccgtgctggtgctcaaccctctcgacccggattcgcccgaggcgaaggccggcaagacgcatgaggccgagctgttcgtcgccccgcgcgccgacaccgccacgcaggacttcttcatgaacgcccattacggcgaatactgggtgggccctcgcgccggtctcaaggaaatgaccgcgatgaccggcatcgagacgcacgacatcgcccagctggctgacgcgctgtccaaggacgtcggggccgaggccggtgcggtgcgcgtgcgcgtgatcagcgacgccgacccgcaggtcacgtcactggtcgaatcgatccgtgaggccaacggctataccgacccggacaagaacaacgcagccgacgacaagctgcacgagttcgccgccgaagcccgcatggtcaaggacgagtacgagatcggagagatgcgcaaggctgtccaggccaccaagcacggcttcgaccacatccttgcgaagcttcccgaagcgctcgacaagccgcgctccgagcgcatcctcgaaggcgcgttcaacgcggtggcccgcgaggagggcaacgcgctgggctacgatacgatcatcgcctccggcgagcacgcgccgattctgcactggatgcgcaacacgggcgtcgtgcgcaagggcgacatgctgctcatcgatgccggtgtggaggtcaacagcctgtacacggccgacatcacccgcacgttcccgaccaacggcaagttcaccgatttccagcgccggctctaccaggcggtgctggactcccagcaggccggcttcgaggccgccaagccgggcgccacgtactccgacatccatcacgcctgcatgcgcgtgatcgtgcagcgcctgcacgactgggggctgctgccggtggacgtcgaggaatcgctgtcgcccgaaggccagcagcaccgccgttggctcgcctgcggcgtggcgcaccacctcgggcttgatgtgcacgattgcgcacaggcccgctacgagtcgtaccaaggcgcgaagatcgaacccggcatgatcttcaccatcgagcccggcctgtacttccgcgaggacgacctgctgattccgccggaataccgcggtatcggcatccgcatcgaggacgacgtgctgatgaccgagaacggccccgaatggatttccgcgggcatcccgaagcagcccgacgacgtcgagcagtggatggccgacatggccgcaggctccaaggcctgattgttccgatacgatgccgcccctttcaacggggcagcatcgtcggttgtgcgcaatacaaggaggaatgcccatgccaacacccgaattcgtattggagttgcgcaagaagatcggccatgacctgttgtggctcaacggggtcaccggctgcgtgctggacgaccggggccgcctgctgctgggccgtcgctccgacaccggcgagtgggccatggtctatggcatcaacgagcccggtgagcagccggcggatacggtggtgcgcgagatcaaggaggagaccggcatcgacgcggtcgtcacagacctggtcgccgtcacgtcgtcgtcacgcgtgatcacctatgcgaacggcgacaatacgatgtacatggaccactcgttcctgtgcgctctcaagcccggcggcaatgccgagccgtatgtgggggacgaggaaagcctgaacgtgggctggttcgaactggatgatctgcccgagcccctggccgccagcactgtggagcggctgaagctgttccggcgctatctcgacaacaagcgccggggcgacgcccacgcgatgttcgtcgccgacggggtgcagcgctagcggcgggtctgtttgcgtttctaagtgcgcgccgaaacgacaagtgcgcgaacatagggacgcaaccggcccatttgcgtccctaagtgcgcacggttgtcgtttcggcgcgcacttaaggacgcaaacgagcgctacacggtcgtcataggggctgaccggtgtgacgtgccgtccgtctcactcgtcttccatgtcggcgagctcatgcgccgggcaggcaagcgcaagcacggccgtggtcgctatgaacgctacgccactgaggatgattgcccgcatgatccatctcctatcgcgtggtcttctcatcggagagccgaacctttccttatcaagtacagaaccatataagagctcgtttcatgggtcaggtcatacgaacggtcaatttttggtgacgacttcgtgaattacgccgtcatcgtgcctgcgattggcgtcgcaatgacgcggcggcgacctgctgaccggatattgccgtcggcatatgacaggacgaccattagaatggcgtaacggaaccattgacgagcaaacgaggtcgatatcagcatgtcttttgagcatccgaaccgcaacaacgagtccatccgcgacgtggagcgcgacatcatgcgccgcccgccggagcacaacaccacgaatctggatctggaccggatgaacctcatgctcgacgtgctcggccatccggagcactcgttccgtgtgatccacgtcaccggcacgaacggcaaggggtcgaccgcccgcatggccgaggccctctgccgggcgtatgggctgcgcaccggcctgtatacgtcgccgcacctggaacgtatcaacgagcgcatcgccatcgacgggcaggagctgagcgatgacgatttcgtggacatgtgggatcagatcaaggatctggtcgccatcgtcgacgcgaagatggccgagtccggccgccccccgatgagcttcttcgaggtgctgacgtcgatggccatctggaagttcgccgacgcgccggtcgacgttgccgtcgtcgaggtcggcatgggcggcctgtgggacgcgacgaacgtgctggacgcggacgcggccatcatcggcccggtcgacatggatcatatgcagtggcttggcgacaccgtcgagcagatcgccaccgagaaggccggtatcataaagccgaactgcaccgccatcatcgggccgcagccgcatgaggagcgggtcatgccgattctgatggaggccgccgagcgcaaccatgcgacgctgatacgcgacggctatgagatggaggtcacggaccgcgtgcctgcggtcggcggccagatcgccacgctgcacacaccgaacggggtgtacgagcaggtgccgatcgccaagttcggcgagcaccaggcacacaacgcgctcgccgcgctcgctgccgcggaggcggtcatcccggtcaacgggccgttgaacggcgacctggtcgggcaggcgctgcagggcgtcaaggtgcccggccgcatagagcagatccgcacgtcgccgacgatcatccttgacggcggacacaacgtgaacgcggccgaggcgctgcgcaaggccatcgaggaaagctacgacttcacacagctggtcggcgtcgtcgcgatgatgggcgacaagcaggtggaggagtatctcggcgtgctggagccgatcctgagccaggtcgtcgtcaccgagaactcgtggcgcgaccgcgtcatgccggccgaggaactggagaagatcgccgtccaggtgttcggccgcgaccgtgtcatccgcgaggacagcctgccagacgccatccagaaagcggtcgacatggtggacgtcgaggatgagaccggagtcggctacggccgtggcgtgctggtctgcggcagtttcgtcaccgccggagacgcgcgcacgctgctcaaggagcggatgaacgccgacctcgccaagccgaaggccgagcgtgtcaatccctcggtgggcgagcccgagccgcgcaccggcgccggagaccctgcacggtccggggtggaatcggacgccgacacggacttcgccaccgatgcgaaccccgatttcaacgagaacgacttcggcgatttcggctttgacaaggccgccaaggaggctgccaaggaggccgccaaggaggcggatgccgccgacggcggtcccaagggcggacaggcctagtcgacatgtatctcaaggaactcacgctgcgcggcttcaaatcgttcgcatctgccacgacgctgcgattcgagccgggcatcaccgcggtcgtcggtccgaacggttccggcaagtcgaacatcgtcgacgcgctcacctgggtgatgggtgaacagggcgcgaagaacctgcgcggcacgtcgatggaggacgtgatcttcgcgggaacgtcctcccgcccgccactcggccgcgcacaggtgagcctgacgatcgacaacaccgaccacacgctgagcatcgactacagcgaggtgacgatcagccgcaccatcttccgcaacgggggttccgaatacgcgatcaacggctcggcctgccgtctgctcgacatccaggagctgttgagcgacaccgggctcgggcagcagatgcacgtgatcgtcgggcaggggcggctggacgcgattctgagggccgatcccagcggccaccgcgcgttcatcgaagaggccgcgggcatcctcaagcaccgcaagcgcaaggaacgtgcgctgcgcaagttggcgaacaccgaaacgaacctgtcgcggctcgacgacctgctgagcgagatacgacggcagctcgggccgcttggccggcaggcgcgtatctcgcgcagggccgacagcatccaggtgacgttgcgcgatgcgcagagccgcctgtacgccgacgatgccgtcgccgcgatggcgaagcgcgacgcggtgcgcggcgagctggcttcggtgcgtcacgacctgcaggccgcgcaatcggagctcgtccgggtcaaggtgcgcatcgaacagatcgaatcgctgagcgcgcaatccagcccggcactcgcgcgaatcaaccagacctggcatgagatgtctcagatacaggaacggctgaaatcgttgtgctcactggccggcgaacgcggacggtcgctgctcgggcagctggtgacctctctcggcgaggaccccgacatgctgaacaagcgggcggaggaactggaatcgcaggcgcggcggcagtcggagacagtcaacgacatgcgcatcgcgctcgacaaggcgatacaggagcgcgccgacgacgagaaaaaactcgcctcggtgcggcagaccctggcggagctgcgcaaaagcgcccagcagcgcgacttgcagatcgcgaacctcaacgcgctgatcgcccgcgaggaggcgtccgccgaacttgcagacacacgagccaaggatttcaccgcgcagcgcgaaacactccagacccagttgtcgcaggcgcgctcgcagtgcgagtcgttggaacgcgaggccgacaacggcgacgatgacggcggcaaggcgctggaacaggcgcgggccgatctcgccaagcggcaggaggcgcttgacgacgcgctcgcgcggcaacgggacgtcgacggttcgatcatcacgctgcaggccaaagccgacgcgctgcgcgacacgctggaatcgcgcaacgcctccggcgctctcgaacaggacgatcaggtggccgcgatggggcggctcgccgatttcatccacgtcgaggaaggctgggaggaggccatcgcccacgcgctggacgcgttctcgggcgccatcgtggtgccgggggagcgcaacctcctgcatgcgctgcgcaaggcgaagcaggatcgtctgggcaaggccgtgctcgtgatgtccgatgtggctgaaagcggtgccggtgccccggaacaggtggccgccgctgaggagaacgatggttcgccatatcggacgccgtgtgcggccggcacgatggtgtcggcgaatccggatgcaccggacccgagccgagccgcgggggtcgtcggcgcggtgcggctgctgctcaacgacgtcgtcgcggtcgagacgatggatgaggccgtgcggatggtccacgacggcggatgggcgcaggccatcacccgcgacggggaggtcgtcaacccggtgggtgccgtgggcggttcatcactgtcgcaaagcgacctgtccttggcagcgaggcgggataaggcgctgaagcggattacggtgctgcaagggcagctggacgacatcacgcggcaggttggcgaggcccgtcagcggcgggaccaggggcgagtgctggtcgacaaggaatcgcagcggcgcattcaggccaagctcaagtccgaacaggccgcgaaggcgttgcaatcggccgagtcgcggatgaagggcgtggaacgtcaggccgcggcgatcgaggagaagctgcgcggcagtgtcgaggaacgccggagccatcagttgaagctcgacgatttgcggcgggcgctcgccgcgatccgggattccggcgcggaacatgccgacgtcgacgagctgggggagcgcgagcatcggctggaagccgcgttgaacgctacccgcgagcatgaggtcaccgcgaagatcgcgtggacggaggcggaacgcaaggtcgagtcgttcaagcggcaggccgggctgttgcgcgacaacgccgcggaggccacgcaacgacgcgcgcgcatcgaggccatgaacgagcgtcgcaaggcgcaggccgcgcacgcgcagcgcatcgccgacgatgccgcgcaggtcgcctccctggtggcggcgagcatcgacgatgtgatcgccaagcgcgaggcgctgcaggccgaggcatcgagccacgacgtggagctgaagacgctgcgggcgcagcgcgatggcatcgagccgaaggtcgcgggactgcagcggcgtgaacacgagctggatgtggatcgcgaacgattggccggggaattcgggcagttgacgcaaaaggtgtcggatgacctgggactttccatcgacgagctcacccgcgatttcggccccgagcggccggtgcccgtgctggacgagaacgggcgtcccgtgccgcgtgcggacgcttctgaacctgaatccgagtccgaaccaggctccgaatctgacggaggcgacgacccgagccggttcgaaaccgttccgtatgaccgtgcggaacagcgcaagaggctggagaaggcgaagcgcgacctcgccgcgctcggcaaggtcaatccgttggccggcgaggaatatgacgcgcttgagacccgcaaccaatacctgaacgaccagcgcaacgacgtggtcaaatctcgcgatgatttgatgaagctcatcagggatctggattccacgatggtgagcgtgttcaaatccgcgttcgacgataccgccgccgcgttcgagaagatgttcgccacgctgttccccggcggtaccggccgtttgcgtctcgacgaccccgatgacctgcttgccacgggcgtcatcgtcgaggcgagcccggccggcaaacgcgtcaagcagctgagcctgctgtccggcggggagcggtccctgaccgcgctggcgctgctgttcgcgatcttcaccgcgcggccgagcccgttctacgtgatggacgaggtggaggccgcgctcgacgacgtgaacctgacccgccttatcaacgcgttcaacgaactgcgcgaacacgcccagctcatcatcatcacccaccagcagcgcacgatgtcgatcgccgacgcgctgtacggcatcacgatgcgctccgacggcgtcaccgccgtagtcagccagaaactcagccgctgaccccacatcgaagaccaccctccggcaccgcgcgccacctcccgccagcgggaggattaccgattgccgacccgctggcgggggctgtcggccgtaggccgactgggggtggccgtgcatccggggatgtggctgttgctccgcccgaccgacctttttcgcctgcgccgactctagcggcggatggccttggcccggctgacggtgtcctccacgaggacggcctgggcgtcgatgatcggcagctgaggcagcgggaacgcctcgttgagcacggagagctcggtgcagccgagcattagcgtatcgcaacggcacgtgccggccggatcgagcatcgcctgcagcaccgactcgtagcgctgcagattcaggtcgccggttcccttcacgtcgtcgtagatcagtgacgtgatgcgctcctgcaactcgtcgtccggctcgacgaaggtgtagccggcctcctcgacggcctgacggtacacgcccgaagcccgcgagcccatcgtgccgaggaatccgacgcggtggaaacgctccttggggtattgcccggccatgtgcgcgacggcgccgcgcggcatgtgcaggatcggcaccggcgtcagcgactggaaatggtcgtagaagtaatgcgcggtgttgcaggtgagcacgatgaagctcgcgcccatcgcggtcgccttgtcgatgtcgtcggcgattatcgggaacgggtcatcgtcggactgcccgatgatgaacgcggtccggtcgggcacggccgcgtcgttgaacacgacgtagtcgaggaactcctggtcgctgtgggcgtgcgtctcacggttgaccaaccggatatagctttccgtggccagcgtgcccatgccgcccaataccgcaaaaaatggtcgtctcataaatgtcgccgtcgattccgaaaagtcagtcgttcttgccgagatacgtgtcgtagttcttcgcggtcagccggtgcagcctccacagcagcagccggcgcctgaacgacaggtcccgcccgtagcgcagcgtccagccggatttgcccgccttgtgcagcgcgattccgcggtcaagcgcctcccccggctccgcgtacttcttgagcgtcgagaacggcacctccagcagcatgctgtcaccgcggccgatgaccgtgtcgccctccatcgggttgccgagcaccaggtcgtcgacgaaatactcggccaggttgaagccgttaagcgtcacgaagaagttcgtgcggccctggcgcaggttgatttcgaacagcttgtactctccgtcgcgcgggtcgaacttgatgtcgaagttcgcgacgccctcatatccgatgctttccaggaagctcttgatcttcaggcagaatccctcgttgtagtcggggatgatcgccgcgtagttgccgatggcctccggcgtcgggtcggcgagcagcacgtggccgagcaccatcatgcgcacatggtggtcatggtcgacgtaggcgttgagcacgcgcatgttggcgtcggagccggggatgaagtcctggatgatcagctcggagccgtagccggcgccgtagatcgcggagacgacatgggccagctcctcgggcgtgtgcaggatgaacgccttcttgcgtccggggaagtccacgtgcaggtattcgacgctgttcgccggcttgacggccacggggaagccgaacggcaggtcgtgatacttgccggccgcggcaccggccttgtccagaacgaacgtgagcgggtgcggcaggtcatactgggcgcacagctcgtagaaggaggtcttgttgctcagacggtcgtgcaggtcggcatcgaccgacacgaccgtgaaatacggcttcagctcgtccttgtaccggctcagcagctcgctgtagtcgtcaccgcacgcgatgagcaggaacgtggtgtcgggtcgctcggacgtgagccggcgaccggcctcgaccatgtgacggcggaaggattccggctcggtgaagtccgcgaagaacgtcggctccataatcgaactgaatttggtgacggaaagctgcatacggccgtataccagcgatttcaggccatacgcgctgtggaacgcgcgggccatcgcgtaggcgcaggtttcactgccgagtagtacaggctggaaagccgtcattatcgatccttctgttggacgttcacgattgcttatgacattctacatactccgtgtggcgatgggaggccgtttcgtgcgcagagtgcgaagatgcggtcacgcgggccgttgcccctggcgcggggggacgatacattgaaataagacgtattctcccgatggaacgaggttggtcatggaagagacgacggcacggggattcgcggaacttcgtgaggcgttggcgtcccgcaccgggacgcggccggaggactggttcccggtcttcaaggcacggtacggcatgcaggtggcgttcgacgcagtgaggtcggttcgtggcgacggctcggtgctcacccagctgttcacctgctgcacggcggtcgatccgattgttgtgagcgggctgagaccgcggtatgcggatgtgggcgccgacacgatgggcattgacgtcgccaaggtggagtccatgccgctggggagcgacgagcaggtgcatgcgatggtgatgcagcatacgtttggcgcgatcgatgaggactcgtcccggcggctggccgcgctggcgggggagatgggggcgttgctcgtcgaggattgcgcccactgcgtgacccgcatggcccgtgatgctgcgggatggccgttggccgacatttccgtgcactcgttcggcgtggagaagatgctgccgaccagattcggcggcgccatctgggtcaatccgcggctgcgtgagcgggatgcggcgctggacgccgagacccgaggccggctcgccgcgctggagcagccgtcccatcatctggatacggtcacgaaactgtatatcaacgagaaccgcgtgctgtcgcgtctgggcggattcggcgggcggatgcgtgagcgactcaccgcttcgggctggtatgagccgccgatttccgacaaggagcgtcgcggcgcactggaatatgagccgatgacggtgacgccgtggatcgcgcagcaggcggtggccggcatctccgcgctcgacgccaatgagaatgggcggcgcgcagtcgtgaccatgtatcgcgaggcttttgcgggcgtcgacgggttggacgttccggcagtggtgatggacggcgaggcgcagccgctgttgcggtttccgctgttcgcgcgggataccgaggcggcggagcgcatcatcgccgcagcgcggcaggcgggtggctacgccgaacgctggtaccgccccgaactgttccccggcgtgaccgatccggccgcctatgggctcgacacgttggaccgctccaccgtgccggtcagcgaccgtctggtctccaccgcgctatgcctgcccaccgaactgggtgaagacgcggttcgccgcgtcatcgacgccgtccgcgccgccgtctgaccaccggcacgtctgaccgccctctggcgcgcagcgggcggtcagacgtctcacccgttacaccgcgccgggaatcttacttcttgagggtgttcttcagtgatttggcgagcttgagggagctgtagaaggccttcttgatcggtacgtcacgcccggcggccaccggggtgatttcctcggtgaacttgcacttgaattcgttgagaccgttgaggctcggtgccagctcggagccgatgcccatcagatcgtattcggtgatgccctgcgagccaaggatgcagcactcggtgtacagcagcttgtcggtcacgtgcaggcgcatcacgtcgttgcgcatgccggcatagtagcgtaccgcgtgcgtgccgttgacggtcacgattgaccatgccaccacgcggccctcgatgcgggccgcgaacacgcggcaatgatccgcgcccagcgcctcgatcatgtcggagtagtcggtgatcggagcgggcgtgaatccgtcgcgcttgccggtctccaccatcacgtcgtagtattccgcgaagtcggcgatcgcctgcttcgtctcgtcggcgatgtcggccgggcattcgcgcagcgacttgcgcacgtcgcggcggccgcgacgcttcatgcgactcaggatcgcatcgtcgccgccggtcacgtcgatcaccacggtctggtcgtacggcacggtcgacagcaccggcacggtgccgtcggtgaaccacgtgtcgatgcggatgaacgccacgtgcctgtccgctcggtgcacttcggtggcgatcgcgtcgatggcctcgcgttccagcgcctcgtccggcttgacgatccaggccgggccgtgcatcgaacgcaggtaatggtatccgtgcgtctccatgtcgatgaacgcaatgaacgcgacggtctcgccgtctcgctggatcatgtacacgccccaaggagtgcggccggggatgtccgcctggaagcgtgcccacacgtcggtctgttcgatcggcagcgtcacgccggcatcggccgccgcctgttccatttgctggtagtcggttttctgtaacgtaatcatgcttgtcttgcttgtctttctatcggttcgtgcgctttggcggctcaggcgaacatgcgctcgacgatgcggtcgtcgccctcgaacggcacgtgcttgttgtggtccttgatccagcgttcgtcacccttgccgatgatgaggatgatgttgaaccggtcggcgtgcgctcgggcgtcgtagatcgcgttcgtgacggcgctcgggcggtcggagatgacggtggacgcgatgccgggcacggtgatgtaccgttgcatctccatgcagatgtcgatgaacggttcggtgtccgtgtcctcggcggtgaagatgaagctgtcgatgcgatgctgcgccgcttcgacgatctccttgcgccggtcgtacgccttgttgccggccgagccggtgacaagcgtgatgcgcgggtgctgcgagccgaaccgctcgtcgacgaaatcgagcagcgcggtcacggaggcgtagttgtgcgcgtagtcgacgatcgccagcgtgttggactgcgggtcgtggaactgctccatgcggccggcgatgcgcaccggctccatcgcgtgcgtggccgcggcgtcggcggtcaggtcgattccggcggcatgcgcgatggccagcgccgctgccgcgttggcgtagttgaagtcgccgtccaacgccagacggaactcgccgagatcagcgccgtctgcggcgatacggtaggcgctgtgctcggcgttcgccgggcttgcggtgacatcggcggcatcggatccggcggggctctgcccgtccagcagctcgaacgtggtgaccggcacgccggcgtccgccgcgtcctgacgcagcaggtcggcatgatcgctggccgcgccaagcaccagcgcgtggctgttgcgcacgatctggcgcttgcaatacaggtaatcctcgaacgtcggatgctcgatcgggctgatatggtcgggggagatgttcaggaacgtggccacgtcgaacgtcagcccgtacacgcgctcgaccttgtacgcctgcgaggagacctccatgacgaggtacttcatgccgttgtcagcggcctctcgcatcatgcggaaagcgtccatcgactcgggcgtggtcaggtcggactcgacgtacgtgtgcccgtccaggcagttgtccacggaggagaacagcgctgccttgccgtgcgagtgggcgttcagcacggcctgggtgaagtacgcggtcgtagtcttgcccttggtaccagtgatgccgaccacggtcagctcgtcctgcgggcgtccatagaactccgcggacagcaggctcatggccttgcgcgcgtcattgacgatcaggccgggtgcgccggtctctgccgaaaaatcggtgtcggccacgtatgcggccagcccgcgctcgtcgatgtcatgcagatactcggccttgaaccgccccttgcagcacagcagcgtgccctcgcgcacgtccctcgtgtcataggtgatcgccgaaaaatcggtgtcagccccttcgatgtcgtgcgcatcaagcgtccaacgatccgcgcggatgatctcccgaagcagaccgtgccgcttgagcagttgcgccgccgatgccaacgttaccgtcataccaaaacctttcctcatggtgccgctgccattgtacaagcccgacgaccgcgggaacgatatgcgcgacatgtgctgataagtccatcacaaaaccgtgcccacgctcacaatttcaccgcacgtcttgcatacaatagtgagcgtgaccgacgaacagcaaccgaacgagaccacggcgcaggcgcgagcgagattcgagaagctcgccatgcccgcggtcaacgcgctgtaccgccaggcgatgaagctcaccaacaatcccgatgatgcccaggaccttgtgcaggacacgttcgaacgcgggttcaaggcgttcgacagtttcgaggacggttcgaacttcgaggcgtggatgaccaccatcgagcgcaacgcatacttcaaccagtacgcgaaggcgaaacggcggccgcagcgggccaacgactccaccggcgaatacgacgactgggacatctacgcggcgtccgagcactcctcggaggggctgaaatccgcggagcaggagtacctggacgccttcgcgccgcaggagatcatggcggcgctcgcaaaactcccgcccgagcgccggcaggtgttcatcgacgcagccatcgatggcaagtcgtaccagcaggtcgccgacgagcagggcgtgaagatcggcacggtgatgagccgcctgaaccgtgcgcgcacccagttgaaacgcgaactgtcatcgtacgcgctggcgcacggatacggcgacgcccgcaagcaactgccaagttcaccgtccgcgaactccagatccccggtgagcgttcataatggagatgacggaatgcgatccgttgcgacgagcgaaaggagcaggcgtgagtgaccctattgagcggcacagccatatttccatcacacggcagacgcctgtgggcatcgtccatgcggatatgcatatcacatcggtggagatttcgggcatgcccggtgacatgggcgatgatctggtcggggactgtttcgacccggattcgtgttgcgacgagcatgagaaggcgatgatcgcggcgctgcgtgcgtatctgcggcccgaggtcgcgccggaatgtctgctggcgcggttgcgcgacacgcttgaccgctgctgctgcgaggatggcgggaatgctgccggtgccgtcgacgagccgggacggtccgcgcaacccgcgcagcctgtacgcggcgctgcggtcgtgtcctgagacgcgatttcggcttgggcccctgtctcgaagctcggcaagcaggataaaacgggcctgcataataaaacggaataataagataacaaacgggtctgcccggctttcgctgggacagacccgttgtcgtctgttatgacaccgccgtatatggcgatgtctcgcggcgtggaatcacgccgtcaggcaagaatcaggcgttcggccttttgccgtggttggcggccttcttgcgacgatccttgcgcttgcgtccgcgcatgcccatgatggactcctttactacgattaataagccttgggaattatcacatacggggtagacgttgtgcaagtggcgaattgtcaccggccgtaggacggccgggtgtcggtcacttgaccgtcacctcgtagcgtaccacggtcgtgacgctcttgccgggctctatcacggtcaggtggtcgccgctgcggaacgcgttggccggggcggtcatcggttcgacggcgatgccgttcggatgctggtcgaacggggcgccggtggccgtgtagcattgccacgcgttgatggtctcgtcgccgaccagcttgatctccatgccatcggggcgggtgaacacggtcgttgtcgtgccgtcgtcggcgcggtggacgtccacccaggcgtcgtcgaacgcgcgtccgtccagaaccgggtcgtcgcgcagatcgaacttggtgccgtccacaggctcggtgccgttcggcaccagaccggcgtcaacggtgacgtgcgtgtccgcgtcgatcttcaggcggcatgcggccgaatcggcgtcacgctgctcgctggtctcgccgtttttgccgttcgccacccacgggtgcaggccgagcgcccacggcgccggctcgtcgccatcattgcgggcgctgaccgtgacggtcatgcccttgtcgttcagctcgtacgtggcggtgacggtgacgtcgaacggatagccgtcgaggttcgggaagcgcagtgactgggtgacgctgttctcggtgagcgattccagcttccacatgtactggtatgcgtagccgtggttcgcgttgttgcgcggctcgggatgatactcgttgaccggcgcgcagtagtgcttgcagttgaagtcgtattcgccgtccttgatgcggttcggccaaggcgcgaggatatagccgcagcaggtcggcgtcaggtcgtccggtccgtagctgcagaacacctccttgccgccgtagtcgaaacggcgcagcttcgagccgagctcgcagacgacggcggagaaatcgccatgatggatggaatactggttgccggtacgcggtgtggtgcccattgcttgctccatgatcgacagtgatattgttaccgctcgctatcatagtgtgcgctgggcttctgccgtgtgcggtcggggtgtcgcctgttgcccccgggcgttgtcatgtgccggtatcgcacgtgtagggatgttccggccgcacccgtgcgtgtgcctttgctacgctgagtcgttgtgattgagtgatgccgcatggcggccactgactgcatgaggaggatgatatggcgaaacgcatcgtgctggcggacccgcgcggattctgcgccggggtggaccgggcgatcctcaccgtgcagaccatcctgaaggccgcgtcggcgcgggtggatggcctgccgccggtgtatgtgcgtcgtcagatcgtgcacaaccggcatgtcgtcgaggatctcgccgcgcagggggccgtgttcgtgcaggagctcgcggagatacctgacgaggctgctgccgccggcatcccgatcgtgttctccgcgcacggcgtgtcgccgcaggtcaaggcggaggccgcacgccgcggcatgcacgtcgtggacgccacctgcccgctggtcagcaaggtgcatcgtgaggtattgcgtttcgtgcgcgaaggctacgagatcatctacatcggccatcgggggcatgatgaggcggtcggcgtggtgggggaggaccccgtgcacgtgcatctgatcgaacatgaggcggacgtggattcgctggatttccggccggagcagaagctggtgctgctcacgcagaccacgctcagcatcgatgagacggccggcaccatcgcggcgctcaagtgccggttcccgtggatgaaggagccgccgagctccgatatatgctacgccacgtccaaccgccaggccgcggtgaagctcgttgccgagcagtccgatagcgtggtgatcgtggggtcggcgaactcctccaactcggtgcggctcatggaggtcgcgcagggggcgttgggggagcgcgggcgagcgcaccgcgtggatgacgcgaacgagctcgacccgtcatggttcgacggggtcgaggcggtcggcatctcgtcgggcgcatccgtgccggacgaactggtcgcgggcgtcatcgaggccttgcgcgcacagggcttcaccgatgtatccaccgtggagaccatcaaggagaacatgcatttcgtgcttccggcggaactccgccggaagccctcgcaggcgcggtagtgcgcctgctcgcctcatcgccgctggcgggacgaggcgtatagcaaaccctatgtgagggtgttcaacgccaatgacggggccgccacggttcccggcatcgcggcgggggagtgctccacactcgcggtcgacggcaaggtgacgctgacgggaggctccacggtgaacgtgggcgctgacgggtatgcggcggcgggactgtccgccaccggtgcgcccgtgggcgccgtcgcgcttgccgaccgcagccgggtccttgctgcgacaccgtgaaaccagtggcccaagcggcggagaatccgccgaatagtcgaggccttcccgattcgcgctctcaaaactcgcagatacgaaaagccgtttgttggaaaatggcggtttccgatttcgtatcttcgagttttgagagcggtagtatggaagacatgggcaaaaaaacgaagcatgagaagggtgccggctccacgccggcgactgtgcagctggagaaggccggagtgccgttcaagacctacgagtacgagcattccaacgaccacatggatgacggttacggggtggaagccgcgaagaagctcggattcgatgagcatcaggtgttcaagacgctgatggccgacaccggttccgagcgcgtggtgggcgtggtgccggtcagcggacacatggatctgaaggcgttggcggcggcggtcggtgcgaagaaggcatcgatggccgacccgaaggtcgcgatgcgcgagtccggctatgtggtcggaggcatctcgccgctcgggcagcgcacgcatcacaagaccgtgcttgacgagagcgctctgcaattcgacgagatcctgctgtccggcggcaagcgcgggttttcggtcggcgtcaatccgcatgatctgctcaaggtgttgaacgcggtcgctgcgcccatcggtacgtggtgacggagtccggctcagcccgccggcaagtgccgagccggtaaaaacaaagggtttatggtttgggctcccacagcgaagcactgtgggaacccaaaccataaaccctttgtggaatctagcggcctagaccgcggggattcactcggagatctcggcgaagtacagcagggtacggatcatgttgcaggtgaagccgtactcgttgtcgtagaaggacacggtgcgggccatcgtggtgccgtcaacggtgttcacgtcggtctgcgtcgggtcgaacacgccaccgtgggtgtcgccgatgatgtcggaggagacgatgccgtcctcgttgtagccgtagtactcggtgttggagaaggcttccttgaacgcggcgttgatctcgtcagcggtgacttccttgttcaggacggtggtcagctcggtgatggagccgtccgggacctggatgcgctgggcgtggccctgcagcttgccgttgacctcgggcacgaccttgccgatggccttggcggcaccggtggagtgagggatggtgttgatcgcggcggcgcggttgttgcgagccttcgggaagcgcgggccgtcgaggatcatctgggtgccggtgtaggcgtggatggtggtcatgaagccgagcttgatgccgaacttgtcgttcagcagcttgaccatggcggccatcgagttggtggtgcaggaaccggcggacacgatgttgtcggaagccttcaggatctcgtggttaacgccgaacacgacggtcggggtggtctcgtccttggccggggcggagatcaggaccttcttggcgccggcgttcaggtgggcctgggacttctcggcggaggtgtagaagccggtgcactcaagcacgaactcgacaccgtcgttcttgacccacgggatgttgttggcatccttctcggcgtagaccttgtattccttgccgtcgaccacgatggcgtcgtcggtggaggtcacgtcgaccggggtgccgtcgtcgtgacggaaggtgccgtgggtgctgtcgtacttcagcaggtaggcgagcatggacggcgtggtcagatcgttgattgcagcgacctcgatgtcaccggcctggccaccgcgagcctgcagctcgaagatgcggcggaaggcgagacgaccgatacgaccaaagccgttgataccaatcttaactgtcatgtgttctccctttgtagggtaggccgtttgcgcatggatgcgctacggcctttgtttaccaacagtgtctactgtaatgcgccgtctgtactagagcaacggtgtcgcgcttgctttgagcataaaacggccatattccgttaacgctaacaaatatgtctgtgcagcctgcggcgattcgatgcgaggcattccgcaccgcggcctcaccgcaccgccagcgccgaggacaccgccgtgtcgagcgtgcccagatccccgccgaacggatgccgcagtctcaccgcaggcagcggcacctcgatcgggaacgtgacgatcagcgtgcccgactccaccgagaccgtcgccgcggaaccgtccacgaactcgttgctcaccccctgcacgacggtgttggcgagcgcggcgccctccagcacgtatttcagcccggcgatggtgacgccatggcagacgtcgctgtgcgagaacaccgagatcatgcggcgcggggcgacatgattggccgggaactccagcgccccgtccgcgatcgcggtaacgatgctgccgtcgccgtacagatatccgatgccgccatgcgaggccagtagcgccatcagctgcatgttggcgatcgtgtggtcgatgcgaccgcccagcgctccatatatatggaactcgcgtgcgccgcggctccatccgaccttcagcgcgctcagcagatccggatcgtccttctgcggcggcaggcggacgctgcggtcgccgtccggcacgtcgccggacagcgaatcgaaatcgccgatgacgaaatccggcgacagccccatcgcccgcatatggtcgagcccgccgtccgcggcgatcgccagcatccccttctcgatagcgggcgcgggcccctcgtaatactcgccggcgccgaaaatcacgcaacgttcatatgccatgctgccactgtatcgtgtgcacggcactgcgcgtcgcgcctgctgatcgtcaccgtgtcgacgaacttcccggtcatcgccgcgttagctgcatgccgatcttcgtgccgccgctattcctgctcggcacggtcacgccgggcctcaacaagttcgcggccgactcgctggggaacaacgcctccgtcgtcggacgactgtccgcctgcaatacggtcggctcgattctcggcaccttcctgccgaccttcgtgacgatccccgcggtgggcacgttcgtgacgttcccgatcttctccggaccgcttctggcatcggcgatgggcgaggtggcgggccggttcgagaccatcgccgacccggacggcaagccgggcgccacgatcctgaccgacgacaaggcgccggtcgatggcttgcctgcgcctggaccggaacttgtggcgacacgcccggtctgggggtgtggtagtatctacaaggcttgagaaatcaagaaagcggggcaaccccacctggaagcctgtcatggcctcgggtccaaggcaatagcctatccggtcgcgtggaatgcgcggtcgtgagcatgcctcatgaggcatgcgatcatgcgaatatgtatgatggccggcgctgcagtgcgcacggttcggtgagccatggattcgtccgtcatgcccggtatccggcgaaggtccgcttcggagaacatgaggattggagtcatcattagcgacgaaccacgtatcaatgacgagattcgcgtctcgcaggtacgcctgatcggcccgaacggcgagcaggtgggagtcatcgcgacctcggtcgcgctcaacctggcgaaggaagcgaacctcgatctcgtcgaggtggcgcccaacgccaagcctcccgtcgccaagcttatcgattacggcaagttcaagtacaacgagaagatcaaggcccgtgaggcccgccgtaaccagagcaccgccgaaatcaaggagatccgcttccgcctgaagatcgatgaccacgatttcgaggtcaagaagggccatgtggtcaggttcctcaacggcggcgacaaggtcaaggtgaccatcatgctgcgcggccgcgagcagtcccgccccatcggcggcgtcgaactgctgcagcgtctggccgcagacgtcgaggagtacggcaccgtcgagtcccggccgaagcaggaaggccgcaacatcatcatgacgcttgcgcccaagggcaagaaggtgcacacccagtccgagcagcgccgccgcggcgaccagtcgcgcgccgagcgccaggcccgtcaggccgcccgcctcgccgccaagcaggaggcgcagagccaggcagcggcggcgtccgcagccgcgatcgacgaccaagacaagacttccgaaacgaagtaaccaacaaggagggcagcaatgccgaagatgaaaaccaattccgccgcgtccaagcgcgtccgtgtcaccggctcgggcaagctgatgcatgcaggcagcgccatgcgccacaatcttgagcacaagtccgctcgcaagcgtcgtgcgctgaaggccgacggcgtgctggccacggcccagtccaagaacatgaagaagctgctgggccgctgaaccgcgccagccgaatagatacgtcaaaagaaagctgaggaataactatggcacgtgtcaagcgcgcagtgaacgcccacaagaagcgtcgcgtcgttctcgaaagggcctccggctaccgtggacagcgctcccgtctgtaccgcaaggccaaggagcagctgctgcactcctttacctacaacttccgcgaccgcaaggctcgcaagggtgacttccgcaagctgtggatccagcgcatcaacgccgccgtccgcgccgaaggcatcacctacaaccgcttcatccagggtctgcacctggccggcatcgagctggaccgccgcgccctcgccgagctggccgtctccgatcccgagaccttcaaggccatcgtcgagcaggccaaggccgctctgcccgaggacgtcaacgctccggtcgaggcctgagccgcgaacctcggcggatgcgccttcgcgcgcatcggcaaccgcatgagaaccccgccctgtgcggggttctcgcatatcatgcgggaacgtgcagatatgcaagccttccgcacgcatacagggttctcgcatatgatggggcaccatgtacaacggatccacccggcttcttgaccagttcatcgcgcatatctccgtcgaacgcggactggccagggcgaccgtgcgggcatatgaatccgatcttcgccgctatctctcgtggctcgcgcacacgcgcggcatcaccgatcccgatgccatcggcaaagccgacatcgaggagtacgtggcgcagctggattcggacggcgacagcgcgcgcagcaaggcgaggaggcttgccagcatccacgagttccaccggttcgccctcgctcagcacgccgtgagcgacgacgtgtccgccacggtcaaggcacccaagagcgcgcagatgctgccggatgtgctgacgatcgacgaggtctcccgcctgctcgacgcgattcccgacccgcacggcaccggcgcggcgcgggggagagctggcaccggagcgttgccggacgccgtgctgctgcgtgacagggcgctgctcgaattcatgtacgccaccggatgccgcgtctccgaagcggtcggaatgaatctggacgacatcgacatcgacgacgcgcatgtggcgcggctgacgggcaaaggatccaagcagcgactcgtcccgctcggcgaatacgcatgtcgcgcgctgcgccgatacctcgccgaggggcgcggcacgctggagggccgcgccaagggcacgccggaacgccgcgcggtattcctcaacaaacggggacgccggctgtctcgccagtcggtatgggaggtcatcaaactggcgggggagcgggccggcatcgatcgtccgcttcacccgcacacgctccggcactctttcgccacgcacctgatccagggcggcgccgacgtgcgcaccgtgcaggaactgctcggccatgcctcggtcaccaccacgcagatatacacgcacgtcagcccggagaccttgattgaggcgtacctcacctcgcatccgcgcgcgcggtgaacgcggagcggttgcccgggcgcgatagcatggatgcgacacgcgaaggaggcagctcgacatgcagcaggcggcatattcccgcttcgacggcgacgacgcgggaaacaggcaggggacgctgccgatccgcggcacctacgccgccgcgccacggggagacgacgggtcttcggcggaaacggtgatggtcggcacgtccggcggccccgcgcacactggtgatgataaggtgaacggtatgcctactgatctgcttggacgagaatacgagacgttccccgcgccgaaaccgctgtcgcagcacggtcccgcgcgcatcatcgccatatgcaaccagaaaggcggggtgggcaagaccaccagttccatcaacatcgccggcgcgctcagccagtacgggcgccgttgcctgatcgtcgacttcgacccgcaaggagccgcgacagtcggcctcggcatcaacgcgaacgctgtcgagaacaccgtgtatactgcgctgttcgacccgtcgatcgatccgcacgagatcgtacagcacacggatttcgagaatctggacatcatgccggcgaacatcgacctgtccgccgccgaggtgcagctggtcaccgaagtcggtcgcgagcagatcctcgccagcgtgctgcgaaagctccgcagcgaatacgacgtgatcatcgtcgactgccagccgtcgctgggcctgctcaccgtgaacgccttgaccgccgcggacggcgtgatcatcccggtcgccgcggagttcttcgcgctgcgcggtgtggcgctgctcatgcaatccatcgagaaggtgcagtcgcgcatcaaccccgacctgcaggtctacggcgtgctggtcaccatgttcacgcgcaccctgcactgcgaggaggtgctgcagcgcatctacgaggcgttccaggacaaggtgttccattcggtcatctcgcggtccatcaagctgccggacgccaccgtggccgccgccccgatcacgatctacgctcccggccacaagaccgcgaaggaataccgcgaggtgtcgcgcgagctgatcgcccgcggcatcgtcgcgtgatggcgcggccatggtgagcggcgcaagcgcgatgcgatgagcgagttgacggaacctgccgacggcggcgggatcggaggcgatgccgccgtctccccgggattctccgtcgaactggaggtctattcggggcctttcgacgcgctgctgtccatgatcgcgaaccggcggctggagctcaccgaggtgtcgttgtcggagatcaccgaggagttccttgcctatgtgcgcacgctggatctcgcgcgcaacatggaggaggcgagcgcgttcctcgatgtcgcctcggtgctcgtcgaggcgaagagcgcggcgctgctgccgcatgaccaggcggatggggagcgcgacgagcagagtctcgaagcgctgcgtgagcgtgacctgctgttcgccaggctgttgcagtatcgtgcgttcaaacaggcggccggcgattttcgcgcccggctcgctgccaatgccggcaggttcccgcatccggcatatgtcgatgaacgtgtcgcggcgatgctgccggagcttgcatggtcgctgggcgcagaggacttggcgcgcatcgccgcacaggtgttcgccaacgcgccggccagcgaggtgtcgctgcatcagctgcatgtgccgcttgtcgacctgcgtgcgcaggcggcggtcgtgcgcgaccggttgcaggcgttgccggccggcggttcgatgacgttcgcggaattgacgcgtgacgcacaccgccgtgtagaggtggtcgcgcgttttctggcggttctggtgttcttcaagcaaggcgtgctgcagtttcggcaggccgggccattcgagacgctgcatctgcgctgggtcgaagacgcccaggacgccggtgtggtcgacatcgcggagggggacttcgcatgaggctcgcaaaacgtgaagatacaggcggcatcgtattggaaaatagcggtttggttttttatatctcgacgttttgtgagcgagaaaggtgacgtgatggatgcgcaattcacggcggaggactttccgggtggtctgagggcctgcatggaggcgattctgatggtcgtcgaccagccgcagcacgccgccgacctggcgcgggttctgggcgtgggcgagcaggaggctcgtgccgcgctggagcgtctgagctcgcagtatgacgaggaggggcgcggcttcgagctgcggcataccgcgcgtggctggcagttcgcgagccgggcgcaatacgagcaggtggtgtcggcgttcgtgactgacgggcagaccgcgcgcctgtcgcaggcagcgttggaggcgctggccatcgtggcgtacaagcagcctgtgacgcgcgcccaggtcgcggcgatccgcggcgtgaactccgacggcgtgattcgttcgctgaccgtgcgcggactggttcgcgaggatggcgtggacgaggattcccgggccgcgctgctggtgacctccggcctgttcctggaacatctcggattggagtcgctcgaccagctgcccccgctcgccccattcctgcccgaacgcgagaccaccaacgtccccgacggcgaataggagttgccggagggctgtcggccgtaagccgactggggtggtcggtgtttcagcgtatgtaggttatgccgcctccgcggcctcgcatgacacaccacttaaagtcatgttgactataagtgatatgctctggtcttgaactggagagcacaccagtcggaaagtgggcatgcatggtcggcggaaacgtgtcggagcggcggatgcaaccgccggccgtcggggtctccgtggtgatcctggccctggggccggaggagaccgcgtcggattgccgtgacgcgatgccctcgcgtctgtggctgccgctggtgcgccgcgtgcgccagccgtttctggggcggtgggcgctgccgggcggcgatttgcgcgccgaccgttcgctggagcagtccgcctaccacgcgttggagaccaccacggacctgcatcctcgctaccttgaacagctgtatacgttcggcgatcccgcgcgatcgcacggtggcctgccgatggtctccatcgtctactgggcgctggtcggcaaggccgaagcccatgatttcaccgaggcggacaacgtccggtggttccccgaggacgagcttcccgaactggccttcgaccatcggcagatcatcgactatgcgttgtggcgcctgcgcaacaagatcgaatacccggatatcgccaccaagctggtcggtgacacgttcacgctgcgccagctgcatcacgtgtatgaggccataaccggcgaggccatcgacgtggcgaatttccggcgtcgcatgctgttgtccggcgagctggaggataccggcgagaaactgcgcgatggccgccaccgcccggcggccgtgtaccggtacaaccccgaccgttcccgcgcgtcgacggccccacccgtcgggccgccacgcgacgcgccgaccatcgaggagctggaggaccagcgcatcgaggacgcgctgtccgcgttgatgccatcggcacgcgcatgacgggaggcgggcggcaagacccgcgtccgtgccgtataaccgcatattgattttggccggccacccggttgtcagatacgttggcgtgcccgcacgccttagagaaaggaacacaccatgagcgcaacattgtccgccctgtcagtggatgagatcatcgcccgcctcggtgcgcagagcacctgcgacgccggcctgacccaggatccgtggcatttcgacaccaccaagcccagctacgggccgggcgcgtccatgctcgacaagctgccgcacaacgcgcctcgccagcaggtgctgccggaggagtaccgcaacgcctccgacgaggagctgcaggagcgcattcgctcggccaagtcccgtctcggcagcaagctactgattctggggcatttctaccagcgtgacgagatcatctgccacgccgattacgtgggcgactcgttccagctggccaagaacgccacgcagtgcccggacgccgaccacatcgtgttctgcggcgtgcatttcatggccgagaccgccgacatcctctccacgccggagcagaccgtgacgctgccgaacctctccgccggctgctcgatggccgacatggccaacatcgaccaggtcgaggaggcctggaaccagctcggcgagatctgcggcaccaagcccgacgcggatggcaggcagcagatcatcccggtcacctacatgaactcgtccgcggccttgaaggcgttctgcggacgcaacggcggcatcgtgtgcacctcgtccaacgcgcacgccgtgctcgaatgggcattcgcgcgcggcaagcgcgtactgttcttccccgaccagcatctgggccgcaacaccgcccgcgcgatgggcattccgctgagcgagatgccgctgtgggacccgtacaaggcgcagggcggcgcgaccgacccgtccgactacgccaaggccaagatgatcctgtggaagggcttctgctcggtgcaccagcgcttcaccgtcgaacagatcgagaaggcgcgcgccgcgttcccgggcgtcaaggtgatcgtgcacccggagtgctcgatgcaggtcgtggacgcggccgacggcaccggctccaccgcgtacatcgtcaaggagatcgccaacgcgccggccggatcggccatcgccgtgggcaccgagatcaacctcgtgaaccgcctggccgcgcagtaccccgacaagaccgtgttctgcctggatccggtggtctgcccgtgctccacgatgtaccgcatccacccggcgtacctcgcctgggcgctggagaacatcgaacagggcaacatcgtcaaccgcatcaccgtggacgacgacaccgcacgcgaggcaaaggtggctctggagcgcatgctccaggtgcacccgtgatcgcaagctcccgtcaacgggagcacatcaacaatattgaggaagcagcacaatgagcaacgctgaaatcgtcgtagtcggcgcgggcgtcgcgggcctttccgcggcgctggcggtggccgatgccggccaggacgtgacgctggtcaccaaggccgacctggtggaatccaacacctaccatgcgcagggcggcatcgccgcggcggtcttcgccgacgacgacccgaaactgcacgcggccgacacgatggccgcggggcatggtctgtgcgagccccgtgccgtggagatactgacccgcgagggcgccgaccgtgtgcggcagttcgccgccgcgggcgtgcatttcgatcgtgacgcgcaaggccacatgctgcgtggcctcgaagccgcgcattcgcgggcccgtgtcgtgcacgccgggggagacgccaccggcaaggtggtcgaactggatgtgtccgccatggtgcgggccaatccgctcatccacatcatcgagcatgcgttccttgaggatttgattgtgcgcgacggcgccatcgccggcgtgcggctgctcgtcaggggcggcgagacattccgcagcgccgacatggccgcttcacgcgtcatcctcgccaccggtggcgccggacgtctctacccgtacaccaccaatccggccgtcgccaccgcggacggtctggcggccgcatggcgtgccggcgcacaggtcgccgacgtggagttctaccagttccaccccaccgcgatggccgtgggcgagcacttcctcgtttccgaggcggtacgcggcgagggcgcggtgctgctcgacgaacacggcgaacggtacatgacccgtgtcgacgagcgcgccgaactcgcgccgcgcgacgtggtggcccgcgagaacttccgcgtcatgcaggcgcagggcggcaagcccgtgatgctcgacgtctctccgatgcgccgcgagaacccggatctggccgagttcctgcgtcaccggttcccgaccatcgacgcctatacgcgttctctcggcttcgactggagcaaggagccgattccggtcgcgcccgccgcgcactactacatgggcggcatccgcaccgatctggaaggtcgcgcgagcatccccggcctgtatgcggccggcgaatgcgcccgcaccggcgtgatgggatccaaccggctcgcgtcgaactcgctgcttgaaggactggtgtacggtcgtcgcgccgggctcgccgccgtgaacgatccggccggttccgtgtggaacccggtctggttctccaactcggccaccggccgcatcgtcagcgacacaccggtcgagctgagcatgccggcacccgatgagcgtgccggggccactggccggcctgccatctgggatcgcacccgcatccagaacacgatgtgggccggcgtgggcgtgttgcgcgacggcgacggcctgcgccaggccatcgaccagctcggcaccggcctggcgttggccgatgccgacgcgacggaacccgctgccacggcctgtgagcctgacccgatcacccgcctggaaaaccgcaacctgctcaccgtcggctacgtcgaggccaacgccgcgctgcgccgcaccgagtcgcgcggcgcccacgcccgcaccgactatcccgagtcatgcgacgagtgggcccaatccatcgcctacatcaacgcctagcgctgtttgctcacttgtcggttggcaccggactgtcgttgcacgccgccggagtggtctcggtaccctgacccgatgcattgcgattaatcccgcaagaacgacagcagtccatatcaagaaagacccgatcatgcttacgcaacacatcatccgcaccgccgtcgaggcggcgctcgccgaagacgcgccctacggcgacatcacctgcgagaccacaatccccgcggacgaaaccggctcggcgcacctcaccgcacgcgagagaggcgtgatgagcggcatcgccgtgttcacggccgccttcacggcgcaaaatcccggtatcggcgtctcgcccctgatcgcggacggggagcgattccagcgcggccaggtcctcgccaccgtggaaggtccggtacgtgacctgctcgccgccgaacgcatcgccctcaacttcacccagcgcatgagcggcatcgccaccatgaccgcctccttcgtggacgcggtcaacgccatctacgatgacggacatgacgggaccgtcacccggccgcatcgctacgagcgcactcgcatcgtcgacacgcgcaaaaccacccccggcctgcgcccgttcgagaaatacgccgtggtctgcggcggaggccacaaccaccgttacgggctgtccgacgcggtgatgatgaaggacaatcatctggcggcgctcgccgcacgcggcatcgacctgaccggcgcgatccgccacgtgcgcgaacaggtgggccacaccacgcatatcgaagtggaagtcgaccggcttgagcagattcccgccgtgctcgccggcggtgcggacaccatcatgctcgacaacttctcgctcgatgacacccgccgcggcgtggatatcatcaacggcaaggccatcgtggaagccagcggcaacatgagcatggagcgcgtgccggccgtggccgccaccggtgtggacgtgatctcagtgggcgcgctgacgcacagcgtacgcagcatcgacctcggattggactggaactagccatggctgacactcccaatgcatccggcgaacccgacgaactgtatctggacgccgctgccaccgagccggtgaccaggaacgtcatcgaggcgatgatgccgttcatgaccgacgcatacgcgaacccggcaagcgtgcatcaacccggcaagacggcggcgagggcgcttgatgccgcccgcgcctcgttcgccgccggtctcggcgcccgcccggacgacgtgatcttcacttccggcggcaccgagtcggacaatctggccatcaagggcatcgccatggcacgtatgcgtgcactcggcctgcagccggtctacggtcttgccggaatcgatgacgagccgtccggcgtggaccccgcacaggccggtgaacatccggcgatccgccgtccgcgcatcatcatctcatccatcgagcacccggccgtcgcgcaatcggcgcaatggctgcacgaatggttcggcttcgaagtcgtgcacattcccgtggacggtcaggctcacctcgaccttgacacgctcgaacaggagctcgacggcgagaccggtgaacgcaccacgctggtttccgccatactggccaacaacgaggtcggcaccgtcgaacccgtggaggagctggtccgcatcgcccacgcgcacggggttcccattcatgtggacgccgtgcaggcggccgggcagattcccatccgcatgcgcgattgggatgtggacgcgctgagcgtgtccggacacaagtttggtacgcccaagggactgggggcgctgctggtccgcggtcgaaccccgatcgagccggtgctttccggcggcggtcaggagcgcgggctgcgctccggcacgcagaacgtggccggtgcggtggcgctcgccatagggctcaacgagtcgaacgcgcgcatggcggcgcagtaccgggagctgacggattcccgcgacatgctgattgacgccgtgcggcgggtggtgcctcgcgccgaactcaccggcgacccggtcagtcgtctgccgggacatgcgtcattcattttccccggagtcaccggcgaagctctgcttgtcgatctggacgcccgaggcatagccgcctcgtccggatccgcttgcgccattggccgtcacgagattcccggcacgctgcttgccatggggctgaaaccgcagatcgccagatccgccctgcgtatgacattccgccgtcccctcacacgggaggaaatcgagcgcatctccatggccttggaagactcctacaccgagctgacgcattagtgcacatggtctccagtcaacgatccctgcgggggcaacgtgtgctgttactcgtcggaggacggttcggttgtgtgtcaaggcgtatcgctaggcttgtgccggtttgcgtgtaagtacagatatgaaccaaaacaagtaccgaacggttacgcgaagaatcaattaagagaggtttctatggcggttcgcggtgatattcgtaatgtggctatcgtggcacacgtcgatcacggcaagaccacgctggtaaacgcgatgctccagcagtcccacgtgttcaacgagcgcgaggaggtgccggatcgtgtgatggactccaacgatctggagcgcgagaagggcatcaccatcctggccaagaacacggccgtggaatacaccggtccgctggcggccaagtacggttacccggacggcatcacgctcaacatcatcgacacccccggccacgccgatttcggtggcgaggtcgagcgcggcatctcgatggtcgacggcgtcgtgctgctcgtcgacgcttccgaaggcccgctgccgcagacccgtttcgtgctgcgcaaggcccttgaggccaagctgccggtgattctgtgcgtcaacaaggtggatcgtccggacgcccgtatcgaagaggtcgtctccgaatccaccgacttgctgctgggcctcgcccaggacgtcatcgaggaaggcgtcgacctcgaccttgaccacctgcttgacctgccggtcgtctactgcgcggcgaaggccggctacgcgtccgtcaaccagcccgagaacggcggcctgccggacaacgacaaccttgagcctctgttcgaggacatcatcaagtacatccccgcccccgaatacgaggagggcgcgccgctgcaggcgcacgtcgccaacatcgactcctccgacttcctcggacgactcggcctggtccgtatctacaacggcacgctggagaagggcaagacctacggcctgtcccgcgtggacggttccatcgagaacttccgcgtcgtcgaactgctgcgcacgcagggcctggagcgcactcccgtcgaatccgccggccccggtgacatcgtcgccgtcgcgggcgtcaacgacatcatgatcggcgagaccatcgtcgacccgaacgacccgaagccgctgccgctcatccacgtcgacgacccggccatctcgatgaccttcggcaccaacgactccccgctggccggccgcgaaggcaaggaccacaagcttaccgcccgcatgctcaaggatcgtctcgaccgcgagctcatcggtaacgtgtcgatcaaggtgctgcccaccgaccgccccgacgcctgggaagtccagggccgtggcgagctcgcgctggccatcctcgccgagcagatgcgccgcgaaggcttcgagctgaccgtcggccgcccgcaggtggtcaccaagaccatcgacggcaagatcaacgagccgatggagaacaccaccatcgacgttcccgaggaatacatgggtaccgtcacgcagctcatggccgaccgcaagggccgcatggactcgatgagcaaccacggttccggctgggtgcgtctgcagttcaccgtgccgtcccgtggcctgatcggcttccgcaccgcgctgctgtccgccacgcgcggcaccggcatcgcctcctcgctgtccgccggctacgcgccgtgggccggcgccatcgtcacccgccagaacggctcgatggtttccgaccgcgccggcgttgccaccccgtacgccatgcagcggctgcaggcccgcggcaacttcttcgtcgaaccgcagtccaacgtgtatgagggccaggtcgtcggcatcaacaacaagccggacgagttggacgtgaacatcacgctggccaagcacatgaccaacatgcgttcctccaccgccgacgtgctggaaacgctgactccgccgatcaagatgagccttgaggagtcgctcgacttcgcgaatgaggacgagtgcgtcgaggtcacccctgaggcgattcgcgtgcgcaagatcatcctcagccgtgaggactggtacaagtggcgtgccaagcagcgtcgtcagaacaacaacgcctgacggcgttgccgttctgacgaccgtcgcgggcgctgattgcgcgcccgtctgcttgcttctgattacggagagtccattgggctctccgtttttgtttttcgaggggctgttctgacgggtctgtgtgccacaccaggccgatttcggcgtttttagggctggtgtggtacgacggaaattcctgcgattgggacgaatgtttgttcatcgttgaaaaatggcggtttctatgattttgcctgttgccataccagcgaatgttagggctaacattccattgtgtggcaatatgttggccacacaatgcgatttttgcctgttttgacgctggtgtggcatgttctgcggcagcggcatggtgttatgtcccgccagcgggggcaagatatgagttcgccgggccttctggcctgtaattggatggcctgcggacacggcttccgctgtttgccatacggctcattgcgccagcggagcgagatttcaccgcgccgatacagcgcatctccttatactggtgaccatgactcaatcggatgatcgttcaattctgccttggtctcatcggctcagccccgtgctgcgcggactcgtcaccgtcgttgccggcatcctgtgcggcatcgtcggcacgttcgcgcatcgcatgggcgcttcggccaacattccgtatggactggtgctcgccttcctgattcttggcatatcggcgtggtgtgcacgctcgcggcttgacgtcgtcggtctcgccctgcacctgatcgcctcgtccggcacggtatggctgatcgctgtgcaatccaccgacgacgcgttgacgccggtcggattcagcggatcatcggtgccgtatttttcccagcgtgtgggatacctgtggctgatcggctgcatcgtcgtccagctgatgctgatgttcctgcccgcgcgatggttcgccatcacgcccaagaccgatggaaagaccgacgacaagaccgacgacaagaattcgcagcagccatcgcagctgtccgtgtcccggcagactcccgacacgctggcggagagccgatgatggccgagtatacgttgcatttcctggggccgaccgggacgttcacccatcaggcggcgatcgaggccgccaagacgatccgcccatccggcgcatccgtgacgctgacacccgagccggacgtcccgacgattcttgacgcggtgcagcgtcggggtgactggggcatcatcgcgtgggaaaacaacgtggaagggtacgtcgtgccgaacctcgacgcgctcatcgacgctgacaatgtggtcggattcgcccgagtcggcgtgaacgtgtcattcgacgccttcaccttgcccggcgcatcactcgccgattgccgtaccgtcaccgcccatccgcacgggctggcgcaatgccgccgtttcacggccgaccatcagctgcagcagctgccggcatcgtcgaatggtgccgcctgccgagaccttgagcccggccaggtggcgctcggaccgagcatctgcggcgatttgtacaatctgacgcgcgtcgcctccgccgtgggcgactatgccggcgcgcgcaccgagttcctggcactcgccccgcgggacgaggccatcaccgtgctgcgcgagcgggcatcacggacggccggggatgagaccgtgggatcgatgccggctccgggggcgacgaccgaccccgtttcggaatacgaatcgatcatcgcgttcataccgctgagcacaggccccggcgtgctcgcgaatctgctggacgtgctgcgcgacgccggtctgaacatgacgagtttcatatctcgcccgattaagggacgcgacggcacgtacagtttcatcgcgaccatcgatgcagcgccctggcaggaacacctgcgcgacgtgctgacacaggtcgtcgaccatggcgattgggtgaagacgctggcggtgtatccgcgccgcgaacggccgaacccgccgatctacgcgtggtcgctgcccaacgggggagtgcgccgcgagccggccgcgcccggcacatggacggaaggcgacactgcgcgaagggaattgctgtggtaggaagtcatgatactgcggccgccgtacggctcacggtcggagtcatcggactcggcctgatcggcgggtcgctggcccgaaggctcgccatccgcggggtgtcggtcgtcgcgtggaaccatcgcccgcatccatacgcccaggccgaagccgatggcatacgctgcatgcgcacgctcgccgaactggtcgaagcgcagccggaggtcatcgtgctgtgcaacccgctgaaggcgatgccggcgattctcggcgagttgcggccgctgctcgaaccgtatcaggacatcacgctcaccgatgtgggcagtgtcaagatgatggtccgcgatcaggtgcgggacgcgggtctggcgggccgctatgtcggcgcgcacccgatggccggcaacgagctctcgggatgggccgccgctgccccggcgctctacgacaacgcgctgtgggccatgaccgtggatggcgacaccgattaccgtcgttttctcgccgtcgcgcggatgatcaccgacgatgcgggcaaccgcgtcatcgtgctcgacgacgatacccatgaccgcgctgccgcgctgatctcacacatgccgcacgtcgtcgccacggcgctcatcaaccagctgaccgacgacccggaccgcaacatcgcagctgcgctcgccgcgggaagctggagggacatgacgcgcgtcgcgctgaccgatccggaccgcacccgtgcgatggtcgaagaggacgccgacaatgtggaacgactgctgcgcatgatggcggcgcggcttaccgaggtcgcggacgaattgcatggcgcagatgcaggtgccatcgccgcgtttttcgcggatggacagccgttccgcgactacaagtccgcggtcagaagcggtgcggacggggacgggccggtcttcgacctgacgatacccgcggagggatggcaggcggcactgctcgattccgcccgccgcggcgagcatatcctgcgtttcggcgacgactataccgcctgcgtgcagcgtcgcagcgcgatgtgatgctgcgggctacttgacgatagaccacccctagtcggccacgggctgactaggggcttgacggcaccacagctcaggggcgggtgaagtggcgttcggggacgggtttgagggtgatgatggtgtcggcgtcgatggtcacgcgatgttcggggcgtgacccgttggccgccgcgtcgcggatcatatccaacgtgtgaccgtcccatgaggtgacgtgtccgacgtaatcgcggtatttcatgcgatggtcggtcggatcgaccccttcggacactcggacgaccactcgcgcgttggcagggatttcattgggaattgccatggggactcctttgccgtcggtttgttccattctagtgggtgaaacgcggttttgcgggatagaatcggcaaagaaaggagtgtgcatggatggcgatggtgatctgtccgcgttccttgcgtatctgcgggccaacaggggattgtcgggcaatacggtgaaggcgtacggcaccgatgtcagggagtgcctgcatgcactggcgtcgcgcggcatcgcagatctgcgtcaggtcacgaccgacgacctgcgtggatggatggcgttcgagacccgcgaccacgcccgctccagcatggcccgcaaggtcgtgtcggtccgttcgtttttcgcttgggcgcatgagcatggcaggatcgaggccgatccggcggccgtgctgatgacgccgaaactgccggacacgttgccttcggtgctgactgaggcccaggcggagcgcctgatggaccgtgtggatgacgatgcgtcgctgcatgccgcctcatcgcagcgttacgagacacggcatgatgagatgccccgccttgattcggcccatcggggcgaagggatgagtcagcgtgacgaagtcgtggcgctacgtgatgcggccatgctggaattgctgtacgcgaccggtatccgcgtggcggaactcgtcgggctcgacatcggcgatgtcgactggtcccaccgcacgatacgggttacgggaaagggcagcaagcagcgcgtggtgcccttcggcgaccctgccgagaaggcgctggccggctggaaggagcatggccgaccattgatattgcgcagagccggtgcgggcactctcgatacggccgcgttgttcctcggcatgcgcggccgccgcatcgaccagcgtatcgtgcgcgatgtcgtgcatcgtgccgcccgcgagagcggggtgcccgatatcagcccgcattcgctgcggcacagcgcggcgacgcacatgctggacgggggagcggacctgcgcgaggttcaggagatgctcggccattcgtcgttgcgcactacgcagcggtacacgcatgtgtcgatcgagcagctgaaggagcggtaccgccaggcgtttcctcgggcctgacatcgtcacgttccgagcttgatcgtcccgcgattgcctacgtcgacaactccgcgataactccgcggtcatcctgcgcttaccctgcgcttaccctgcggtcatcttgcgatcaacccgtgatttcgcctcgattgccctgcaatccgcatgattccggggtgcaacaggcgaattgtgcacgttcacatcatttaaaatcttgaaatgtgatacaaatatgaacaaaatgtggcaattaacgtcgaaatcttgacggaagcgtatccttatcacgttttgcgtttacatggggtgactataatcggtcaccaacaagaacgccgccatccaaaggcgacagtcgagtgaacgcttttgtcgttcggaacaaggaggaaggatggccccggctcaatgctgaagttcatcgccaagcgcctcgccaactacgtcgtcatgctgttcgtggcgatttcatgtacgtattttctggcttctggtttcatgcgtccgcgctcgaattacgagtcgaggactccccgccctccggcagcgtccatcaaccgcagcttggatctggccaatatcaatgatcacaccaatatcttcactcggtattggcgttggctgaccggtgtcgtcaccagatgggactggggactgtcccctgatctggggtcggtcaacggtgcgcttgcgccgcgtatcgttgcctccaccgagctggtgacgatcgccacagtcctttccatcgtgcttggcgtggcgctcggcatctacaccgcgcagcgccagtacaagtggcaggaccgcctgttcggcaccactgccacgttcttccttgtcatcccgaccgccgtgttcgctctgcttgtcgtgatgctcgccatcttcatcaacggcgccagcggcttccgcctgttctatgtgacgggtctgtccagttatacaggaaataactggttcctgagattggctgatttcgggcagcacatcatcctgccgaccatcgtgctgacgattctgggcatggtctcctaccatctgacgcagcgcacctacctgcttgacgagatgcacgccgattacgtgcgcaccgcccgtgcgaagggtctgacccgccgccaggccatccgtcgccacgcgttgcgcgcatccctgattccgaccgccgtcaacgtcgcattctccatcgcctcggtgttcaccggcgcggtcatcaccgaatctatcttcgccatcaacggcttgggccggtacttcatccaggccattctcgacaacgacatcaatgcctcggtcgccatcgcggcgttcggcggcgtgtgcaccctcgccggtgcgctgctggccgacatcgtgtccgcatggcttgatccgcgcatcaagatgagctgagtgcaggggatgtgagaaacaatgactgatacaaccgtcaaaaacaacgaaacgacacagaaagagtccgacgagagcacgtcgaagggcgatatcaagcacatcggttacgccggcctgatcgcgcgtcgtttcttccgtcagcgctccgccgtggtcggactgatcatccttctggtgctggtgttcttcgcgctgttcggcgccaacatcggcaagtgggcgtatgacgaccctgacttcctcgccctgtcggcaggcccgagcgccagccactggctgggaaccgactccggcggctccgacctgtacgccatggtggtgcgtggtctcggcaagtcgctgatgatcggcatcatcacctcggtggcgacgatggcgatcgcctcgctgctgggaacggccatctccttcttcggcggctgggtcgagcgcgtcggcatgtggctgctcgatatgctgctcgtcgtgccgtcgttcctgctgatcgcaatgatcgtgcgcaccgcgaacgccaccaccggatggatctggctgatcatcggcctgaccgcgttcggctgggtcggctatgcgcgaatcatacgaacgctgacgttgtcgctgcgcgagcgcgactacgtcaaggcggcccggttcatgggcgtcggatcgttcaagatcatcgtgcgtcacctcatgccgaacctcgcctcgatgatcatcatcaacacggtgctgggcgtcgtgggcgctgtcaactccgagaccgcactgtcgtaccttggtctgggcgtcaaggcgcccgacgtgtcgctgggttccgtcctgcagtccggcgccgtgtccatgcagaccgctccctggctgctggtcttcccctccatcgccctggtcctgttgacgttcagcatgcagctgatcggtgacggtctgcgcgatgcgcttgatcccaattcacgtgcgagcggaacggtgggtgcctgatgttcagaaagacaatgatgaaaaacaacaagtcaaagggcagcgtctcaagcgagcacaaggagatcgtgcgcgacgacatcctccagtacgagctgcttgaaggcaacggccccaagggcgcgccgaagggcgatccgatcatgcaggtgcgcgacctgcacgtgtccttcgccacagaggccggcgtgtgccgtgcggtgcgaggcgtcaacttcgacctgtggcgcgggcgtacgctcggcatcgtgggcgagtccggctccggcaagtccgtgaccgcgttgagcctgatcggcctgctcgacgacaacgccaaggtcaccggctccatcatcatgaacggcgaggagctcatcggcaagaccgacgaggagatgagcgagatccgcggcgagcgtatcgccatggtgttccaggatccgctgtccgccctgaccccgatgttcaccatcggcgaccagatcgccgaaggcctcatcacccatcatcccgacatgtccaagcagcagattcacgaccgttgcgtcgagctgctcgaactggtcggcatcccgcagcccgaggagcgtctcagcagcttcccgcaccagttctccggtggtatgcgtcagcgcgtgatgatcgccatcgccatcgcgaacaaccccgacgtcatcatcgccgacgagccgaccacggccctcgacgtgacgattcaggcgcagatcctcgacgtgctcgccaaggcgcagaaggagaccggcgccgccgtcgtgctcatcacccacgatctgggcgtggtggccggcgcggccgacgacatcctcgtcatgtatgccggtcgtcccgtcgagcgcgccagcatcgacgacatcttccagcacccctccatgccgtacacgatgggtctgctcggcgccgtgccgaagccgcacatcgccgcctcccagcgtctcgtgccgattcagggcaacccgccgtcgctggtcgacatcccgaagggatgcccgttctcgccacgatgcccgctcgccaccccggagtgctcgctgtctgagccgaacctggaagtcgtggacgcgaactccggtcatctcgcctcctgccgtcgactgcaggagatcatcgacaagaacatgaagtacacggacgtgttccccgtgcccgacctgcttcccgccgactgggccgacgtcccgcgcgaccagcgcccggtgacgctggaggtcgaccacctggtcaagcacttcccgctgaccggtggtggcatgttccgccgtaccatcggccaggtcgcggccgtcgacgacgtgacgttcaagattcgtcagggggagaccctggcgctggtcggcgagtccggctccggcaagtccaccacgctgatggagatcatgaacctcatgaagcccgaggacggacgcatcgtcgtactcggccatgacctcgccgaactcaagaagaaggcggagcgcaaggcgttgcgcaaggacctgcagatcatcttccaggatccgatgagctcgctcgacccgcgcatgcccatctacgacgtgctcgcggagccgctcaaggtgcacaagtggagcaaggagaagatcaaccgccgcatcggcgagctgatggagctggtcggcctgaaccccgactacgtggatcgcttcccggcgcagttctccggtgggcagcgtcagcgcatctccatcgcccgcgccctcgccaccgatccgaaggtgctgctgctcgacgagccgatcgcgtccctcgacgtgtcgattcaggcgggcatcatcaacctgcttgaggacctgcaggccaagctgaagatctcatacctgttcgtcgcgcacgatctggcggtcatccgccacatctccgaccgcgtggccgtcatgtacctcggccaggtggtcgagctcggcgagaccgaggacgtgttcacccatccgcgtcacccgtacacgcaggcgctgctgtcggccatccccgtgcccgaccccgtggtcgagcgcacccgccagcgcatcatcctcaagggagacctgccgtctccgtccgagaagcacccgggatgccgttttgcgtcccgctgccccgtcaagctgcggctcactcccgagcagcagaagatgtgcgagacgaaacgcccggttttgacgtcggatgaccagatagcgaccgaattcgcctgtcacttcccgctggatgtgaacgacgaatccgcgccgttctaaagtctttcgggccggtcatatgaccggcccgattgcattggtttcgccgaaaagtgaaaagtgacgccaatgttaacaaaacgtggtgtatcatcacggttctagttgcgagatattttgaaggagagaacggcacgcgcaactcgtgctgttcaggagaggaatgcaaagtatgagttttgcatctaccgcgcgtaaggtcaccgccttcgccgccgctgcagccacgcttctggcgcttggtgcttgcggcaacagcaacaacggcagcgccggcaacaacggcgccaagtccacttccgaaccgcaggaaggtgttcccaccaactacaccggttcgttcccgatgccggatccgggcaaggcctacaacaacccgaaggaccgcggcgagctgaagcagggtggcaccctcaccctgccgatcaccgagatcggcccgaactggaacgccattgacgtcaacggcaacaccgtgtacatgagcggcctgtggcgcttctacatgccgtgcatctgggagtacccggcggatggttccctggagaacatcaagccgaacaccaactacgtgaccaaggtcgagcagacctccgacagccctgagaccgttgtcttcacgatcaacgacaaggcctcctggaacgacggcaccccgatcacctggaaggacttcgagtccacctggaaggtccagagcggcaagagcgacaagttcaccccggccctcaccactggttacgaccagatcaagagcgtcaccaagggcgacaccgacaagcaggccgtcgtgacgttcgagaaggacttctacccctaccagtccctgttcaacctgctgtacccgtctgaagccctcaccggcgacgacaccaaggacggcgacaccttctccaagggttggtcgaacgactctcactccgacaagtggggcgccggcccgttcgtcgtctccaagagctccgactccgaagtgaccttcaccccgaacccgaagtggtggggcgacaagccgctgctggacaaggtcgtgctcaagcagatggagccgtccgctgccatgaacgccttcaagaacggtgagattgacgccgtcggcgcttccgacgccgagtccatgacgagcgcgaagaccgtgaaggacgcttacctgcgtcgttcctacgactccggtgtgtacacgctgaccatcaacaccaagaacatcccgctggaggtccgcaaggccttcgtccagggcgtcgaccgcagccagctgcagaagatcgacttccagggtatcgaatggaccgagaagaccccgggctccctgattctgcctcagttccaggacggctacgaggacaacatgcccgctgagtcgaagttctccaccgccaacgccaccaagacccttgaggacgccggctacaagaagaacagcgacggctactacgagaagggcggcaaggtcgcggccattacgtacacgacgttctccgactccgcctccaccaaggccaaggcaaccgccatccagaagatggccaagaccgtcggcatcaaggtgagcatcgacatcaaggcgtcgaacaccttctccgacaccgtcagctctggtaactgggacatgatcggcctcggctggtccgctagcgacccgttcggctacgcgtcctccgcttaccagctctacggctccaagtccgagtccaacttctccttcaccggcaccgacgagatcgacaaggagctcgagtccatcccgggcatcaaggacagcaccaaggccattgctcagttcaacaaggctgagaaggaagcccagaagctgtacgctcagatcccgttcgagaacggccagatcactgtcgccgtcaagaagggtcttgcgaactacggtcctgcaggctactcctccggcgcgcgtgtcatggtgaccgttcaccccgagaacctcggctgggagaagtgagtcgtctgattcatcgatctcattgagatagcgatatagaagtcccccgtggctgcaaagtcacgggggacttctcgtatgtgtggacgatgctggaccacccccagccggccatgccggcagcccccgatagcggaggctgccggcatgactgactggaggtggtcacgctggctgagcggggttataccccgctcagcggcagaccttggagatcggctgccagggctgcagggtcaccggttcggaatccaccgcggcgagcgtgcgctcgtccaggtattccttgcggatgatgagctcctgaacatagcggtcgaaccacgcgccggaggcgacatagtagccgtccttgccgttgtccttgccccagctgttctccaccttccaacggtccggctcaccggccttgtcgaggttgacgccggtgagcgtcatggcgtggttgctgcgcgaatcgttgtattccagaccgtgcgccttgtccgatgcgaactcggtgccgaacagctcatccacgcgcacggtgccacgatcgaagatgccggccttgcgcagtgagaactgcgcgcagtcgcaggcgaaccagattgggtggcctgcggtcagctggtcgacggcggccttgcggaacacgtcgagcggcacgttgatgaagtccatcggagcggcctccgccacgttgcccacgaacgccagctgatagcggcggtaatacggggtagaggcgagcggggagttcgtcaggctcacgaaatcatccaaatcctcgcccacgtacttcgcgtagaactcctgcggcgtgatgccgtgttcgacgatctgcctgcgcgagtcgatgccggacttcgtgccggactcggacgccttggcgtcatccttggcgtcgtccttgccctcgtccttgacgcgcagcagcagatcgaagctcgtcggtggctcgcccattgcgatagcgcagatacggtacacgaccgacatctgcccggtcttgagcgagcgcagctcctcaaccgacttgccggcctgatgggcgtcgcgcaattcggcggcgaactcgcgcagcttcgtgttcaggtactgctcgaacgccgaggaatcgcgggagttcgacgactccgggtaggcctccttcggcaccagaccgtacttcttgaccagcgcgacgaacatctgccaccagccgccatcgtcagccgggccttcgttgaccgcctcgaagatgcggctgtccgtggtcttgtcgagcgtcttgagcacgttctcaaggtagaagttcgacttctccagcttgtcgtagaagaacagatagctttcggagaactcgaaatcgtcgaggttccacttgtgcatcagctcgtagcgcagcgtgttcagcgatgcgaacatccagcagcggccggaatgctcctgcgaggtgatcgaaccctgcttgagttcgaccgagaacgtgcgggggagctcgcgcacgccgcgatacgaggtcgcggcctggagaatgccgttcgataccgccgcgttcgccgccacgaggttcgcgcggtccgcgttgaacgccgcggagtattccctgagctgttccgcagtcagtgccaggttgtcgggctggttggaagccatgtccatgatcctttcctattgtcggaatgaaaaactgccacgaagcagtctactccgcctacgtaggccgtgtgtgagcggggagcggaagattccggtcgaaactgcggctcgcactgtcaacgggacggatataggatggccccatgatcaccatcaccacatccaacgtgaacggcatccgcgccgccaagcgcaagggcatcgagacatgggcgggcgagcacgccccggacatctggtgcatgcaggaggtccgtgccccgcaggacgagctcgatccgatattcggcgagttcgggttcgaatacgccaccgccggcaagatcgccgaccagagcgagctgacggcgatgaacgaggtctgccgcgtcaagggacgcgccggcgtcgggctgctgaccgacctgcccgtgacagcccggcgatacggtttgtccgggctggacgaggatgtggattccggccgatggatcgaggccgacgtgacgacgccacagggctatggaatcaccgtcgcatgcgtgtacgtgcacgcgggcaacagcgacgatccggtgaaaatggcgcagaaataccgcttcctcgacaccatgctcacgcgcatgggcgagctgcgggacgaggcctcgcgcggcggcaggcaggccgtgctgtgcggcgacttcaacatcgcgcacacgccgctcgacatcaagaacgccaaggccaacatcaagcatgccgggttcctgcccgccgaacgcgcctacatcgaccgctggctgggggagtacgagttcgtggacgtcatacgctcgctcgccggcgacatccaggggccgtacacgtggtggagtcagcgcggcagggcgttcgacaacaacgttggctggcgcatcgactatcagttcgccactccggaactcgccgagacggcacgaggcttcgtcatcgacaaggcgcccagctatgacgcccgctggtccgaccatgcgccgctgaccgtcacgtatgacgtgtgatcgtgcaatccatgacgcgctctgggccatgcggcggccgttcggaccggcgacaatccggcggcgtcttccaagccaatcacaagccctagtgctacgctagtcacggttgcaacctgtacaacgaaatgaggaacccatgggactgtttggattcggcaagaagaagcgtgaacgcgaggaagccgaagcgaaggccgagaatcgcgaggacgaggccgccgtcgacaccgaggagaccgccgccccgaccgacgtggcggacacgtacgaaggccgcggcgaatcctacggaccgtgggacgtcgatgacgagaacgtgccggattacgacgagtacctcgacatgggctcctactacctgccgtatctcgcgggcttgcagctgcgcatcaaggcgaaccgcagcacccaggagatcctcggcgcgaccatcagctacggcgcgtccagcctggagatcgaggcgttcgcggcgcccaagaccatgggtctgtgggacgacgtgcgcgccgatttgcttgaggccaacgagaaggcatccgaacacgcgggcgtgttcggcaccgaactccacctgccggtcaccgtcaagggcggcaagactgtgaacacgcgcatcgtcggcgtggatggcccgcgttggatgctgcgcggcatcttctccggcaaggccgcgaacgatgacggcaactccgacaccgaagcgctcaacaagtacttcgccgacatcgtcgtggagcgcggcgacgagccgctcgccccgcgtgatctcatcccgatgcacccgccggtgacccccgcccagcgtcaggcggcggccaagaccaatgaccaggctgacgacaaggagcacctcgacgacatcccggacaagcccgaagggccgttcgactccgatcagcagaccgaggtcaagaccacgctgtcgcgtggaccgatgttctccgaagtccgctgacgaatcccggcgctcgacgccgggagccaaggaacgagcatgaccgatcagaaccagaagaaacgtacgggtatggcgtccctcgccgccgcgggcgagggggaggacttctccgtcatcgacgccatcggcgggccgcgcggcgtcatcgaatcgatgctgccgggcgtgttgttcgtcgtgttgttcgtcgtcaccagcaacctcaatctcacgatcggtgtctccgcggcgctggcggtgctgcaggtcgtcatcaggctcgtgcaacggcagtcggtcatgggcgctctcagcggcctgatcgccgtcggcatctgcctgatatgggcgtggcagagtcatgaagcgcgcaactattacatgttcggcttcctcaccaacgccgtgtacatcgtgctgctgtccttcaccctgctcatccgcgtgcccggtctggggctcatggtcgagttcatccgtaccatccccaccgagcatttccgcgcgtggctgcacggctggctggacgacaagccgctcaggcgcgcctacacgatcgtcaccgtgctgtggatcggcgtgttcgcgctgcgtctcatcgtgcaggtgccgctgtacctcgccgattccgtggcgctgctgggcacggcgcgcctgctgatgggcataccgttctgggcgctggcgatatgggtgtcgtatctgatcatcgccaccccgctgcaccggcacatcgccgcggccaaagcggcggccggcggcggcaaagacggtgacagtgacggccacaacagcggtgatgaaggtgacaacgcagccggacaggcctgatccggtcaaattgcgaaaggaaacaatgaacgcgcaagtgcgtatcgaacgttatgccgaccagggacgatgcgtcgggcatatcgatggccgtgtggtattcgtgaggttcgccctgccgggcgagctggtgcaggtcgcattggatgaaccgcacgaccgcgacgaccgctactggaccggcgaggtcgtcgaggtcatcgaaccgagccccgatcgtgtggatcccgcatggccgctggccgggccgcttgccatgggtggtggcgtcggtggcgccgatctggtgcacgtgagcctggaagggcagcttcgctggaaggccgccaccatcagcgatcagatgagccgtctcgggcacgtggacgtcaccgtgccggtggaacgggccgaaggcgacactgagaacggcggcctgcactggcgcacccgcatcgagatgatcgccgatgacgacggcaggccgtcgatgcgtcggcgcggctcgcacaagcgcgtgccgctggacacgatgccgctcgcgacagacaacctgcttgccgtcgccgatcgcgaacacgtgtgggatggcgggttcgaacccggatcccaaattcgcctgtctgtgcccgaaccgaggaagcagcccatcgagggcaattacgccgtgctcgtggacggcgaactgcgcgccggaaaccggcatctgatggagaccgtcaccgtgaacggccgtgacttccaatacatggtcgacgcgaacggcttctggcaggtgcaccgtcaggcaccggtcatgctcgccggccatgtgatcgacctagcgaacaaggcgcttgacggcatgacctccgcctgcatatgggacttgtattccggtgccggactgttcacgctgccgctggccacgatgatcgccgaacgcacgcgcatgctcagcgtggagggcggcaagaccgcggtgaagaacgcgcaacgcaacctccgcgcgttgaacctgcctgatgtggacgcccgttgcggcgatgtgtccgccacgctcgcgcacgtgccggcccatctgtcacgacccgatctagtcgtgctcgatcctccccgcgccggtgcgcacgccaaggtgtgccgtcagatcgcgcaggcaggcgcgaaggacgtcatctatgtcgcctgtgacccgaccagcctcgcccgcgacacggcgacgctgatctcgctcgggtaccgcctgtcggacattcgggcgtacgacatctacccgatgacccaccatgttgagacggtggcctggttcacacgcatcggacggtgaggcgatgggtcgggtacgcggcgatcatgattgcgggttcctgcggcgcatgtggcgccgtgggattggcatcgcgtgcgccgcggccgcggtgatgtcgctcacctcctgcgtgccgcagggcaaggcggtcggcgatacgcaggagagcgaaccggagatcgcccatgagggcgtccaacggcaggatatcgtcgtcggcgtcatcggctccgtggacaccggcctggactctgatgtgctgaacgccttcaacaaggccgggttgaaggcaccctacgtatccaccagcatggtcgacgatccggatgccgccgcgcagcgcggagtgcggttcatggtcacgcgcaaggcctccgtcatcatgatcgacggcattgccgtcaacgagaagaacgccgaagactgggatgccgcgttgcagtccgcgcgcaaggcgggcgttcccgtcatcctcctggatccggtcgccccgcccgacgacgatacgttattcgccgtcacgttcacgcttaccggcaagggagacggcgtgaccgccctcgacgacgccgtcgtcaccatcgtcgacgacaaaccccacccccgcacgatgaacgtcaccgacaacctgtcctgaccttccgatatccggagctcttccgcgggagcggtagtccgtattttcgccccgctggcggggctgtcgcggagcgactgggggcggcttggcgtttcatcgcctgccggctattccgtctgaccaccctccggcgctgcgcgccacctcccgccggcgggaggtgtggaggcgtaggtggctgcggtgatcagccgagagccacacctcatcctgctgcgctcgatgggggacgtgtgtgaaaataccgcctgggaatggtgcccccgttatgctgccacgggtaggctagtacgtatgaatgcaaccctgaatctgcctgaagtcgaggaaaacggcctgaccgcctcgcaagtgcgcgcctgcgaggagagcggtcagacgaacgcggtgaagagcaccacgtcgcgttcgatactcgacatcgtgcgggccaacgtcttcacgctgttcaacggcatcatcttcgccgcgatggtactggtgctgatcaccgggtcatggaaggacgcggtgttcggcttcgtcatcctcatcaacaccggtatcggcatcgtcaccgagctcaaggccaagcgtacgttggatcggctgtcgattctcgtcacatcggattatgcggtgcgccgcgacggcgagaacacggaggttccttcgcgcgacatcgtactcggcgacctgctgtggatacgttccggggagcaggtgccggctgacgcgcaggtcctgtcatcatacgggctcgaactcgacgaatcgatgctgaccggcgaatcgcgcaccgtgcgcaaggaggacggcgaccaggtgtactccgggtcgacggcggtgtccggcgtggcgctcgcgcgggtgaacgcggtgggcgagcacagttacgcggcgacgttgaccgcacaggccaaggtatacaagaagacggtgtccgacctgaacaagggcatcaacacgatcctgaagttcatgacgttcctggtggtgccgctgtgcgtgctgctggtctggtcgcagatgaggaccgtgggcggatggaacgccgcgatagcttcgggggagtggcggcaggccatcgtgtcagctgtagcgggcgttgtcggcatgattcccgaaggcctggtattgctcacctcgctcaacttcgcggtcgcggcgatgcggctcgcccgcaagaacacgctcgtgcaggaactcgaatcggtggagacgctggctcgcgtggactgcctcaatctcgacaagaccggcacgatcaccgatggcggcatcatgttcgaccgtctggtcatgctggaacgcatggacggcgacgatcgcgtggagagcgcggcgactcaggcgctgtatgacctgtcgaacgaggagcagccgaacggcacgggtcaggccgtgctcgacgggctgggggaacgcggttaccatgccggcccggtgcgagcgcgcgtgccgttctcgtcggcccgcaaatggagcgccatcgtcaccccggccgcagccgcggaaacggaatcggccgccgaccgcgagccgccgaccgtctggtatatgggcgcgccggaagtgatgctctccgcgctttccggagagcacggcgatgtgctcgaagcggtcaatgattacgcgaattccggcaaccgcgtgctgctcatcgcgcgggcgacgctcatacggaagagcgagggcgatgccgcaacagattcgtcatggttcacgcagtcgcccgaactgctgccggacgccgagccggtcgcgctcgtattgtgttcggagtgcgtgcgcgacgacgcgcagcccacactggcatggttccgcgatcagggcgtgcgctgccgcatcatctccggcgacaacccggtcaccgtcggcgcgatcgcggccaaagtgcgacttacaggagaccgcgagccgcacgccatcgacgcgcgcacgctgccgcaggacatcaacgagctcgcccgcgtgctggagaacgtcgatgtgatcggccgcgtgctgcccgaccagaagaaggcgatcgtccaggcgctgcacaccagtgatcacgtggtcgccatgaccggagacggcgtcaacgattcgctcgccatcaaggaggccgatctcggcatcgcgatgggcaacgccgcgcccgccaccaaagccgtggcacaggtcgtgctcgtcgattcgaagttctcgcacctgcccgacgttgtggcccgcggccgtcaggtcatggcgaacatggagcgcgtcgccagcctgttcctcgtcaagaccgtctactcggcgctgatttcgctgggcgtggtactcactgcgatcccgttcccgtacctgccccggcatatcacgtacgtcggcgcgctgactatcggcatgccggcgttcatcctcgcgctcgcgccgaacacgcggcgttacatccccggcttcctgcggcgtgtcgtgtatttcgcgctgccgggaggcgtcgcgatcgcattgtccgtgctgctgtcgtcgtggctgttgcccgatgtgatgggctgggatgtgaacaacgccgccgatttgtccgcgttgcgcaccacctgcgcgatcatcgtgttcgtgctgggcgtgttcatgctcgcccgcgtggcgcagccgctcaattcgtggcgcggcgtgctggttgccgtattcgccgcggccggcgtcatcggcatgttcattccgttcgtggcgaggttcttcgacctgcatctgccgaccgggcgggtattgatcgccacggtggcggcgctgctgatttccacggtcctgttcgcggtctgtcacgtcatcctcgcctcggtgacgcgaattttcccacatatcaagccgacacgccagagctaaagtaacgtatcggtatcgttggtagcggataatctcttgtggaatagcatttcatttgatctcggaggaagcatgtctgtgcgagacgaccagttggcgacactgaacgtggccggcaaggactatgactactaccgcatcgccgacctgcccggcgtcgaccatctgccgtactcgctcaaggtcctcgtcgagaatctggtacgcaacatcgacggcgcgaacatcacggacgaacacgtcaaggcgctgctgaactgggccccgcaggcccagcccagccatgaaatccagttcacgccctcgcgtgtgatcatgcaggacttcaccggcgtgccctgcatcgtggacctcgccaccatgcgcgacgcggtcaaggatctcggcggcgaccctgaggtcatcaacccgcaagtccagtccgacatggtcatcgaccattccgtgcagatcgacaagtacggcgtggctgacgcggtccagcagaacatggacatcgaataccagcgcaacggcgaacgctaccagttcctgcgctggggccagcaggcgttccgcaacttccgcgtggtgccgccgggaaccggcatcattcaccaggtcaacatcgaatacctggcgaaggtcgtcatgacgaagacctccggcttggatgatggccgcgagctcgcctacctcgactcctgcgtcggcaccgactcgcacaccaccaccgagaacggcctgggcgtgctcggctggggcgtgggcggcatcgaggccgaggcggccatgctcggccagccgatctccatgctcgtgccgcgcgtcgtcggcttcaagctcaccggttcgatccccgagggcgtcaccgccaccgacgtggtcctgaccatcaccgacatgctgcgcaagcacggcgtggtcggcaagttcgtcgagttctacggcgagggcatcgcctcggtgccactggccaaccgcgccaccatcggcaacatgggacctgagttcggctccacctgcggcatcttcccgattgacggcgtcacgctcgactacctgcgcctgaccggacgttccgaggagcaggtcgcgcttgtcgaggcgtacgccaaggccaacaagctgtggggcgacgcctccgacccggactatgtcgagccgcagtactccgaatacgaggagctcgacctcggcacggtcgtgccgtccatcgccggcccgaagcgcccgcaggaccgcatcctgctgtccgaggcgaaggacatgttcgagaagaccgcacccgcctacgagaccgacaagaccgtcaaggacccggtggccgtgtccaccgacttccgtggcgatttcgacatcgaaaacggcgacgtggccatcgcctcgatcacctcgtgcaccaacacctccaacccgtccgtgatgatcgccgccggcctgatcgcccgcaacgcgcacgccaagggattgagccccaagccgtgggtcaagacctcgctcgcccccggctcgcaggtcgtggccgactacctcaaggccgcgggcctccaggacgatctcgacgcgctcggctaccagctggtcggcttcggctgcgccacctgcatcggcaactccggaccgctgctgcccgagatctccgaagccatcaacgccaacgacctgaccgtcaccgccgtgctgtccggaaaccgcaacttcgaaggccgcatcagcccggacgtcaagatgaactacctggcctccccgccgctggtcatcgcctacgcgctcgccggcacgatggacttcgacttcgagacccagccgctcggtaccgacgcagacggcaatgacgtgtatctgaaggacatctggccgaccaacgaggaggtcgcggccgtggttgacggtaccgtcagccgcgagatgttcctcaaggactacgcctccgtgttcgacggcgaccaccgctggaagggcctcgacgtgcccgaaggcgagctgttcgcatgggacgagcattcgacgtacgtgcgcaagcagaccttcttcgacggcatgaaggccacgccggagccagtcgccgacatccacggcgcccgcgtgctggcgttgctcggcgactcggtcaccaccgaccacatctccccggcgggcgcgttcaaggcgtccagcccggctggcaagtacctgaccgagcgcggcgtggagccgaagaacttcaactcctatggctcgcgtcgaggcaaccacgagattatggtgcgtggtaccttcggcaacatccgcctgcgcaaccagctgctcgcctccgtcggcgaggaggtcacgccgggcgggttcacttacgatttcacgactggaaagccttcgacgatctttgacgcctcgctcaactacaaggccgccgatattccgctcgtcgtgctggccggcaaggagtacggcactggctcgtcgcgtgactgggccgccaagggtacggtgatgctcggcgtcaaggccgtcatcaccgagagcttcgagcgcatccaccgttccaacctcatcggcatgggcgtgctgccattgcagttcccggcgggggagtcctatgagtccctgggtcttgacggcaccgagacctacgacatcgccggcgtggacgagctcaacagcggcgtcaccccgaagaccgtgcacgtcaccgccacgcacaccgacggctccaccaccgagttcgacgcggtggtccgcatcgatacgcccggagaggcggactactatcgcaacggcggcatccttcagtacgtcctgcgcaacctcatgaagtaagcggcccgaagtcccttgaccccatggtcaagggacttctttttttctttcttcccctccttctcttcctttaccttttccctcttcctttcctctttccgggagttatccacaggcgcgacacgcccggactgcattgcacaatcctcggtagcatctccatagaacggctgtattgcaatgtttcgacaacgtggcatgactattgtgcggcgcagtccgggcgtgtcacaatcgagccttcgaccacattgcccgaaaacctgaagaccgggccggaaaacctgttaccgttcgtccatgtttgagatgcgaaacgaaccgccaccgaaccaatacatgcggcatcaggcgtggctcatccagcgctattacctgaagcgttgccgggcggtcagggatacgctggagcatgagccggtattcgcgttgtcgtcggcgctgggactgatgggcattgcaccgcccgagaccgccgtccttgatttgggcaaggaacatatcgtcgttcggaatcgtgacgcgcgacgcggtcatcccgccaatgtcgcatgtcacgcgtggtcattgctggacgaccgtatcgtaatccgcatctttgatctgtactgcacgtcacccgccgcgacgttcgcccaattcgtgcggttcaactggttcgaggaaacaatcatattggcggatcggctgacatgccgtgacgagcggctgaggcgcgcgaccaaacaggaactgatggatttccttgatgagcggaaggtctatggcggcaaggccgcacgccgggcgttgcgtttgtctcgtcctaacaccgattcccggtgggaacgggagctgcgtctggatgcgatgaaatggggattgccgaatccggaggcgaaccatccggtcgatttggggtctggattggcatggcttgacatggcatacgagaagtatcgcgtggcgatggaatttcatgggcagcagcatctggaacagtatgtagcggacacgaggcgcatgaacgcattggcggccaagaattgggtggtgcttccggcctggcagagtacggtgcttgaccaggccgaactgcatcgatacttcagtcaggtggccgccgctttggagcatgccggtgccgtcgattttctgcatccgcgcatggatctgtggacgttgagcggcaatccggagctgctggaaccgttttgacgtaggagcgaccgattggtatatggtccgagacagggatggcagtcgtcgtgatacgacacgcccggagtgcgcagcacgaccgatgaatagtcgctgcgaggtaacggtataaacccgttctggactccggacacaacgattgtgctgcgcaatccgggcgtgtcgtgttatgggaacaccggtgtatcgaggaaagagggaaacttgaagagagaaagtcgggaacacagttgagggggcatagaacagatggaagagagacggccggcaggatgtgggagaagtcctcggaacgggataaagaagaaccgtttcgcttacgccggcgaaacggttctcgagtagtaacggacgatcccgtcacgcgaggccggagagcttgttgatgagctcggggtctcgcgtggcgcccttgtcggcggagcgcgcgaaggcggcgtacgccttgagggcctggctcaccttgcggtcgcggtgcgccacgtagccatcgccggcctccagttcgcggcggcgctcggccagctgctcgtcggtcagctcgacgttcacggaacgggcctcgatgtcgatgtcgatgatgtcgccgttcttgatgagcgccaccgggcccttgttcgccgcctcgggagccatgtgcccgatggccagacccgaggagccgccggagtagcgaccgtcggtgagcatggcgacctgcttgccgatgcccttgcccttaacgaaggacgtcgggtacagcatctcctgcatgcccgggccgcccttcggaccttcgtaacgaatcaccagcgccatgccgggcttcagcgtgtcgtcgaggatcacctcgatggcctgctcctgcgaatcgaccaccagtgccggtccgcggaacttccagatctcctgcggcacgcccgcggtcttgacgacgcagccgtcgggagcgaggttgccgcgcagcacggcgagaccgccctcgtggatctccggatggtcgatgtcgtggatggcgccgttggcacggtcgcggtccagcgagtcgaacagcgtggtgtgcgtccacggttcgggagagatgatgtggccgggagccgccttgtacatctgctgggcttcttcggtgcaggtgggacgcatgatgtcccagtccgccagcttggcttccagcgtcgggtagtcgatggagtgcacgttggtgtgcagcttgccggcgcggtcgagctcgccgaggatgccggtgatgccgccagcgcggtgaatgtcggagatctcccacttgccggacggcgacgccttgcagatacacggcacggtgtgcgagatgcgctcgatgtcgtcaagcgtgaagtccacgtcggcggactgcgccatggcgaggatgtgcagcacggtgttggtggaaccgcccatagcgacgtccatggtcatggcgttctcgaacgcctccttggtggcgatggagcgcggcagtacggagtcgtcggaatcgtcatagtactggtgggcgatcttgacgacctgctgcgcggcgcgcttgaacaggtccttgcggtaggagtgggaggcgaggatcgtgccgttgccgggcagcgccaagccgatggcctcggtcaggcagttcatcgagttggcggtgaacatgccggcgcaggagccgcaggtcgggcagacggtcttctcgtagttgagcagctcctcgtcggagacggaatcgtcggcggtggcgtacatcacgtcgatgaggtcggtgctcttgacggtgccgtcggcgaggatcgtggtgccggcctccatcgggccgccggagacgaacacggtggggatgttgaggcgcagcgcagccatgagcatgccggggacgaccttgtcgcagttcgggatgcagatcagtgcgtcggcgcagtgcgcgttgcactggtattcgacggtgtcggcgatgatgtcgcggctgggcagggagtacagcatgccggtgtggcccatggcgatgccgtcgtcgacggccatggtgttgaactcgcgcgggatgccgccggcctccttgatggcctcggagacgatgcggccgaccttgttgaggtggacgtggccgggcagaaactcgtcgaacgagttggcgatggcgatgatgggcttcttgcccatgtcgtcacctttgacgccagctgcacggtagagggctcgggcacctgcgaagacgcgcccgttcatgatttttgcagatcgcatttcagtcatggttctattcaagctcttgcaagggacacgcgacatgtcaagagtcggaatatggaattttcataagtgttacaaaactcacagtggagcctatgtagccttttatgttgtctgcaagtcggcaacgaactggcagaatccaccggacccgctccggtcgctgcgtgaggctataatcgctgcggttgagatagatttccatcatgtgattcggagacttgcaaaaatggcagaagaaaccaaggataccgaggtcaagggcaacgaggagttcggcaccgcgcccgtgcccgagggtttcgcgaacccgccgatcgacgatctgatgaagcacgccgattccaagtacgcgctggccatcttcgccgccaagcgcgcccgtcagatcaactcttacttcacccagctcaacgagggcctgctgcagaacgtcggcccgctggtcgaataccagaaccaggagaagccgctgtcgatcgctttccgcgagatcgacgagggcctgctggaggagactctgggcgaggatgatctgagcgaaggcaactgattcgtctgaatccgtccggttcgctgtacgcggtatttgctttttctggggcgacactcttgcccttgacggcggtgacgtgtacaactgagcgtcaggagcgaacgacttggggctcgcgccgaccgaaggtctggcacgggcccttttcgtagcctgttcaggtcctgcaacaacagaatgaaccaacgtatcattgtgccttatccgcaaaaggcgggtagggcgataagtccgaaagagggatgatatgaccaatcaggagcgcaagctcatctcggccgaatctgtgaccgaaggccaccccgacaaggtatgcgaccagatttccgacgaaatcctcgacgaactgcttcggcaggatccgcaatcgcacgtcgccgtcgagacctccgccgcgaccggtgtgttcctcgtgttcggtgaggtgacgtcaaaggggtatgtcgacgtccagtccaccgtgcgcgagacgctgcgccgcatcggctacacgtcttccgaggtcggcctcgacgccgactcctgcggcgtgatcgtcgccatcaccggccagagcgccgagatcaatcagggtgtggcgcgcctcaccggcgagaaggagaccgaggccagccgcgaggagcggtacgaggcccagggcgccggcgaccagggcgtgatgttcggttacgccaccgacgagaccgacgtgctgatgccgctgccgatctatctggcccaccgtctggccttccgcctgaccgaagtgcgcaagtccggcgaagtgccgcacctgcgcccggacggcaagacccaggtgaccatcgaatacgacgagaacgacaagccgttgcgcgtcgacaccgtgctgatctccacgcagcacgacccggaggcgagtcaggaatggctggccgcccagctcaaggagcatgtcatcgacccgatgctggacgaggtgctcggcgacggcgtcaagcatgacgattaccgtcagctcgtcaacccgaccggctcgttcgtcctcggaggtccggccgccgacgccggcctgaccggccgcaagatcatcgtcgacacgtacggcggcgccgcccaccatggcggcggcgcgttcagcggcaaggacccgtccaaggtcgaccgttccgccgcgtacgcgacccgctgggtggcgaagaacatcgtcgccgcggggctggcgcaccgtgtcgagctgcaggtcgcctacgcgattggcgtggccgaaccggtgtcggtcaacgtcgagacgttcggcaccgaaatcggcgtgacccgcgagcagatccagcaggccgtgcgcaaggtgttcgacctgcgtcccgccgcgatcatcgacgagcttgacctcaagcgcccgatttacgcgaagaccgccgcatacggccacttcggccgcgtcgacgtcgagttcccgtgggagcgcaccgacaaggtcgaagagctcaaggccgccatacgctgactggcagatcacaacgatcaccctcggtttcacttcgtaacgtccccgccagcggggctgccgcgaagcgaaaccgggggtggtcttgtctatacacacaacatgcatacacaaaaaagccgccggacaccccgagaaggttgccgcctgcggcggacttcaccggtggcgtgatacaaatgaaccatgagtacgaatgacgcgcagcagttggcgtttgacggcatggcgccgcgcaaacgccgcaagcgcgcgcccgccgagaagattgtggccgcggaagacccgatcgcgcaggtggtgctggacgtgcaggcgacccatctgggccagacattcgactatctcgtggaggagcggtggtcgcaggccgcacggcccggcgtcatggtgcgggtccggttcgggggcaggctcctcaacggcgtgatctggaagcgcgcggcagccagcgccacgccccgctccgcgctgagatttcttgaacgggtgatcagcccgcacgtgctggtatccgaatccatgcgtgacgatatcacgcgcatcgccgacgcctatggcggcacgcgggccaacatacttcgcctggcggttcccccgcgcgtggcgcgcatcgacggcgaacagcaactggccgcgcgttcgctatgggtgggaaggcccagattctcgcacatctcggacgaactgatgcaacggtgcttcgacacgatacaggcttcatatgacggcgccgccatgctgcgctcatccctggagagcagctcgttcgccgccctggtgatggatgcgcgtccgggagcgcgtgcgtgggctcgtgacgccgcgtggatgatcgctgtcgcgatgaggcagaaccgtgccgccgtggtggtcctgcccgggataagacagtgcgaggatctcgccgttgccctggagggactgggactgtcccgtttcgcgccgggcggcgccgagcacggcggatactccggtgacttcgtcgtgctggccgcaggactgccgccggcggaacggtaccgtgcctatctggcggcggcgaccggtcaggtcgggtgcgtcatcggactgcgtgccgccatgtatgctccggtcgaggggccggccctgttcatgatggtggatgatgccgcgtaccagcaggccgacgggatgatgccgtacgcgcaggcacgcggcgtcatgcgtctgcgcgccgagtcgcacgggggagtgtttgtggcgctgtcgtacgcccgtagcccgttgagccaatgggaatgcgaggaccacacggccgtgactgccgtgagcggcccgagcgcatccgtcacgccgttgccagccgctcgcagggatcagatgccgtgggtgcggtggctgaaccgcgaggagctggcgcgtctcgccgacccgagcataggcgcccgcgtgccgcataccgcggtgacggtgttgtcgaaggccttgcagacagggccagtgctgctgtccatcccctcggacggcatgcaggaggcgttgggctgcgtgaaatgccatgcgcaggctcgttgcgcgaaatgcaccggcccgctggggcgcatgggtgatggggtgccgcgctgccggtggtgcgctgcggcggcggtcgactggcattgcccgcattgcggctgcgagcgcatgcgcgtgatacgggttggcgcaaccggcaccgcccgcgagctgggcggcctgttccgcggtgtgtccgtcgtcatatcgtcgccgagccagccgcgaggcgtcgtcgagtacgtggatgatgcgccgcgcatcgtcatcgccacgccgggagcggagcctcgcgtgctgcctgcatcccgtcaatcggagcaggatgccggcgaatatcgtgccgtgacgatcctggacgcgtggaacagtctgtatgcgccgggtgtggacgcccgcgtggacgcgctgacggcgtggatgcgggtcatggcgttgtgtgcgccccgcactcgtggtggacagggtctgctgattggtgaatgcgatcctgcagtggcccatgcgctgatgatgtgggattcggcgtcgctcgcccggaacgaattgctggagcgtgggcaggccggcatgcctccggtgtgcgcggtcgcatgcgtatgggggcgtcgggatgcggtgatggccgccttggacgatatcggcgtgctgcgcggcgattgggcctcgctggatgttgcgggggagccgatacccggcatgctggggccggtgccgatagcggctccggtgacggtgagcgaacgcgagctggagagcatgcaggaccgggtcaaggccctggtccgtgtgccggtcggcatgcgtgcccaattggccgtccgcctgcggtccgcggtggcgcgtcacatggcgtcgcgcactcccggcgaactgcggttccaaatcgatcccaaggatttgatctgatccgagagattatccgccgcgtcgaggtgtcgtttcgaggaaagcggcggcgtgacatgtctgactgccgattgaatcagcattcggaaccttttgtttcggttggtgagatgagacggggattctttgccacgaaacgtcaaaaatcgctgttttcggcattcggcccacttcttgtgccacaaaatcggatttaaccggttgcatgccgtttcgagccatgagaccgaaactgggaatcattggaaaatggccgattctgttattcggatcgttttttcgtgtcggtcgtgtggcacgaaatgtcgagaacgcttgtttttcgcatctcgtggcaatgttttgaccaggccgtcactgcatccggtgccaccatgcaggccgggcctgattcgctggcggagaccaagatggccggcgaggcgcggaaggattcctctttccgagaatgctctagctcagacgggtgctggcacggcgaccgttgtcttgctcacggcgattatggcgctgatggatgtcggcgtatatgacatttgccgcgtagattcggggctgccgaaacgattcggacgagaactttcagacgcggcgcttatagttgcatgccggaatgcatcggtgcggcggatgattcgccgcgtcgtctcgatggcatggaaccatggatgtgcgcggccgcgcgccgcggaatcgttcattggaatcgttcatatggatggaggcatcatgaagggttggccgggcgaaccggatatggaacatgacgtgctggtggcgcagggacccgccgcggccgccgacggcaagccgatcagcaacgtgattttcgacttcggcaacgtgctgatctactgggatccgtccgtcgtgctgctgcccaggtattcgcaggagaccatcgaccagttcctcgacaatgacatctccggcttctacgacgcgaacgaccgcatggacggcggcgcaagccccgacgagggcgtggcgtggatgcgcgagcattacggcgacaagtgggcggatatcctgcgctactatctcgacaatttcgaggattccctgaccggcgtcgtgccgggtgcccgcgtgctcgtcaacgatctgaaggccgccggcattggagtatggggcctgtcgaactgggagaaggaactgttcccgatcgcgctgaagcactgcgagatcctgcagcggctcgacggccgtctggtgtcggggtacgtgcacatgcgcaagccgcacaaggacatctacgagaaggccctggaggagttcggcatcagcgccgaaagcagcgtattcatcgatgacaaggcgatgaacatcgcgggcgcgaacgaggccggcatccgcggcattcgcttctcggacgcccgcaagctgcgcgagctgctgatcgagcagggcatcgatatcccggcggttcagtgacctccgcccgtccgcacgtcgtccggcgttcgacgatgatgacagggcagatggcctgaagtcccaataccgtggaaggaaacggaacacatgttgaaaatcctctttgccggcacgcctgatgtcgcggtgccgtccctgcgcgccctcgccgcggacagcgagcacttcgaagtggtcgcagtgctcacccgcccggacgcgcccaccggacgcggacgcaagctcacgcccagcccggtcaagactgccgcgctggaactgggattgccggtactggaatccgacccggccgagccgacgttccttgacgagctgaaggtcaccggcgcacaggccgccgcggtcatcgcatacggacgaatcctgaagcagtccgtgctggacgcgctgccctgcggctggtacaacctgcatttctcgctgctgccgcattggcgtggcgcggcccccgtgcaacgagccatctggtcgggcgacgatatgaccggcaccagcgtgttccgcatcacgcgagcgatggatgccggcccgctgctggtgcaatccgaaacgccgatcggcgagcatgagaccgccggcgacctgctgacccgtctgggagaatccggagcgctggtgctgcgcgacgcgctgcgcaccgtcgaggacggtaccgccgatcccgtggaacaggcggaaggcgattacccggtggcggagaagatccgcgtcaacgacgcgcatatcgatttcagtgcgccggtggaagcggtcgaccgtcagattcgcgcgtgcacgccgaatcccggggcatggaccgaactggatgcagacgggctcgggctcgacgacgggctgtccacgctgcacgtgctgcgggcgcacccggccgatatgaccaatccgaacgtacccgggtcgttggtgtctggggcgctcgcagctggaaagaagaatgtctggatcggcacaggctccacacctctggaattgctggaggtcaaggcgcagggcaagaaggcgatgcgcgccgccgactgggcgcgaggagcccgactctccgaagccgcgcgctgccggtaacgaggtgcgcgttgcggactggaggtaagtgaaaccacccccagtctcgctgtcgctcgccctcgcctgcaaatggccctgccctttgctttacggctcggcccgccagcggggcaattatcacgctcccgctggcgggagctgtcgcgaagcgactgagggtggtcttggcgctatcgccgtgcgacgtcagcgcaggaagtccagcaccttggtcaggtcgcgctcgttgatggactcgtgggcggcgagctgagtcttcggcttggcgcagaaggcgatgccgagcccggccgcctgaatcatcgggatgtcgttcgcgccgtcgccgaccgccacggtctggctcatgggaaccccgtctcgggcggcccacgcctgcaatgcatgcagtttcaccgtcttgcacacgatattgcccagcaccttgccggtcagcgcgccatccaccacttccagacggttcgccagccaatggtcgatatgcccttcggcggcgagacggtcaacgacctcatggaatcccccggacacgacgccgaccttccaaccatgacggtgaagctcgtcgatcagcgccaacgcgccattggtgaagtgcagcttgtcgtgcacggtgtcgaacacgctcacgggcagtcccttgagcaatgcgacacgctcacgcagcgcatcacagaattcgatttccccgcgcatggcacgttcggtgatcttcgctatctcgtcgccgctgccggccgcctcgccgagctcgtcgatgacttcctcgtcgatcagcgtggaatccacatccatgacaagcagaccaggcttcgacagcgtcggcgcggccgcggtgccgtcacccatggtgtccgagggcgattggtgtgcggccgcgaacacctccacgtcgggcacgtcatacgattcgtcagaaggttgcaaagtttcgtcaagcataccgtcgattgtcggaaatcgttgggacaataccggtatgcatgaatccctgcgcatatcggccttcgcgcccgctgcggtgcacggagcgggcgactccggctccgctgtcggcgccatttccaaggtcattgtggccgtcacggacccggcgattcgccgggcgcgtaatctgatagggaagcgtgctcgaaaaaggggcgaacagtgaacgatatcatgcacgacggcactccggatggcatatggaattcgcaggaccatccgtcaggcctacctgattcagggccggtctcatcgtcgggcacgggtgccgaaagcgccacggcacgacaggacgcgaggaagatacgggagaacgtcgcacgtgagctggcggccgccaatgaccagctgatggccaagaaccatgcgctcgcgcaggcgctgtcgcgcgcgggcaaggaactcaccaaggcgaaggcgcagctgtcgcagatggcccagcccccgaagaccttcgcgacgatggtcaaggtcgactcgtcgatgaccgacgagctcggtgtccagcatgcgtcggccgagatcctgacgggcggcagacggctggtcgtgcctgtggccgccaacgtcaacgcgtcccggctgacggccggcgcctgcgtgctgctcaacgagaacatggtattggtcgagcagcgcggcactgacatgctcggctctgtccgcacgatccgccaggtgcttgatgacgggcgtctgatcgtcgcggatggcggcggcaaccccagcgtgatccggcgctcgggagcgttggcgcacgagacgttcgccaacgggcagcgcgtcatcgtcgacccgtcgggccggctcgccctggaactgctgcccgacgagaacgatgccgacctggtgctggaggaggttcccgatgtcaccttcgccgacatcggcgggcttgacagccagatcgaacgcatccgggacgccgtgcagctgccgttccttcaccgcagcctgtacgaacggtacaatctcaaggcgcccaagggcgtgctgctgtacggccctcccggcaacggcaagaccatgatcgccaaggccgtcgcccatgcgctttcggatggtttcggcaggggcagcggcgtgttcctctcggtcaaggggccggaactgctcaacaagttcgtcggtgaatccgagcgtctggtgcgtcagatcttcacccgcgcgcgcgaacgtgccgcggacggccggccggtcatcgtgttcatcgacgagatggattcgctgctgcgcacccgcggcaccggtgtctccagcgacgtggagaccacgatcgtgccgcagttcctctccgaactcgacggcgtggagagcctcgacaacgttatggtgatcggcgcctcgaaccgcgtggacatgatcgaccccgccgtgctccgcccgggacgactggacgtgaagatccgcgtggaccgccccggggcggatcaggcggcatccatcattcgccactatctgaccgacgacctgcccctgcagcccggactggacgccgacggcctgtcgcgcgttctggtgcgcgacatctacacgcgctcgtcgcgacggcacctgtgcgacgcgtgcaacgaccaggggcaatggtcggccatcttcctctccgacgtcgcgtccggtgccatgctcaagaacatcgtcgaccgcgccaagacgaaggcggtgaaggcgtccattctcggcggcgacgacgtggcgttgaacgtcgagttgctgggagaggccgtggaggacgagttcgtggagacacgagggtcggtaatggacgtcgatccggtgcaatggtcgagaatcaacggcatggacaacgggcgcgtggtccgtatccgtccggttccgcgcaaggaaaaggagaacatgcaatgaccgtgcgacgggtgatgggcacggagaccgaatacgcggtctcggcgcccgctgtctcacatgccaatccggtgcagctgtcgttcgacgtaatcggcgctgccgccgatcccgaacgttcgcgcatacgctgggactatcgtcaggaggaccctgtcaacgacgcgcggggcacccgtctggagagggccgcggcccgccccgacatgcttaccgacgagccgcagctcaacatcgtcaacgtcatcgcccccaacggcggccgcatgtacgtagaccacgcgcaccccgaatactcggcgccggagaccaccgacccgttcgaggcggtgcggtacgaccatgccggcgacctgctgatgcggcgggcggccgcgtcggcgagcgtgggaacggggcacgacatcgtcctgcaccgcaacaacgtcgacggcaagggcgccagctggggcacccatgagaactacatgatgctcagatcggtgccgttcgacacggtggcggcgctgatgaccgcccatttcgtctcacggcagatctacgccggatccggccgcgtcggcataggggagcgcagcgagaccgccggataccagctcagccagcgtgccgactacatccacgcgatcctcggactgcagaccaccttcgaacgccccatcgtcaacacgcgcgacgaatcccacagcccatccgattatcgtcgcctgcacgtgatcgtcggcgacgccaaccgcatggacgtgccgcagacgctcaagctgggcgccaccagcatgctgctgtggctggccgagcacgcggacgagaccggctatgatctggcagcgctgctggactccatggcgctcgtcgaccccgtgtcggccatgcacacggtgtcgcacgacctgacgctgcaggccgagctgccgctgcgcgacgggggcgtcaccaacgcgtggatcatgcaggtgaggctgcgggccgccgtgtacgagatgggggcgctggtgtacggcaccgacacgcgcggcgagccgctgtggccggacaagcccaccaccggcatcatggcgctgtgggggcaggcactcgccgacgtggccgccatccggcatgccgacgacgatacgagactgaatatgcaacccgaggcgtcgcgggtggaatggctgatgaaatggcagctgctggagcgtctgcgccgcaggcacggcttgtcgtggaacgatccgaaactgcgggcgatcgacttggggtgggccgccttggacccggtccgctcgatattcgagaaggtcaggtcgcgcaccgagcgcacggtcgacgaccggcaggtcgccgatgccgctggcaatgcgccgcagaccacgcgcgcatggctgcgtgccgcggtcgtgaaccggtatgcgagccaggtggtcgctgtctcatggtcccatctgaccgtccgcaggcatgatgcgccgcagacgggggaggagtcgtacggcaatgcgagccgtccgatcgtccggccgtccgacctgtgctcgctcgacatgtccgatccgtgcgccttcgacaaggcgcacatggccgcgttcgtggacggcacgcgaaacgccgatgagctgataacgcaaatcggtcggaacatcaccgccggaaggtaatatcgatacaggcatgaaatggcattaccgtgggcgcaccactggccgatgcgcatcatggggcagccatgatggcgagcgatgacgatcaaaggcgcgaacgccacgaccagagacaacgaccgacagacgaggttgatgcagacatggatttgcgagaaatgacacaggccgtcgcccaagtggcgcggcatgccggcaggcacgcccttcaggagcaggtgaacccccacgacctatccacgacgatggtgtcgcccggcgagacgaaattcactagcgaggtcaacacccggctgattcgctatacccgcgcgcgactgtccgaaatcgaaccgttccagggcttctgggaggagcgtccggaggacaaccagccgggggagaggtactggtgtgtcggcaatatcgacggagccatcaatttcatccgcaacatggccgaatggaccgtgaccatctcactgttcgagttcgacgagcactgccatgcgcgcccgatcatgggtgtggtccatgcgcccgccatgggcatcacgtacatggcggcgaagggccagggcgccatcaggatacgccgcaaccccgtgggcggcgacaagcgcgagaaggtcatgccgtcgatcactgcgacgttggatggctccgtggtcagctacggcatgtcgtatgtgccggaggagtccaagcgggccctgtccgcggtagcctccatcgcgggtaaaccggccgatatcaagcgagtgggtccggcttcgatggatttgtgcaaggtggccgacggcacgtacgacgcctatttcgagcctcacctgcacaagtgggatgttccggccgtctcggccggcgccgtcgtggtatgggaggcgcaggggcgtctgagacagtggaacggcgagctgatccattggcgtcgcgagaacgatgtcgtggcgtcgaacggcctgatcggcgacgagctgcagccgtatctgcagtgatcgggcgcatacagacatatgcaggcgtctgccggcggtgacgaatacgtgcgtgcgtggcagatgtctgcgattcggtgacggcatgccggatgtccggcctgtgccggcatcggcggaagaagaaaaccggaaggaaagggagggacggatatgcctcaggaattcgctcacacgcagtcgtcctcgcagaagcaggataccgacgaacagctgaatgacgtgtcgatggcggcacaggccgagaccgacgcggccgtggacgctctcgacgcggtgctggatgacatcgaatccacgctggaatccaacgccgaggagtacgtgaacagcttcgtgcaaaaaggcggcgaatgatgccgcagctgcgtgacagcggcaatcacgggagttggcaggaagcgcggaggtcttcgcagttccagggattcgtccgcattttcggcgtggagacggagtacggcgtatcggtgacgggttcggaccatccggtcgacgcggcgcaggtcgcgatgatgatgttccagcctgtcgtgtcccgcgcgcgttccacgaacacgtacctgaccaatggttcgcggctgtatctcgacgtcggctcccacccggagtatgcgaccgccgaggcccgcgatccgatggacgccttgctgcaggatctggcgggggagcgggtcatggccggattggccctcgacgcgcaggcccggcttcgtgccaggtacggggacggcgtgaacgtgcacgtgttcaagaacaacgcggactcggcgggccactcgttcgggtgtcacgagaactatctcgtacgccgatatgtgcctctggaaaccgtcgaacacgagctgctgccgttcctgataacgaggcagctgtacaccggagccgggcgggtcaccgatcagggattcgagatcacgcagcgggcggactatctggatgaggcggtgtcatcggcgacgacgcggtcgcgccccatggtcaacacacgtgacgaaccgcactcggatccggatgaattccgccggctgcatgtcatcatcggcgactccaatcgttcgcaatgggcgacatggatgaaactcgccgtgacgcatctgattatctgcgtcatcgaggaggccgcccggctcggtgaggattccggtttcgcgtcgtgcgcattggctgatcccggtgccgcgaaccgtgcggtcagcgccgatctgacatgcgtgaccgcccggcttcgtcttgctgacggctccgagccggtgtccgccgtgcagatgcagcgcaggtaccaggccgtcgtccgtgatttcatggaacgtcatcatgatgccgttgacgacgcactgccgcgcacggacgtggatcagattctttccgcatggtcgctggttcttgaccagttggaggccggcgatgtggaagcgttgtcggaccgcgtcgactgggcggcgaaataccgcctgttccaggcgctgaaacgccgcaagggcgaagtgacggacgccatgcgcgaacggctggacatggattaccatgacatcgtcaacggttcgctgtatccgtcaatgctgcgtcgaggcgtgatgcggcagctggccacgccccggcaggtggagcatgccgtctcggaaccgccggccgatacccgtgccgcgttgcgtggggccttcgtcgccaaggcgctgtccacgcaatgccggttctcctgcgactggacgcgattgtccgtcatggctcccgaacgcagcgaagtcgtgctgctggaccctttcgaataccaggcgaatgccgacgtccaacacctgatgaacctgctataacgccccgctggcggctgagccgtcggcgaagtcgaccggggggggggggaggtaggtgccgaccggaggcgccccagcccaagcccagatacgaaaaagcccctgactcttcattggtcaggggctgtatttgttcaccatgatatcgaaatcggtgacaatggcacgaaccggacttactcggtcacggccttcttcagcagggagccggcggagatgcgcacgccgtaggtcgccgggatctcgatgatttcgccggtgcgcgggttgcggccggtgcgggcagcgcgcttgacgcgctcagcggagaacaggccggtgagcttcaggccttcgccggactgcatggcctcgacgaacacgtcctggaaagcgttaacggcggcctcagcctgagccttggtcagattggacttctgggcgatcttcgaaacgagatcagacttgttgtatgccataaagcatccttctttgatctgggggcttcgattgccgaatccccggtgttcatcaatgatgatagcgcatgatgtaggcaaacgccgcattttttaagggttttccacactttttccggttgttgggcggttatatgagattgtgtttgtcgagccagcgcatggacagcgcaccgagggggattcgcagccagtagaacagcgcacggtacagcaacgtcgcggagagcgcgatgcccgcgggcacgcctgccgcgccgaacgagaacgtcagcgccgcttcgacgccaccgaggccgccgggggtcggcaccgcggagccgatggcattggcgaccaggaagatgaacagcgtctccagcggattggtcatctgtccgaacgccagcagcgccgcccagaattccagtccggtggccacgttgaggatcagcatgcccagcacgctgaacgacagctccttgggattggtgagcacgtcgatcagctgccgtgcgtaggccttgaccaggggcagcagcctgtccgtcgcgtaatgccggatgggcgggatcatcatcgccacggcaagcgccatcagcacgatgccgacgatgacgatcagggtgttcgtcggaatcatgctgctaagcgcgtcgctgcctgtgaatatgccgatgacgaacagcatgagcactgtgccgccataatacacggccatgacggcgctcatgatcgcggtggcggtcgtattgcggtagccgcttttgcgcaggaactgtaggttcacgaatgcgggtccgacgccggcgggcatggacaccatcgcgaatccttgcgcgacctgtgacatgaagatgccgagcgggttgcgcttgtcgcgttcgatgaaggccccgagctccagcgcggagccgagcagggcgatgagttcgaagatcaggcagacgatcgccatcaccgggttggcgttcttcaccgcggagatgacctcgtcgggcttcagttgggtgaagatcaccacgacggcgacgatcagcagcaccatgccgataaaggagcgcgggctgaaccgggacagggacaccggctccatggcctcggcggtctcctgcggggccagcgcgcgcatctcggcgcgcatgtcgtccacgatgtgcttgttccagcccggcagggcccgcgtgccggcgggaacggccgccttctggatgaatggggtcagcgagatcatcgtgtcgtcgccgagcacgtcacggcctgcggtgaccgcgcgttcggggccgatgagcacggcgagcagcaacagcagttgcacctgatccagtgcgatgttcggggccgcgctggcgtcatccccgttctgccatccggctatgatcggcgtgccggattccagtcgcgcgagggtgtccggcgtgatgcggcgatgcgtgtacccgcgcttgttcgccaccgacaggaaacgcagcaatgcgatggcgtccttgtcggacaacgtgttgaggttgcactcgtgcatgatgtcgtcgccgtgcagcaccagaatcgaagtctcgccggtgtcggccacgccgtagaccttgggggtgggcaggcccgcattgcgcaatcccaggatcatcgccatatggtgctgggtcgcctctctcggcgagcggtcgcgccgcatggcgacgccggtgaaccggacccactgccacagctgtttgacgtagcccgccgtgcgcgcctggctgtccagagcggagacgacgaaggcccgtccccaatcatccacggcgtcgtacagtcgagatccttcgaccagatcgtcgtcgagggtcgaggcgagggagccatgggacaggtcgacgtccatgcggcgcttcagcgaggtgatatgcagtccgatgccgttgagcgcctgcacgagatcctcgccccatgcgccctggttcttggtgccggctgcgaaccggatcagcatgccgaccagccggcctacggacagggacacgataactccggtcacggagttgatcgacagcaggatcaggatggccgacgagatgtagaggatgttccatccccatttgaccgtcgatcgtgtacgccgaggccccgcgacggtcaacaatgccgcggaacccgcgtagaagtccggcagcagtcccgttccgatgatcgagctcggcgaacacagcgcggtgataagtgtgaagttcccgaaggtcgacacggccatcgatatgccccagacggtcgctaggccaccgaacatggcgagtagggccaacgccgattgcagccactcccgtcccaccagcagctggacgatggccataacggcgatggtcacgatggtcagctgctgcagcatcgaggtcggaagatcgaccatccagttcagtgcacgtccggcgctgtgggcatcggactcgactcccgtgacgaaaccgctcaggtagatggaggacagtatggccaccgctgcgagcagcacggcggagatggcgtggaccagatcgccgaaatcgtggatgcggcgcggtgcgacgtcctcgatgaccgggtgggccgtggtgccggatacgtcgtcgctcatcggacgcgcgtccggcgacgccttggaatcgtcatcgccggacgttgcggttatcgtctgatcgttcatcaccgttcctgtgctgattgatcgtcgatggaaatgggaattatcggacggctcagcggtcgaagtcgaccagcgcgccggcgacgcccgtgtaggtggcgggggtcagcgccttgagccgcgcggccgtggcggggtcgaaggactgctggtcgatgaagcgctcgaccacctccttgctgatctcatggccgcgcatgagttccttgaccttctcgtatggcttgtccatgccgggcaggcccttgagctcgcaggcgcgcatcgcggtctggatcggctcgccgagcacctcccagttggagtcgagttcgcgttcgatgacgatgttgttcgggtggatggacttgagtcctcccatcaggttgtacagggcgagctgcgagtagccgagcgccgaaccgatgttgcgctgggtggtcgaatcggtcaggtcgcgctgccaacgggactccaccagcgtggcggagagcgtgtcgagcagcgagcaggacagttcgaagttggcctcggcgttctcgaagcggatcgggttgaccttgtgcggcatcgtggaggagccggtggcgcccttgacgggcacctgggcgaacacgccgcgcgagatgtacatccacacgtccacgcacaggttgtgcatgatgcggttcgcgtgggagacggtcgagtagagctcggcctgccagtcgtggctttcgatctgcgtggtcagcgggttccaggtcaggcccatgcggttggtgacgaactcgcgggagacggcgatccagtcgacgtccgggcaggcggccagatgcgcgccgaaggtgccggtcgcgccgttgatcttgcccaggtactcctggttctcgatgtgcctcagctgacggttcagacggtagacgtagacggcgagctccttgccgagcgtggtcggtgtggccggctggccgtgggtgagggagagcagggccttgtccttgtattcctcggccttggcggcgaggtggtcgatgatctccttgaacgccggcgtccatacctgctccatcgcgttcttcacgcaacgggcggtggacaggttgttgatgtcctcggaggtgcaggcgaagtgcacaagggtcttgagcgcgtcgttgatgtgggtgagctcggccggcgctttgtcgagctggtcgtcgatgtagtattccacggccttcacgtcatggtgggtgacggcctcgtgcgcggcatgctgcttgatgccttcggcgccgaagtcctcggggatggcccgcaggaaggcgatctcggcgtcggtgaacggctccacgccttcgacgatcggctggttgccgttgccgtcgaagccgttggccagcaggatcatccattcgacttcgacgcgcatgcgctcgcggttcagcgccggctcgctcagatattcgacgagaggtgcggtctgcttgtggtagcgtccgtcgagcggggtcaatgcaattgcgggggtgatgtcagtaagcttcatagcatcccagattacttccagccgtaaacctgatgcgaaaccgatgcatgttcgtttctcccccgttcctgatgccttcttcgtcccggcatgtcgttctcctctcgttttcgtctgctgactgctgttttcccgtgtttccggtgcgtgcacgcccgtcagtcatgcgacatgcgtccctcgtagtatcgggtgtcgatgagttcgccgtcgatgatctgctggaaatgccgttcgtgcgcgtccacggcgggcgagccgagatcggtggcgttgcggtacgcggcctgatggtatttgagccaatgggatatctccttagtcttcggcgcgtcggccaccagtgctccggcgtagttcgactcgaccgaaccggtgttctggccgggcgtgcacgacccgttggcgttcaccgtcggcggcgtgacgccggtggtctgcatgactttgccccttacagtgagccattgttcggtcgaagggttgcggccgccatcgagcgaggcgacgagctcgtcctcgatctctatgctggtcacccaggtcttgggcggtatcggatgattggcgacaggagagccggcggtcaccacgtgatcgatggcgtaggagtccttcaggtcggaggccagggccgcggccacgatgccgccctgggaatgccccaccaatgccaccggctcgtccttgccgatgccggcttgtctcatggcttcctcgaccatgcggaagctgtccgcgttcctgcgtcggttggcgttggagctcatgagttcgaggttctgctcccatccgaacggcgaatcgtcctgcccgtccgtgcccggtatcaggattagccagcctgtcgtcccatcggaacggcggtatcgctggaccgctatcgtcgcataactgagtccgctgttaagggtgatcttgcctaggcgttcctcggcgagccgtcggaggttttccatggacgaggccacggaatgcgaggccccggccacctgagacgtggattgcacctcacgcacggtgagtttgttgccctgcatggcgttcttgaacttcgacgtgtactttgcgatgcgttccgcggcgccggcgacctgggtaccgccgaggatgtgcgcgatgcggttgttcgtgatgcgtcccgccagcgatgccagcagctcctcatccattttcgatgtggcatcgagcgcccgcacggggttgagcttgccgtccttgatggagcccgagacgaatccgtagagcgacagcatccccagcgtgttccatccgacgctgggcagcacggtcgtcatgatctgcgcggccttgcgaagtttcgtctccgccttggtctccgcttcgtcatacaggctgtgggcgcggacgatcagatcggcgacctgttccaggtccccggcgagcgtggcgcactcccgcgcgtgggtgacgcattgctccagcagacgcgcatatggcatggagacgtgaccaggttctccatcgccgccgctgccggccagcgcagggcagaacgccgcgcccgcacggtcctttcggagctggtcgtggaccaccgaccagaagaaccccgcgcccttcatctccttcgcctgattgcgcagcgatgccacggcggccgtatatcgttcacgggttgccggggcgtattgcgtgcctccgtgtatcgacgaagtgaccatccagttcatgatgagcctccgctccaggcgagttgcccggtctgccgcacgcggtcgtcgatggatgccgccaacctcgtatcgcggtccaatgttcgtgcgcacagtgtcgccgcattgccggtccaatccaggttcttggcggcggccatcgcggttctggactgttccagcgcgttggaggtcagccgttgcagggagccgatgcgctcccggctggacccgacagcggtgcggcaagggcagtcggcgccggcgatcgacgccatcgcgttcccccatatcgggaacgcgccgttgaagatagtgcaggtgttcatggttccatgaacgcatgcacggccatccgcgcgcaagcggagcggaacatgtggtcgaaggctcccgacttatccacacactcggcgtgtcatccacagcaaatgtggacgacgagaccggcgccgtcgcggagcactgaatggagtgatgcgcaatggcgccctcgctggcggactgagccgtgaagcgagtagaggggctgtctgcatgcgaagccgcctggggcggtcccgggtgcctctcatccgcagcgccacttgtgccgtggcccgtctttccatcaggggagaatcggcctgacttcgccgccgattgccgtgctaaggatgccgtgccgggatggcacaccaggggaaaaacatgggaaaaatgcattgtgtggcttttgttgtgccacacaatggaatgtgagccttctcattacgtggtatggcagaaagcgaatcacagaaaccgccattttccaatgattcgggaaaacgctctgatatcggcgttgccacaccagcccaaaaaccgtcgaaaatcgtgtggtgtggtacacggacaaccggaaccggacagctggaaccaggcggcgcccggggccaatcaccatggcttggtggtggagtttgtgttggaggagcttttgcccttaccgcctttggagccgttctgcgagttggactgctgattcgacttcagcaggtcgtccacttgcttgcgctgctcctgcgtcagaccgccgctctgcttggcgttgccgtccgatccgggcgcggtctgcgcgttggaggtttcggtgttttgctgcttctggagctgcgcgttgatgcgttcggtcagcgtggcggagactgacgcgttggtgtcgatcacgtccttgacttgcggcagtagcaacgcggaccatgcggccgcgtctgcgaacctggcgtcggctttttgctggagtgcgctgagcgtcgacaggtcggcgtcatccttggaagcggccttcagattgccgttcagctgcgaggtggcatcgtcgaatgcggtgacagcgatgaggttcgcgccggccgcgatgcccgcgcacaggcaggccatcgcgacgatgccgatcaggatgcgcgaccatagcggagtgcgcgctactgcgcggtctttcgcctcgcggccgttcgcctcacgcttcttcactgtgttgcttttcatcgcacgattcgttgatttccgggatttcatagcatcctccgtgacatggcgatccatgcgccgatctcccaggcgagcagcaggcccagcgccacggcgaacggccatatcacgggaatcgtacgctcccgccgtttgaccgtctgggtgagcctccactgtcttgatgccttggcggacacggcctgttcgatggtgtgcgaggcgtccacgtgcaggtatgagccgcccatctcatcggcgatggattccagcgtggcctcgtcgagcttggatattcctggcttgccggtcgtcgggtcggtcacccactgcccgtcggattgctgtcccgttgctgtgccgtcgctggccatcggtatcttgccacccgcatcagagcccacgccgatggtgaacgagtcgtcaaggtaccgcctcagcgcagaatagctgcggcgtgcggtgtcggaggtctgctcgccgtccgtgatcacatatagcacgatgatgtcatcgggatgttgatccctgattgatttgagcgacagcatcagctggtcgagcggcgtgtcgagactcgatccggccgatgtggacgtggattcgacggccagcgtgtcggcccagccgtcaatggcgatggagtccggagtcaacggcacatccagggtgccgctcgcgccgaagcgcaatgcggcgaaactggaatcggcgtacgtcgacgtgatgcccttcacgatgcgcttggccgcgtcaagacggctgattgtgcccgaggagccgtattccgcgtccttgaccgccatcgatccggtgacgtcgaccgccaccatgacatcggtggcattgatagcccggctggtggtggtcgtcacgatgctgggcgtcagcatcatcacggcggcgagcaggaacattatcaccctgcgtatgcaggcggtcagcgtctcatcgctggagcgcctgcgccgcacatgcacgacgaccaccgcgaccgcgaacgccagcatgagcgccgcgatcgcgccgcccgcgatccaacccagagccggggcgaatgtcatcggtctcatcgtctcaacctccatgccagtatcatccatatcgcaagcagcacgaccagcatcagcgtccaccatcccggcgcgtcgatcagcgcggcctggcttgaccgtcggctttcgctggtacgccggctgtcaatctgcctcaccagctcgttgatgtcggatgagcccgactgggtgaggaacgttccgccgcgggactcgatctgctgcttcatctcggtggttgtggcgtcgccctcgctctggcgtggcccggagaacaggccgtccacgctgatatgcgaggcttcagccatatcgagcgcctgggcgagtgaatacgtcggcgtgccggacgccacgttgtcggtggcgagcacgatcgaggcggggcgctgccgtgcggcgccggacgtgtcgccataggcgaagccgggtatcatcgcggcgcagctgaccagcccgtccccgatcagtgatgtcgagttcttgcggttctgcgtgccttccagccaatcggcgatcttttggtagtccttgtcgctcatcttgtcgatgtcgtcctgcgattcgacgccacggagcgcgtccgccgccttggtcagctggctggagaccaggtcgtagtcgtcggtcagggggaacaccgtgcgcgatgtcgagttgaagatgctcagggcgatgcgttctccctggaaatggctcaccagttccagatatgtttcgatgaccgcccggtcataggggagcgccgaacctgacacgtcgaggcacaacacgatgtcgcgactgctggagcgttccgcgtcacggtccacatgcgccggtctggcgataagaaccgtgcagatggccagcgccgccaccagcgccgccacggcgatccgccccagcaatcgccacagatggaacagatgcgatgcatgctcggtattgaggtcgtcgtcaagactgtataccggcatgccgtcccgcgggggacgcctgcggcctcggaagatcgcgatgacggccaccagcactgccgcgacgagcacggccgccacggcggcatacggccacagccaatggatgctcatgtcgttcgtggtcatcagcgccacctttccacgaggttcagcacccagtcggcggcctgttccacggtggcgtccttcgcctgcgcgttgaactcggcgttcgcgaactccggcggatacagcgcggctatggtctggcgcagcagcgtgaaaccgtggactcccgaatcacttgccagagagcctgcggaacgtgacgcgatctcctgcagcgtcgtcgaaccgagctccgcgctgctggcctgcgacgcgaagtccctcgccacggcggcgagctcgacgaaggcgtcctcgcgcgaaagcttcccggccccgttgcgctccacgatgtcgtgcacgcggcttttccattgcgagacgggggcgaaggcgttgtgggaccctcggggagcggctacgcgtttcgcacgtcgaggacgggacatgatgacgatcgccacaatcaggatcagcaacgcgatgaagcacgccatcgtcactatgggcagcagagacgcgacgggcacgtctgtcacgggatgcaggtcgttcacgtccacggctgcggccagcgtcgacgaggtcacgaaaccgttcatgacgttcatgcaggcacctccgacgtcaggttcagcgatggcggcacacgcagctgattgcggatggaacggccgagcgaacgcgacaccagccgcacgaaggcatcgaacatcatgtcgctcgacgcggcgcggatcattcgcgaaccacgtttggcgagttcgtgctccagagcggcgcacacgtatctgcgatgcagcgccacctcttccgcggccttcgcgttgcgcagcagggcggggatgcggcgcccggattttccgtcataccattcgcgggcggcctcggacgggtcgaaggggttggccgtcgccacggtgatcagcaccacggggtgggtggcggctatggcgccgatgacgtcgatgtgacgcttgcgcagggccagctcgtcggtggcaagcacgatgagcgcctgacggtcgcgtatgcggcgcgcgtaatccagcagagcgtcgatgttgcggccgtatgaccaatcccgccgcaaggcgtcgtccagcgtgcgctcgaactgcgcgaacccgccgttgaacggcatgcgcgtgatgctgtgggcgtcggcgaacaccagggagacgtcatcgctgcgccgcagcgacagcgcggcgaacatgcgcagcgcgttgcctgcgaccgcgtaggccggctcgcctgacgcgcatcctccggtcatctcctcgccgacatcgcacagcagccatacctggctggtcgcctggcgcgcatgctgcacgaccatcgggcggccgagacgggcgctggctttccaatcgatgagacgcgcctcgtcccccggcccgtagacgcggatgtccatcgggtcgtcattgcctccacgccggttcgaggcgtgctcgccctccaggacgcccagcgccttgcgaacggtcggaaggctcagcgaattgcccaacgcctcgatcttcctgcggatccggtcgtcggaagatgaggagtgtgaggggtgtgagccatcgatcatgggacgtgaaccgtttccacgatccgatcgatcacctggtcgctggtcacgccgtcagccagcgcctcgaaggtcaggatcacacggtgcctgagcacttcgtggaccatcatcttcacatcctcggggatgacgtaatcccggccggcgagtagcgcgttggcctgcccgctgcggatcagggcgatcgacgcgcgggggctcgcaccgaggcggaccgtcgagctcaggcccttcagcggcttgtttccggcaccgcgcgaggtcgccaccagatcgacggcgtagcgcatgatcgcctccgacacatggacgcgccgcgccgatttgcgcagaaactccacatcctgaatggtgatcgtgtcggacggcagtgatttcggatcgaacatgtcggtgccgcggcgcgtgagcatcgccagcatgctcgtctcctcgtcggccttgggataggtcatgacggccttcatcatgaatcggtccatctgggcttccggcaggttgaacgtgccctcctcctcgatggggttctcggtggcgattaccatgaacggcttgggcagctcgatgcgttcgccgccgatcgtcgtggcaccttccgccatggcctcaagcatcgccgactgcgttttggcgttggaacggttgatctcgtcgagcaatacgaaattggcgtggatcgggccgatctgggtggagaaccgctgggtggagaagtcaaacacctgggtgcccaccagatcggacggcatgaggtcgggcgtgcattgcactcggcggaacgttcccgagaccgaggtggccagcgtctgggccgcggtggtcttggccaggccgggcacggattcgatgaggatgtggccgcctgcgaccatcgtggcgatcagcgcttcgcgcaagtcggactgtccgaccagcgtctgggcgaatctggcgcggatgcggtcggtgagttgccgtgcgcgtcgcaggtcatcctgcgtcagcgcggcggaaggcgccggcacgggcgtgcgcatgggggcggccggcatggcgcccgtcgtggggatcgcgttcgcgagctgggacggcattgaaggtttcgaggtgaataaagccatgctgcccaccttaccgtgacgaagcaaccgcggagtggggatcgggccgatccgcctgcgccgatggcagcgaccagtcgaccggttccgcgcccatggagaccagtgcttggttggcgcgggagaacgggtgggagccgaagaacccgcgggatgcggacagagggctgggatgcggcgaggcgatgatggtcgcgttggtgagcagcggcgcgaggctctgcgcgtttcgcccccagaggatcgccaccagcggcttcggcttgccgtccgcgtccacccgggcgttaagggcgcggatggcggcctcggtgatggtctcccatcccttgccctgatggctgttggggcgtcccacgccgacggtcaggcacctgttcagcagcatcacgccgcgctgggtccaaggtgtcaggtcaccgttgtcgggcatcggcacgtgcatgtcgtcgacgagctcgcggtagatgttgaccaggctcttcggcagcggtcggacgtcgggcgccacgcagaagctcaggccgaccggatgccccggagtcgggtagggatcctgcccgacgatcagcaccttgatcgagtcgaatggaattgtgaaggctctgaggatattatggcttgcgggcaggtactgacgtcctgcctgcagttcggagcggaggaaatcgcccatgtgatggacctgcggctccacgtcctgcagcgcggcggcccatccgggctccacgagctgcgacaatggtttgactggatgttgactcatggtctctactgtagcgagcgtgtcgaagctgtgcatatccggtgcatgactgacggccgtcgcgcacttgggacaccatggccggtagacttgacgaacgatacggaagggtgattatggccaaggacaaggaaacatacgattcgtatgccaaagacgtgttcgacaatcctccggcaggtccggtgggcgtgcatcggggcgcgcggtcggccggggcgcgcatgacgcctttcctgatcgtgctgcttgtggtggccctggcgggcgtcggcacatggggtgtgctgtcgggaatgttctccgacgtgctcttcgggaacaacggcacgtcgcaggcggccgacgacaaggcgtccgacagcggcgactcgaagaccggcgacacgacgaagtccggcacgggcgagcagtccacttctagttcgactgacggttcctccgacacggcttccaatacctccacggattccgcccagagcgatacgacatcgagcagcagcgacggttcgaccgatgccaccgacacgaacgggcaggggacggactccaccgcctcgtccgacgcgcagtcgacgccgccggccaccgccgaggcgaacaaggccacttccgtccgcgtgatcaacggaaccaagatctccggtcacgccgccagccgtgcgtacacgctcaagcaggccggatacaagaacgtcgtctccgccaacccctccggtacgttgcccgcgagcaccgtggtctggtaccagaacgagaccgatgcggcgaccgcgaaggacatcgccgtgaccttgggcatctccgacgtgcggcagatgtcgggcatctccgcacccgtcgtcgtcgtgctgatgcagtgaccgtacatcggccgagaatccgcgtccccgtaggctttgtgcgaatgtcccctagtaccgtacaatgatatggagtcgcgaggtgggggatgcggtgcggttttgagctctcttccgtttgttcgcggcataggaacaagggaaagaatataacaatggcacagggaactgtgaagttcttcagcgctggcaagggttacggattcattacctctgatgctggtggggatgatgtgttcgtgcactactcggttattcaagccgatggtttcaagacgctgaacgagggcgataaggtcgagtacgaggccgaacgtgggccgaagggaatgcaggccacgaaagtggtcaagctctgaatcgtgcgaggctttgcgcgtcatcgaagctccggtacccaatgagtgccggagctttttccttttctttcggctttaccggatcggtatcggcatgctccggccttcgcggatcacgcgatgatttcaagccaacagcgcaatcctcatgaatatgttggcactcgggcaccgagagtgctaatctcccaattagcactcggggagtgagagtgacagccggcagctgacggtcggcggccacgcctcgcccccaggtgagattcagtaccgtgaagccatttggaggatacacaaccatggcaaagatcattgcatacgacgaggaagctcgtcagggcatgcttgcgggtctcgacaagctcgccaacaccgtgaaggtcactctgggtccgaagggccgcaatgtggtgctcgacaagtcctatggcgcaccgaccatcaccaacgatggcgtctccatcgccaaggaaatcgatcttgaggatccgtacgagcgcatcggcgccgagctggtcaaggaagtcgccaagaagaccgacgacgtcgcgggcgacggaaccaccaccgccaccgtgctggcccagtccctcgtgcacgaaggcctgaagaacgttgtcgccggctccaacccgatcgcgctgcgtcgcggcatcgagaaggccaccgacaccatcgtcaaggaactggtcgccgccgccaaggacgtggagaccaaggaccagatcgccgccaccgccacgatctccgcagccgaccccgaggttggcgagaagatcgccgaggctctggacaaggtcggtcaggacggcgtcgtgaccgtcgaggacaacaaccgcttcggccttgaccttgagttcaccgagggcatgcgtttcgacaagggctacatcgccccgtacttcgtgaccaacgcggacgaccagaccgcggttcttgaggatccgtacatcctcctgacctccggcaaggtttccagccagcaggacgtcgtccacatcgccgagctcgtcatgaagtccggcaagccgctgctgatcatcgccgaggacgtcgacggcgaggcgctgccgaccctcatcctgaacaagatccgcggcaccttcaactcctgcgccgtcaaggcccccggcttcggcgaccgtcgcaaggcgatgctgcaggatatggccatcctgaccggtgctcaggtcgtgtccgacgagctgggtctcaagctcgactccatcgacatgtccgtgctcggcaccgccaagaaggtcatcgtctccaaggacgagaccaccatcgtttccggcggcggcgacaaggccgacgtcgaggctcgcgtggctcagattcgcgccgagatcgagaagaccgactccgattacgaccgtgagaagctgcaggagcgtctcgccaagctggccggcggcgtcgccgtcatcaaagtcggcgcggccaccgaggtcgaggccaaggagcgtaagcaccgcatcgaagacgccgtgcgcaacgccaaggccgctatcgaagagggcctgctgcccggcggtggcgtggcgctcgtccaggctgccaagaaggccgagtccgcagaagccgtcacttcgctgaccggcgaagaggccaccggtgccgccatcgtgttccgcgccatcgaggccccgatcaagcagatcgccgagaactccggcgtgtccggtgacgtggtgttcaacaaggttcgcgagctgccggagggtcagggtttcaacgccgccaccgacacctacgaggatctgctggccgccggcgtcgccgacccggtcaaggtcacccgctccgctctgcagaacgccgcgtccatcgccggcctgttcctgaccaccgaagcggttgtcgccaacaagccggaaccgaaggccgccgctccggccgccggcgccgacatgggctactgatccgctctcggaatccgccatcgcagcgcggtagcgcgttgcagcagcggatgccgtaacacggatttgccgcgatgtgaagggcttcgacctgttgagggtcggagcccttttcgtatgtctgcgggcgtaccggagcggatcaccgccgtgatactgttcagccggaagcgaacagtcgggacgcctgcgcttcggcgtcggcgtagacggtggatgcctgggtgagcgcctgctggatggattccagcgacgcctccatctgctgctgtgccgcacgccactgcgcgctcaccgaagtgaactgcgtggcggcaccgccacgccaggcgtcctggagaccgttgaggttcgtatacattccgttgaccgcctgccggatggcggcgatggacgccgaaacggcggcggaggaggattggatccgttcggaatccacttgatattggggcatggttgttcctttcctgtattgttctgttttcgcccggtgacgttgaagcgtccggccggtaatgtggaggatatgacattgcgaacgatgagatacggaaaaacggatgatgtggtcgaaggctcggccattttgggggttatcggcgtgtcgcgcgacggattttctctgtggaaacggctgttttccgcggttttgacggtgctggtcataacaatgtggataacttcgcccggtgcggtcgcatacgccgccggggacgattcgtcgtcctcggaccaggggcaggccacgttctcccaggacataaccgatccctacaacgtgctcggctccaatctgacgaaagttacggacgccatatccagcacctacgacagcaccggcgtgtcggtcaagctgtcatacatgctgcatttcgagggggtagaggaccccgaccaatgggcgcaggaggcgttggacgccaccaaccccaaaccgaacaccgtgctgctggccgtggccctcaacgacggcaagctcgtggtcgccgtctccggcaactcggaatcgtggctgtacaacaagaccacgtcggaccagctgctgaaaagcgcctacgggccggtcagcggcaggaaccccgactggtccggctcggcgatcgccatgatggattccatcgccacgatcaagacgaccacagcgcagcgcggcacggtgtggaaatgggtgggcatatccgtgatgtgcggcgtgctggtggttctgatcgtcatcggcgtcgtgacggtggttcgccgtcgtcgcgatacgaagggcaagcagccggatgccgagaaggacgcaggaaaatccacagagaaagccacgaagaaagacacgggcaagtccgccaagaagcggcgctccaagggtgatgcagccgagtcggactccccggcggaggacgacggcaggccgcagtccgcttcaagtgaatccgacgagcagtccgctccgtccgtacccatgacgcgccgcgaacggagggaggcatcccggcgcggaaagcggttcggaacgtcgtcggccgccaccgcgcccaagccgggcaacaccgacgaagccgccgacgaaggctcccgggagcgtttcgacgcgtggctggcgtccattgtcccgcaagacacagatggtgttcaggaaacatccagaacatcgagtcaagctggtaaccatgagcaagccgattgaagcatccattgttgttgtcgacgacgaaccgtccatccgtgaactgctcgtcgcatccctgcatttcgccggattcgatgtggccaccgccgcatcgggctccgaagccatcgaggtgatcgagaagacccagcccgacctgatcgtcctcgacgtcatgctccctgacatcgacggattcaccgtgacccgccgcatccggcaggagggcattggcgcccccgtgcttttcctcaccgcccgcgacgacacgcaggacaaggtgatgggattgaccgtcggaggcgacgactacgtgaccaagcccttcagcttggaggaggtcgtggcccgcatccgcgcgattctgcgtcgcacccgtgagcaggtggaggacgatccgatcatccgcgtcggcgaccttgagatcaacgaggattcgcacgatgtgtcccgcgccggtcatgcgatcgatctgagcccgaccgaatacaagctgctgcgctacctgatggacaacgagggccgtgtgctgtcgaaggcgcagatcctcgatcacgtctggcaatacgattggggcggtgacgcggcgatcgtcgagtcgtacatctcgtacctgcgcaagaaggtcgacggcatcatggtgaccgacgacaacggtgaacagcacaaggtcaccccgctgatcgagaccaagcgaggcatcggctacatgattcgcgagcccagagtctcggcgtgaggcgggcgcgatgaccgcacagacacctccgccgacgggtgacggaaccgccgcaggcccggccccggcaccgggaaccgcgccgaccggcacggtcgggactccgggaaccgcgcagatacctccgccgacagccgcccctgcgagccagaagcgtgcgacccataccaagggtgtgtgggcgacactgaaatcgatgttcgtcgggcgtctggacgccgttccgctggccaccaagatcgtggcgtgcacggtcatcctgctgatcgtgggtacggccggtatatcactgacgttgcgccagctggtcggcaactacatgctggagaagacggacacgcagctgttccgtcaggcgcaactggtcctcaacaacatcgataccatgcgtcagcagaataacgccgagaaatccagcagcagcctgctgtacagctacttcgtgcagatccgcgacagcgacgacaccatcttgcgcaacgccatcgtccccactctcaaggacggcgtcagttcgatgccgttgctgcctatggacggcagccgcggaggcgtgcagctccagcagccgttcaccaccaacgccgtcgtgacgttgagcgggcggagcgtggaccattccacgctgtccaccgccgaatcgccgtggcgcgtcgtggcgctgccgtggaccgatgaggacggcaagcccggcggcgtatgctacatcggtctgtcgctgagcgaccagcttgacaccgtaaagacattgacccgttactgcatcatcgtcggcgtggccatcgtcatactcggcgccctgctggccacgctgatgacccagagaacactgtctccgctgaagcgcatcgagaagaccgccgcgaagatcgccgccggcgacctcacacaacgcgtgcccccggcgccggagaacacggaggtcggttcgctgtctgtctcgctcaacgccatgctcacccgaatagagcagagcttccacgagcaggaggagaccacggcgaagatgaaacgattcgtctccgatgccagccatgagcttcgcacgccgctcgcggcgatccacgggtatgcggagctatacaagatgcagcgtgacctgccgggtgcgctgggacgcgccgatgagtcgatctcgcatatcgaggattcgagcacccgcatgacggtactggtggaggacctgctgtcgttggcgcgcctcgacgaggggcgtggcatcgacatcactcagcaggtgccgctgaccacgctggtcacggacgcgaccgaagacctgcacgcgctcgatccgggccgtgagattcgccgcggcacgctgacattccagccgcgcaacggggatgagccggccgatctggagttcgtcgaaggcccgctgcccgatgtcacgttgaaaggcgacgggtcgaggctgcggcaggtggtcaccaacatcgtcggcaacatccaccgctacacgcccgccgactccccggtggagatatccgtcggcgtcatgcccgcgtcgatcagccccgaatcgttggcccgcatgtccgcgaatgacgcctcgatgcgctacttcatcgaagccgtggacgtaagccgctccatgcagatgggcatgaactacgcggtggtccgcttcagcgaccatggtccgggcgtgcccgagaactcccgctccaagatcttcgagcggttctacaccgcggacccgtcccgggcgcgtctcaaaggcggcactgggcttggcatggccatcgcgcagtcggtggtcaaggcgcacaagggcttcatctgcgcgaccgactcccagggcggcggcctcacgctcacggtggtgctgcccatagcgccgctggagccgaagatcgctgtgggcgaaccccctcaggacgccaaggcggaacgcaaggccgaacgcaacaaagccaagcaggagaaacagcaggcgcggcagcacaagagcgagtgattcgcgtccggtgcgctgccgcgtgccgtgcgttcatgcattgaggtaaactgatactttgatgtattcatgagcagatcgagaatctgccggtccgacgagtaacgaggtgtgccatgcccagtgggcgcgtacgttggttcgacgcgaaaaagggattcggattcattacgaacgacgagggcgaggacgtgttcctgcccgcagcggctctgccggatggcgtgaccaccctgcgcaaaggcgcccgcgtggagttctccgtgatcgacggccgcaaggggccacaggccatgggtgtgacgctggtcgcatccgtgccgtccctggtcaaggcgacccgcccgaagccggatgatatggccgccatcgtggaggaccttatcaagttgctggattccgcgggcaacgagctgcgtcgccatcggtatccctccgccgccgacagccggaagctcgccacactgctgcgtggcgtggctgacagcttcgacgtgcaggaatgaggggacaggggatagtacatgcctgaaacgaccatgcctgagacggttgtggacgaacccggtatcgcggattcgcccatcgcctccatcgacccgaaagacgctgcccgtgccatggccgtcgaggctgccgaggacgagaacggcgtcggagagttcgtcgaggccatcgacgccggtgacggcatcaccgattaccggttcgtctcgctgatgcgcggctacgagggatggcagtggtccgtgacgatgttccacgatgtcgaacgcgacacgtggacggtgaacgagtcaacgcttattcccatggaacaggcgctgcgccctccggaatggattccatggaaggaccgtttgctgccgaccgacctgtcggtgaccgactccatcggcaccgacccggatgatccgcggttggaggaaggtttccgggcgaccgccgaagccgagaccggtgacacgcgcgtttcggatgcacgggacgtggaggcggccggggccccgggcaaggtcgatgccgcggatgaggcatcggataccggagcatcggattctgaggcgcccgacagcgaacctgtggagtcccaggacgctcagcccaccacagctgcggaggatgtcgatgacgcggtgagcgcattcgatctgtcccgccgccatgtgctgtccccgctgggccgcgcccagaccgcgcagcgctggtatgagggccctcgcggccccaagtcgttgtccaccaagaccgcgtcgggcaatctgtgctccacctgcgggttcttcgtcgcgttgcagggcgatctgagcgaaatgttcggcgtctgcgcgaacaagtggagcccggacgacggcaaggtcgtctcgctcgaccacggatgcggcgaacattccgaaatcgagccgcccgagccgagccacatgtggattcaatccaagcccgcgttcgacgacctgcatatcgatgtcatcgcgcaggcgccgcgggacgagcgcggcgaagtggagctgatcgagaagctcggtgccgccggcctgccgttcgacgtgcccaagggcacgatcatcctcaaatcccagctgcctgaaacgcgctgacccgaatcgcccgcaacacgggcaacgtcacggcgaccgaatggcggaatgacgatggaacgataatcgcctgtgacaccacgcgaagcggtgtcacaggcgattcgtctatatccggggttgcgcatccgggccagcgcgcgatggcgctcagtgcacgatggtgaccgtgcactccgcgaagttcaggatctgcctcgacacggaaccgaggaaacgggcgtccaagccgctcagaccgcgggatccgacgaccagatggctggcgaaccgggatgccgtggtcaggcccttggccgccgcgatgtggaacgccttgcccgtcacctgaagcccgtcgggaatatcggcctgctcgatcatgcgacggacgatgtcctgcgcgtgatcctgaccggcgccgatcgaggcgatcgcgttctcatagccgggcacctcgcccagatccttcagctgccagcagaacatgacctgcagtggggcgtgatgcagcgcggcgaaatcaatggcgaaccgcaacgcatgacgggacgtctcggaaccgtccacgccgacgaccaccggacgtttgcccttggccgcggccagctcatcatcatggtggatcggcataccgggggcgagcgaatgcgcgatatcatcctgcacgctcttgtcctcgttgccggcgatcctgaccaccgtcaccggcaccttggcggattcggcgagggaggacgacagcgaccccacgaaccatctggtcacgcgacccagggatcggcggccgacgacgatctgttgggcatccgctccgatctgcagcagtccagtcgtgccggaggcgtgcacggaggtgagcttcaggttatccgggtcgaatgcgatgccggcgctcgcctcattcacccaatccagcagttgctcggtgatggccttgctcgccttctcccacgcgtcgggattgtccggctgagctcccatatcccacgaatgcgtccacgcatagaccgcgttgaccgccctgccgctcaaggacgcctccctgagcgcccactgcaaggccgtgaacgactcctcggagccgtccaccccaacgacgatgtcgccggctccgtccgacgtccgcggctcggactcgatgttcacatctggttgcgtcatgacatcctccttgttggcatgttatattcagcatatcgtttttcattgcgttatgagcgcaattatcgcgaggaaaggcataaacgtcatcgcgaatcggtagagtggtgtggactatcgagatggaaggacaagcatgttcgaacggtttaccgaccgtgcacggcgcgtgatcgtgttggcgcaggaagaggcgcgtactctccagcacaactacatcggcaccgaacacctgctgctcggcctgatccgcgaaggtgagggggtcgccgccaaggcgctcgcatccaagggagtgaccttggacgacacccgcaagcaggtcgaggagatgatcggcaaaggcaatgccgcccccaacgggcacattccctttactccgcacgccaagcaggtgttggagctgagtctgcgcgaggcgctgcagctcggtcacagctatatcggcaccgagcacatcctgctcggcctgattcgcgaaggtgagggcgtgggcacccaggtgctcatcaagatggatgtcgacctgggcgaactgcgttcggccactatcgacatgatccatggcaacagcggcggcgccaacgcctccggcaagggcgatctggccaacgccggcggcgtgcaggacaagcgcagccagaccggttcggccattctggaccagttcgggcgcaacctgaccgccgaagcggccgagggcaagctcgacccggtgatcgggcgcaccaacgagatcgaacgtgtcatggtcgtgctgtcgcgccgcacgaagaacaaccccgtgctgatcggcgagccgggcgtcggcaagaccgccgtcgtcgaaggcctcgcgcagaagatcaacgccggcgacgtgccggagacgctgaaggacaagcaggtctattcgctggatctgggctccatggtggccggctcgcgctaccgcggcgatttcgaggaacgcctcaagaaggtgctcaaggagatcaagacgcgcggcgacatcgtgctgttcatcgacgagattcacacgatcgtcggtgccggttcggcggacggcgccttgggcgcgtctgacatgctcaagcccatgctggctcgcggtgagctccagaccatcggcgccaccaccaccgacgagtaccgcaagtacatcgagaaggacgcggcgctggaacgtcgtttccagccgattcaggtgcatgagccgacaatcgcggagaccatcgaaatcctcaagggcctgcgctcgcgctacgagaaccaccaccacgtgaccatcaccgacggtgcgctgcagtccgccgcggagctgtcgtcccgctacatccaggaccgcaacctgcccgacaaggccatcgacctgatcgacgaggccggcgcgcggctgcgcatcaagcgcctgactgccccgcccgagctcaaggaacttgaccagaaggtcgcgaaagtcgccgccgagaaggacaaggccatcaaggaccaggacttcgagaaggccgccgagctgcgcgacaaccaggagaagctggaagcggagcgcaaggagaaggaatcctcctggcgcgagggcgagtccgatgtcgagatggtcgtgaacgaggatgtgatcgcccaggtgatctcctcgaccaccggcattccggtgttcaagctcacccaggccgagtcgaagaagctgctcggcatggagtccgagctgcacaagcgcatcatcggccaggacgaagcggtttccgcgctgtcccgttcgattcgccgcactcgtgtgggcctcaaggatccgaagcgtcctgcgggctcgttcatcttcgccggcccgaccggcgtcggcaagaccgagctggccaaggcgctggccgagttcctgttcgacgatgaggacgcgctgattcgcgtggacatgtcggagttctccgagaagtatgcggcatcgcgtctgttcggtgctcctccgggatacgtcggttacgaggagggtggcgagctcaccgagaaggtgcgccgcaagccgttctccgtcgtgctgttcgacgagatcgagaaggcccatccggacatcttcaacacgctgctgcaggtgctggacgacggtcacctgaccgatggtcagggacgcaaggtggacttcaaaaacaccatcatcatcctgaccaccaacctgggtacgcgcgacatcgccaaggccgccaacaccggcttcaaccttggctcgaacgcggagtccagctaccagcgcatgaaggatcaggtcagctccgaactcaagcagcagttccgccccgagttcctgaaccgtcttgacgacatcatcgtgttccgtcagctcaccgagccgcaggtgcgtcagattgtcgacctcgacatcaagcagctcaacgaccgtctgttcgaccgtcacatgtcgctggagctcaccccggccgctaaggacctgctcgcgcagaagggcttcgacccgctgctcggtgctcgtccgctgcgccgcgtgatccagcgcgacatcgaggacgccatctcggagaagatcctgatgggcgaactcgaagacggtcagcgcgtggtggtcgactccgaaggcgagggcatcctcggcgagttcaccttccgcggcgaacagttcgacgacgccaagcccgagaacgagccggctgcggagccggcaacggaggagtcagctgacaagtcggctgacaacgccgctcccgcctcgcaggaggcctgatcgggtaccggttgaccgccgactgaccacccccagtctcgctacactcgacagccccgtcagcgggggcgtgaattggctcccgctggcggggctgtcgcgaagcgactgggggtggtctgcaatatcctcccactcatgccgtcctcaggacggcaaatcacccgcacccatactcccaccatgcgattccatcctgcagtggaaaccgacacaacgaagtgttggcagaaaggaattgccatgaagcagtcggccgtcagaaagtatctggccgcgatcattactttggcctgtgctatgacatgcgataccaattgcacatgcagacggaacctctcccgaaaacgagttggtcaccgtcgtgttggtacaggacgctgagaggatggtcagcgccgacattcccgcacagtatgtgcaggagtataagaacaggctcaagaacgaagaattcaaggccgccgagattgccgaggcgaccggctccgagataagtctcatgaccacgacagctaacaacctgctgaagccaaccgtgacatatttccggaaaagcagctgcttcatgcaattcatatggccggtggtttgtcatacctgaatgtaacgaacggcctattcatgattgctgtcatcgtattcgccggtctgcttggcctgttgctcagtatgatgatgcgtcggcagcggacccgtgagcaggcgcatgagcgcatgctggagcgggagcgtcaggaacatcacgctcagacgctcgattacgccacgcaggtgcacgactcgggcggacgcggtatccgttgatcggttgcgtcgactatgtgacgctcttcgagaagagcttgccggcaagggattccatggaggggtcgcgctgcacgacaatggactcatggaagacatcgacccgatcatatgacgctgcttggcgagccgctcaatgaaatcgcccataacatcatccggcactgcccggcaggttgcgaattcgattgcagcgtgatgcttcacgatgacgtcgcagaagtcacccagtacaattccgtgactcatccggccgataaaagtgagacggcggtctccacacatatgggacttggcctgtatcgtgacagactgctccatttcggcggcatgctgcgcaccgaggtcgaggacggcacttggatgctgtatgcccgtgtgcctctaacgcatcaaacctgaccactgtcgtagcgtccgcggtgtcgtaatacaaaaaaagagcgccgggggagaattccctgacgcccatgccaacgagacgatgacagccggtaatcggtgtgtcggccgaccgtcctgacgacggcggccggccgacacaccgggccggacagcgaatcggcctacttgatagcgttgagccactgctccttggtggccttctccgcctccagcttggccttcttcttcgggtcggactcggccgcgatcttctcgtcaagctcggcgagctgagcggtcagctgctcctcgaagctggacttgcgggcgtcggcctccggatcggtcttcttccacgcggcgtcctcgacggccttgatctgcttgtcgacggcgtcgagacggccttcgatgcggcgcatgtcgtcgcgcggcacatagccgatctgatcccactcgtcttggatggctcccagcgcctgacgcgccttcttcgcggcggcctcgtcggcgacgggcaccagggcctcggccttcttcagcagctcctccttcttggcgaggttctctttctcggaggtgctgatctggtcacggtcggcctgacgcgcgttgaagaactcgtcggctgctttgcggaactgcgcccacagcgcgtcgtcatcgctgcggccgacgcggccggcccgcttccaacggtccatcaactcgttgaaccggcgcgaggtctcgccccatgcggtcgagtccttcagctggttcgcctcggcgatgatcgcctctttctcggccttggcatgggcgcgctcgacgtcgcgggcctgcgaccacttgcggcgggcctggttgaacgtggtgcgtgcggcggagaaacgcttccacagcgcgtcggcctgcggcttgtcgatgtgcacggacgtgcgctgatgctgctgccactggtcgaatagggaacggaacttgtcggcggtggaacgccagttgatctcgtcatccagcgaggatgcgagggcctcggccttctcgacgatcttggtgcgttcttcgacagccttggcgatcgccgccttgcgggccttggtgagctcggccttcttcgcggcaccggcctccttcagctgctcgaactgctgcttcagcgcggccatgtcgccgaccgccgcgggcttgtcggtctcctgctcaagggacttcagcgtctcgtcgatctcgtgcgacttcaccgtgtcggaatgcaggcggctcgccagcagatccaacttggccttgaggtcaaggtaacgacgggcgtacagcgacagcgcctcctccttggagacgtcggggaactgcccgacctcacgctcggagtcgccctccctgacgtacacggtaccgttgtcgtcgacgcggccgaacgcttcggccgtcttcacctcggcgtccgaatagctggatgccgaagcggcgggggcggggcgcttgaccgctttcttggcgaatgcggccggcgaaggggcgtggggtttcggcgcggatgcaggggtcggtgccggtgtgggcgtcgttgcctgctcggtgggttcggtggtgttgtcggatatggtggcagtctcgtcggccatggccagctccttataagcttgaaggtagtcgttggctggggaaaaatccgaatggatttttccgcaacctcccctattatagggaatcgtggctaaaggcgcatcaatatcaggatttccagagtggctcccctctgaacgtgttgtggagcagcgtgtcatcgacacgctccgtagggttttcgagctcaacggtttcatcggcatcgagacacgcgcggtggaacagggctccagtctgctcaagaaaggcgagaccagcaaggagatttacctgctgtcccgtctgcaggaggtcgggcacgaatccgacacgccggtcaatgaccggttgggtctgcacttcgatctgaccgtgccgctgagccggtatgtggtcgagcattccggcgacctcgcgttcccgttcaagcgttggcagattcagaaggtgtggcgtggcgaacgtccgcaggaaggacgtttccgcgagttcgtccaggccgatatcgacgtgatcggcaacggcgacctgcccgaccattacgaggtcgagctgccgctggtcatggtgtcggctcttgaggagctgcgcgcgttcggcctacccaaggcgaccgtgcacgcgaacaaccgcaagctgtccgaaggcttctaccgcggacttggcctgaccgacatcgagggagtgcttcgcgagatcgacaagctcgacaagatcggcgcggacgaagtggcgaagctgctcgtcgacacgtgcggcgccgatgaagcgcaggcccgcgcctgcctggaactggccgaactcaccgccgccgacggcaaggagctcgccgacaagttcgacgcgctgtgcgccgcgcacggcatcgcggacgattccgacgcgtacatgctggcccggcagggactggacacgctcgcgatgatcgtcgacgaagccgccctcatccgcccgggcgcggtgatcgccgacctgaagatcgcccgtggactcgactactacaccggttccgtatacgagaccttcctcgacggggcggcgtcgcttggctcgatctgctccggcggccgttacgacaacctcgcctcgcagggcaaccgcaagtacccgggcgtcggcctgtccatcggcctgagccgtctcgtgtcgtacatgctgcactccgccggagcgcacgccagccgcgtctccccggcatccgtgctcgtcgccgtgtggaacgagcaggatcgctccgccgcgaacctcatcgcgaacacgctgcgctcccgcggcatcgccgcggacgtcgcacccaccgcggccaaactcggcaagcagatcaaatatgccgacaagcttggcatcccgtatgtgtggttcccggctggcgcgacggacggcgacgacacggcatccgacgaggtcaagaacatcgtcaccggcgatcagcagccggccgatcccaagtcgtggcaaccggatactgtgtatgcccggcaaaccgttgtaatcgactgattttcgtcagcgcccgtcctctgccggggacgggcgcgcgttgcagggaaaccattgcatagattgcataagaaagaggaagcatgagccagacggcttacagaacacatcatgccaccgaggtgaccgaagcactcgtcggtcagaaggtgacgctcgcaggttgggtcgatcgtcgccgcgatcacggcggcgtggcgttcatcgatttgcgcgacaacaccggcctggtgcagatcgtcatctacgacgaggagatggcgcgcccgctgcgctccgagttcgtcatccaggtcaccggcgaggttcgtctgcgcccggacggcaacgagaacacgcatctggccaccggcaagatcgaagtcgtcgtcgagaccatcgatgtgctcgccaagtccgatgcgctgccattccaggtgtccaccgcgctcgaaaacgagtccgagaacaagctgcccggcgaagacgtgcgactgaagtaccgttacctcgaccttcgccgtccgtccatgcagcacaacctcaagctgcgctccgacatggccaaggccgcccgccacgcgctggaggagatggacttcaccgaggtcgagaccccgaccttcatcaagtccaccccggaaggtgcccgcgacttcgtcgtgcccgcccgtctggtgcctggctcctggtacgcgctgccgcagtccccgcagctcttgaagcagctgctcatggtctccggcgtcgagcgctactaccagctcgcccgctgctaccgtgacgaggacttccgcgccgaccgccagcccgagttcacccagctcgacatggagatggcgttcgtcgaccaggaggacgtgatggccatggccgagaaggtcatcgccgccatctggaagtccgccggctacgacgtgcagctgccgattcagcgcatcacctggcaggatgccatggacaagtacggctccgacaagccggacctgcgtttcggcaacccgctcgtcgagctcaccgaatacttcaaggacacgccgttccgcgtgttccaggccgactacgtcggcgccgtcgtcttcaagggcggtgccgccaccccgcgtcgtcagttcgacgcatggcaggagtgggccaagcagcgcggcgccaagggcctcgcctacgtgtccttcaccgaggacggcgagctcaagggacccgtcgctaagaacctgtccgactccgagcgcgagggcctgatggccgccgtcggtgccgagtccggcgatgccgtgttcttcgccgccggttcccgcgaatcctcccagttgctgctgggtgccgtgcgcgtggagctcgcccgtcgcgagggcctgctcgatccgaagaagttcgccttcacctgggtcgtggacttcccgctgttcaagcccaccgacgacccggatgacgatgatgtggccgtcggccactccaagtggacctccatgcaccacccgttcaccatgccgagcaaggactggatcgacaagttcgatcaggatcccgagcacgccatgtctgactcctacgacatcgtctgcaacggcgaggagatgggcggcggttccgtgcgtatccaccgcgacgacattcaggaccgcgtcctcaacgtcctcggcatcgctcccgaagaggccaaggagaagttcggcttcctcctcgacgccttcaagttcggcgccccgcctcacgcgggcatcgccctgggctgggaccgcaccgtgtccatcctcgccggtgccgacaccattcgcgacgtcatcgccttcccgaaggccggtggcggtcgtgacccgctgaccggcgccccggctccgatcagtgacgagcagcgtgccgagaccggcgtcgactacgacccggatgccgaagactgagtaacatctcgctgtcttctttgacgagagggcccagaccatgcaggtcgggaccctctttgcatatccgtctgcgcagtacacaggccgtttttccgcagttgtccgcaccctgctacccgtgatgattgccgaactgctgttttgcgttcctaagtgcgcgccgaaacgacaagtgcgcgcacatagcgacgcaaatggcccggtttgcgttcttaagtgcgcgcggtcgtcgtttcggcgcgcacttaggaacgcaatgacggccaaagcacatcagatgcatgccatgtcgaccatttgatgatgggcgatgaggtcgggcagggcacaatgggatcgtgatcaccattggaatcgtggataacgaccggttcgcattgcccatgctggatatgccgctgaccgacattcccggtcccgagatctgccggcgtgttcgtgctgcatcagccgacatcgtggtacttggcatcacatcgtattcgttggatcattaccgtcagctggcgatcgatgcgggcgcccaggggttgattgccaaaagcgtgacgccgaaggaactcgccgaagccatgcggaatgtcctagtacggccgttcccgggtttcccgaccacggaacaggcacatgggtcgatagtgtcggcatcggcgcgacggccccggacactgtcgaagcgggagcgtgaggtgttgggtctgtatgccgacaactattcgacggcggagattgcggagcgcctgggaatagcggattcgacggtgtccgtggtggtgcggcacgcgaaggtcaagctcgacgtcgccgctcggtcggaggccgtgcgcgtgttttgtgcattgtactgagtcgaatacggcttgaacatcgtgcgtctgtttacggtgaccacccccagccgccggtaccgatcgaagccgctgccatgtcgatccggcatgttgatgacgtcatgcgtgtcatgcagcgcccgcatgacgatggagcgcagcgattgtgcttccgcttcctccagcagccctgcgtcgaggtcatgatcgatacgcatgaccgcgtaggcgagatcgttggagattcggtcgtgcacacgcacaagacccgcaaggcgccgcccgaattcgccgcggctttcgtcaccgcggacacgcacgccgacctcaacggcgtggtcaagcacacgctggaggtgtccaaggtcagtttcgcaccgattgacgcggccgtcgaggcgaccggcatggagtcgggcggcatgtcgccgatcggactgcccgatgactggccgctgctcgtcgaccagcatgtgctgtcgattcccaagctgtatctcggctccggcatccgcccgtccaaactggtggtcgacggctcgatcttcgctgatattcccggtgtccgattcgtccccggtctgggcaagccccggcagtaagacgccgtgcggccgcgggcgagtcgcacaggcgagtcgcatgttggacgagaatgtgaacttcttgtgccttcaatagtttatactgctcaatatgtcagaaaaacaagaagcaatactccccgtggtgccgctggtaccgggcaatgaacccacaggacgacctctcgtcgaactgactcacgtggaaaagtacttcggcgacctccacgtattgaaagacatcaacctgaccgtcaacaagggcgaagtgctcgtcgtcgtggggccgtccggctccggcaagtcgacgatgtgccgcaccatcaaccgcctggagaccatcgagtcgggcgacatccgcatcgacggcaaggcgctgccccaggagggcagacagctcgcgcagctgcgcgccgaagtcggcatggtgttccagtcgttcaacctgttcgccaacaagacgatccttgaaaacgttacccttgcgcccatcaaggtgcgccacatggacaagaaggaagccgagcatctcgccatggatctgctgacccgtgtcggcgtcgactcgcaggcgtccaagatgccctcccagctgtccggcggccagcagcagcgcgtggccatcgcccgcgcactcgccatgcgcccgaaggtcatgctgttcgacgagccgacctccgcgctcgaccccgaaatggtcaacgaggtgctggacgtgatggtcgagctcgcgcgagaaggcatgacgatgatctgcgtcacccacgagatgggcttcgcgcgcaaggcggccgaccgcatcgtgttcatggccgacgggcagatccttgaggagaacacgcccgacgagttcttcggccatccgaagaccgaacgcgccaaggacttcctgtcgaagatcctcacgcactgattggtcgtgacgcatatgacggtattcaacactcgcatcaggcgcatcgcccgccgcgcgctcgcggcgctcgccgccgtggcatgcacgatgtcgctggccgcgtgcggcgccgacgaaagcggcaagatacgcatcggcatcaagttcgaccagcccggcctcggcttcaagaaatccggaacatacgtcggcttcgacgtggacgtggccaagtacgtcgccaagaagctcggctattccgaagacgagatcgtctggaaggaagccccctccaagcagcgtgaggccatgctgcagaacggcgacgtcgaaatgatcctcgccacctactcgatcaccgacgagcgcaagaacgcggtctccttcgccggcccgtacttcgtggccgggcaggacctgctcgtgcgcaaggacgaccattccatcaacggccccgaagacctcaacggcaagcgcctgtgctcggtcaccggttccacttcggccgccacagtcaaggagaagttcgcctccgaagtgcagctcatggagcagcccggctatgcggaatgcgccacggcgctgttctccggcatcgtggacgcggtcaccaccgacgacatcatcctcgccggcctcgcctccgcctcgcgcggcaagctgcgcgtcgtcggcaagccgttcacgcaggaatactacggcgtgggcatcaagaagggcgacacggcgctcgccaagaagatcaacgccgccatcaccgagatgatcaaggacggttcctgggagcgcgccatcgccgacaacaccgagggcacgtcgtacacgccgaacgcggagtacaacccgccgaaaccgaccgagggggagaagtagcatggacggattcatccaactgttcagcgagtacaacgttcccgccgcgttcctggtcaacatcgaactgacgctgtggtcggcgctgttctcgctgattctcggcgtggtgctggtcatgatgcgcatctcgccgatatcctcactgcgcaccgtcgccggagcctacgtggaactgttcaagaacctgccgctgaccatcatcatggtgttcatggtgctgggcgcctacgcgcagctcaagctcacgttctccgacacgttcgccacgaacttcttctggctgtcggtgacgggcctgagcctgtacaccgcggcgttcgtgtgcgagtcgctgcgttcaggcatcaacaccgtgccgatcggccaggccgaggcggctcgtgcgctcggattgggcttcatgcagtcggccacgcagatcatcctgccgcaggcgttccgcggctcggtcgcgcctctcggcaatacgctgatcgcgttgctgaagaactccacggtggccgcggccgcgtcggtggccacggagacgtcgtcgctgatgagcacgatgatcgaattccacccggacgtgatcgtgcagatcttcctgatcttcgcgttcggctatgtgattctcatcatcccgatcggcatgctgaccacgtacctgtccaacaagctcgccgtgcggaggtgacgacatggctgatacttccaattccgtattgttcgaccagcccggtcccaagggacgtcgcgccatccgcatcgtcaactgggtcgccgcgctgatctttgtcggcgtgctggtgctgatcctgatgcgcctgcacaacccgccggacggcgagaaccagctgagctgggagctgtggaagcccgcgctggagcgtgaggcgtggaccgatttctatcttcccggcctgtggatgacggtcaaggcgtccatcgtcgccgttgtcggctccgtggtgttcggcctggtgttcggcgtcggccgactgctgccgaacgtggtgctgcgggcgatctcgtcggtcgtcgtggagttctgccgcgcggtgccggtactgctgctgatgatcttcttctggcgctggttcgcgttcgcgggactgtccagcccgtcctactgggcagtggtgctggccctggtgctgtataacggctccgtggtcgccgagctggtgcgttccggcgtcggcaacctaccgaacgggcagcgtgaggcgtcgctcgcactgggactgaccgagacgcagtcgctgatgcagatcgaggtgccgcaggccgtctacgcgatgttgccggccgccgtcacgcagctggtcgtggtgctcaaggataccgcgctcggatcgatcatcatgtacaccgatctgctgcaggagtcgcgccgtctcggctcgatgtacttcaacatcctgcagacgctggtcgtggccgcggtcgtgtacttcatcgtctgctggctgctgtcgcgtctggccgaatggctgccgtcgcgcatgcagcagcgcaccgcggcgccggccgaaccggaaccagttccgccgatcgcgatcatggatccgtccaacgtcaaccagattgccgtcgccaaggaggtcgaggagcgccccctgcgcggcacgccgctcacataccacgtgcaccatcgcggcagcaacgcctcgatccacaactggcagcgcacgcgctacgagcagggcttcgacgaggcccatcccgatccgcagggcggagatgaggacgatgccgagcagaagaacgctgaagacgacgcgtaatgacccggtagattacggcccgcgcaggaatacgcggacagcgtcccgcagcctgacccgataacggccgggccggcactccccgacaggggatgcgccggtccggccgttcgatattccgccgcggaaatgcttcacaaggcggcgcatgggacgtacaatcggggcatggccaaaggcgacggaaaatcggacaagacagataagccggacaagtcgggcaaaggagcgaagtccgagaaaacggacaaacgcatcgacaaggtactgcggctcgccacgaaccgcatcgaaaccatcgaatcgagcacgacggtggctgaacgactcgcgaacgccgccaaatccagtgagctgctcagcgctgtatggtcgctgccgcccgcgcagcgtctcatgttccatcacggcgtgcatatcgacgatgtcgccggagactccacacccggcttcccaggcggcagggatgacgctgaacggttcatcacgctcagctcatcggagatcgcccgatatcaacggctgctgtatgcgaacggcgtcaagggctcgcgccgccggctgctcatcgtgctgcagggcatggacgcctccggcaagggcggcatcgtgcgccacgtgttccggcagggcgacccgatgggcatccactatcacggtttcggcaagccgaccgacgaggagacgcggcacggtttcctgtggcgggtggaacgcgagctgccaaagaacgggtggatcgcggtgttcgaccgctcgcattacgaggacatcgtcatgccgcatgtgtacggcacgtatcccgaggccgaatggtgcggccggtacgatctggtcaatgagttcgagcgttcgctggcggccgacggctgcgcgattctcaagatcttcctcgtcgtgagccaggaggagcagaagaggcattttctcgggcgtctcaacgacccgaccaaatactggaagttcgacatgtccgacctgggcgcgcgcgaacgctgggacgactatatgggcgcgtggcaggaggtgttcgagaagaccagcacgcagaccgcgccgtggtatctggtgcccgccgacaaccgctggtactcgagggccgtggtctccgagctgctgcgcaccacattgaagaacatgaacatgacatggccgggactcgacccggacgtcgatccggacgaggttcggcggctgctggggtgaacttgcgcccgccggtcgattccgcgagctgcgccggcgtgtagactgggaaccactatggcagatacagaacattatggttcgctgggggcgctggcgcccgcgtgggacgagggcgagcgcaacatcgacacggacgagatctacgagcggttcttcggctgggtggccgacgtcaagggcgtcgagccgtggcctcatcaggaagaggccatcatggacctgctggcaggcgaccatgtgatcctcaacacgccgaccggctccggaaagtcgctggtggcgcttggcatgcacttcgccgcgctgtgcaccgggcggcgctcctattacaccgcgccgatcaaggcgctggtctcggagaagttcttcgatctggtcgaggtgttcggccgcgacaacgtcggcatgatcaccggagacacgcatatcaacgccgatgcgccgatcatctgctgcacggccgagatcctcgccaaccaggcgctgcgcgaggggcgtcgcgcggacgtcggctgcgtggccatggacgagttccactattacggcgactcggagcgcggctgggcgtggcaggtgccgctgctgacgctgccggacacgcagttcctgctgatgagcgccacactcggcaacgtcgacgcgatcgccgacaagctggaggacatgaccgacactgacgtggacgtgatcgccgacgcgccgcgcccggtgccgctcacttacgagtacacgctcgatccgctggagaagaccgtcgaactggcgttccgcaagggcgagacgccgatctacgtcgtgcatttctcacaggatgcggcgctcgacaccgcgcagtcgctcgcctcgaccggcgtgtccagcaaggagcagcgacaggccatcgccgaggccatcaagggcgtgaagttcacgaccgcgttcggcaagatactgcaacggctgttgcgtaccggcgtcggcatccaccatgccggcatgctgccgcgatatcgtcgtctcgtcgagcagcttgcgcagcaggggctgttgccggtcatctgcggcaccgatacgctgggagtcggcatcaacgtgccgatccattcggtcgtgctgaccgcgctgacgaagttcgacggcaccaagatgcgtcgcctgcgcgcccgcgagttccatcagatcgccggccgcgccggccgcatgggcttcgacacggagggactggtcgtcgccgaggcgcccgaatacgagatcgaaaacgccaaggccgtcgccaaggccgggaacgatccgaagaaactcaagaaagtcaagcgcaagaaggcgccggaagggttcgtcacgtggaaccagagcacgtttgacaagttgattgacgccgcgccggaaacactcgtcccgcacatgaagatcactcattcgatggtgctcaacgaggtcacgcagggcggtgacgcgcgccggcgcgtcgacgagctgatcgatgactccgcgcagacgccggaccagaaggagcatctgcatgaacgtgccgacgagatattccagaccctgttcgacacgaaggtgatcgagaccgaagagcgcgacgacggtgggctcgactacttcctcgacgtggacatgcccgacgatttcgcgctcgaccagccgctcagcccgttcctgctcgccgcgctggaactgctcgaccctgaatccgacatgtacgcgcttgacgtgatttccatggtcgaggccacactcgaagaccccaagcaggtgctgcgcgcgcaggagcggcaggcgcgcgacgccgcgatgatccggatgaaggaagacgggctcgaatacgacgagcgcatggacaggctgcaggagatcacctatcccaagccgctggaggacatgcttgacgcggcgttcgatcagtaccggcacgacgtgccgtgggcgaacgactactggctgagccccaaatccgtggtacgcgacatggtcgagaccgcctccgacttcaccggatacatctcgcggtacaacatcgcccgctcggagggcacgctgttgcgctacctgtccgacgcctaccgggcgctcgcccgcaccgtaccggacgacaagctcgacgatcagctgcgcgacgtgatctcatggctgcgcgtggtcgtgcgttcgatcgactccagtctggtggacgaatgggagaacgccggcgcgtccgatgatgcctcgcaggcggccgccagtctggccgcgccgggcgcgaaggccgcggtggtggaggaccggcgcgggctcaccgtgctgatccgcaacgcgctgttccaccgcgtgcagctcatggaccttgacaagcccgaggcgctcggcgctctcgacaaggagtggggctacggcgtgcatgagtgggaggacgcgctcgacgacttctacgacgaacacgagtacgtgaacaccgacgccaaggcgcgttcggccgagctgttcatgctcgacgagaagcacgagaacgatgagcacagctggcacgtgcgccagatcatcgacgactccgacggtgaccacgactgggccatcaccggtaccatcgacctggacgcgacgcaatccagcggcgaagtcgtcttcttcgactacgccgtcaccaacgactgacgccgtcggcccccgccagcgggggctggcgcgaagcgactgggggtggtccgtccggtatcgaacctatgttcgataccgtgttgtagagtgtaggcatgactgagaatgatctgttcggggcggcggatgtgcccgacgatatgacgcgaccgttggccgtgcgcatgcggcctcggacggtcgacgaggtgttggggcagtcccatgtgctggggaagggctccccattgcggcgtctggcgaatccctcgtccaaggggtcgctgaccgcgccgagctccgtcatcatgttcggacctcccggcgtgggcaagaccacgctggcgaccatcgtcgcccgtcagtcggggcgcgcgttcgaggagctgtcggcggtgacatcgggggtgaaggacgtgcgcgacgtgctcgcccgcgcgcggcgcagactcgtcggcgacggcacggagacagtcctgttcatcgacgaggtgcatcgtttttccaaatcgcagcaggacgcgctgctgcccgccgtcgagaaccgtgacgtcaccttcatcggcgcgaccaccgagaatccgagcttctccgtcatcaaaccattgctgtcacgttccgtcgtcgtcaaactcgaatcgttggaaccgtccgatctcgccacgctcatcgcacgcgcggtggaagacaagcgcggattgaacggcgaagtcaaaatcgacgatgcggcggtcaacgagatcatccgcatggccggcggtgacgcccgcaagacgctgacgatcctcgaagccgctgcaggtgccgtcaccggagacaaggctcgcaaaaaaggcgcgcggcgtccgaccatcacgccggatgtggtctcgcaggtcatggacgccgccaccgtgcgctacgacaaggacggcgacgaccattacgacgtcatctccgcattcatcaaatcgatgcgcggctccgacccggatgccgcgatacactacctcgcacgcatgctgcgagcgggcgaggatccgcggttcatcgcccgtcgcatcatgatcgccgccagcgaggaggtcggcatggccgcgccgcagatactgcaggtcaccgtcgccgccgcacaggccgtcgcgatgatcggcatgcccgaagcgcgcatcatcctcgccgaggcgaccatcgccgtcgccaccgcacccaaatcgaacgccagctacaacgccatcaaccaggcgctcgccgacgtggacgccgggctcatcggccaggtgccgctatacctgcgcaacgcgccgaccgcgttgatgaaaagctggggcaaccatgacggctatcggtacgcgcacgactggccgggtgccgtcgcgccgcaggaatacctgcccgaggagctgcgcggccgcgagtactatcatcccaacgaccgcggatacgagcacgaggtcagccagcgcttggacaaagttcgctccatcctgcacagtgaaaccgcgccggacggctataccgagtccaaagagcagaacggataaatcgccccgcccggcggggcggccgagcggtagcgaggctgggagtagttcatcgcaactgccactccgccctcgtccggcaatccgttacactgtaatgtggcctgacgcagtgtgggtatcgtaagggcagtccggaaacaactggcgtcggtctgaatggatttcatcacatgacctcaacctcgcaggagcgcatccccaagcgtctgatcggcgccatcgtcgccgtgggctcgctggcattcatcggcatcctcaccgaaacggtgatgaccgtgctgttcccggaactcatgaccgaattcggcgtgaacaccgccaccgtgcaatggatcaccaccgtgtatctgctggtggtcgcggccacgatgccactgtcgtcgttcctgaaccgccgcttccggctgaagtccctgttcatcgcggctgtggtcctcgccgtgaccggttcggcgatcatgatcgtcggccacaccttcccggtcatcctgctcgcccgcgtgatccaaggcatcggctcgggcgtggcgacgccgctgatgatgaacatcatcctcgaacagtcgccccgcagcaaggtcggccgcctcatgggcgtaggttcgctggtgatcacggtcgccccggccatcggccccaccgtcggcggcgcagtgtcgagtgttttgccgtggcgtgccatcttcgtcatcgccattccgatcgtgctgttggtctccctgccgctcggactgcactgcatcgagcagaaacgccccaccgaggacgcgcggctcaacccagtgcagttcgtggcgatagtgctcgccctgagcggcatgatcttggcgctcaaccagatgggcgtcgcggtcagcgctgcggtcaacggctcttcggcgacacgtcccgtcatcatcaccgtcgtgagcctggtcgtcggtgtgggctccctggtgttcttcggctggtcatccagccgctcgttctcgccgctgattcgtctggggtggctacgagaccgtgtcgtccagcttcatctactcgcgtacctgattctgccgatcgtcggcatcggattcggatacgtcatcaccaatctggcccagatgtcgcttggcaccagcgcgttccacgccggcgtcctcgtgctgccgggcgctctggtcggtgcgttcttcgcgcccgtcggaggcatgctgtacgacaaattcggcccgacgaagccgattctttcggcgatttcggtggccacgttcggaccgatcctgctgctggcattctccatgcggttgacgcctgcgctgctcgccggcttctacttcattttcgggctgtgctatgcgctgggattctccaacatcatgaccagtgcgctgagcggcatcgaccacgcgttcatgccggatggcaatgccgtgttcaataccgcattgcagttcggcggtgccgtcggcaccgcactgttctcgatgattctcggcgtggctcaggcgggcgccggctcggccgaaaaggggagtgccgcgttccgtcacgccacggccgtgggcggcacgtggatgttcgcgacgatgacggcgatctgcctgatcgcgatctgctcgcttgcctgcgcgttccgtatccgtgcgtcgagaacggctgccgagcgctgactcccgctccggggatggttcaggtcagagccatcccaccgccagcagcgcgacgacgtaggcgacgcacgcgactgcgaccattagatcgcgtcggcgcgcgcgcattactctccaatgggtgcggtggatgccttcctcgtagcagcgcgcgtcaagcgccagactgagattatccgcgtgacgcagcgccgccacaaggatcggcacgatgatggcgaacagcgctttgacacgagtggccggcgaaccggtctcgatcgtgccgccgcgggccgattgcgcgtcgatgatcgccttggtctcgtcgctgagcgtcggcaggaaccgcagcgcaagactcatcaccagagccacttcctgcgtgtgccagccgatctttctgaacggcatcagcagggagccgaacgcatccgtcatcgcggtgggggtcgtcgtcgcaaggaacacggcacccaggatgatcaccagcgcgagacggcacgaatacagcaccgcgaccatgagcccgccggtggtgatcggcagcgggccgatatgcgcaagcgtctcgccggagcgggcgaagaacatgttcaccaggcccatcaccgcgaatacgatcaggaacacgcgcacggaagacagcaaacgcagcggatgcagccgggcggccgccacgacgcatgcggtcaggacggcgcccatcgccagctgcgccggcctggtgatgacgaatgcggtgaacatcaacgtcaggaacgtcaccatcttcgcgcgcggatccagggacgctacgaatgacggacggttcctggattcgtcttcaatggactcgatgccggctttgccggcgttcgtggaagactcggtggcgtcgccgacgctggtgtcttcgtcgtctccggtgccgcaaccatcgccttcgccgtcgccattatgcgatcctatggtgatgatgcggtccgcgcagtgctcggcctcgtcgatggaatgcgtgatgatgagcaccgccacgccctgacttttcagggaacccagcagcgcgtggatgcgggagaccgccgattcgtccagactggcggtcggctcgtccatgatgagcacacgagggcggcatgcgatgacgcccgcgatggcgacgagccgctgctgcccgcccgacaggttgaacggagaacggtcggcgagatgctcgatatgcagcatccgcagcgcctcctctacgcgggtggccacctccaactcgctcagatgctggttgcgtgggccgtacgccacatcctcggcgacggtgtcagcgaacagctgacgctccggatgctgcatgacatagccgacgttgcgccgcagggccgcgcgttcttttcgggtgagtgcgcgaggccgtttcccgtgtttcgacgacgcgaccggtaatccggccacggtgatcgatccggcggacgggcggtccaaggcgcacagcagacgtgcgagcgtggtcttgccggcgccgttggcacccatcagcgccacgatttcgccttcggcgacgcgcagagaaagattctcgaaaaccggggcgtcgccatcgtcataacgatatgacaggccggatactgcgatggcgtcggatgctgagcctgtaggtggaatgggtgatgcgtccgacttggtagacgccggttttacgggttgtccggatttcgctggttgcgcgggcgacgcggccgcggtggaacctccgggctcctcagctgccgactccgtggagcctgcagcgtcagtcgcgtcagcgtggctccgcgcaatcacttgcttcgccgcgatcgcttcgacctgcgtgagcagcccgccgtctatgcgaagtacgcggtcggcgtgcatggtctcgtcatgatgatgcgtgaccagcacgatcgtcgtgccacgccgttgcagcatgtcgaggatgcgcatcacctcgatccgcgcgtcgggatccagcatcgcggtcggttcgtcgagcaccagcatgcgcgggttcatcgccagcattccggcgatggcgatacgctgctgctggccgccgctcatgcgcgtcggatccgcgtggcggaaccccgccatatccaccgattgcagggattcgtcgatgcgcccgccgatgtcgtcccgagccacgccgaggttttccgggccgaatgccacatcatcctcgacgatggtggtgacgatctgatcctccggattctggaacaccgtgccgatgccatgccgggcatcgcggtattcgctcggattcgctgaagcggtctcgccgtcgaagacatgatggcccagcagcgtcatatcgccgccgtccggggctgcgagaccggcgatcagacgcgccagagtggatttgccggagccgttggggcccaccagacacagccgctccccgctgcggatggtcaggtcgatgccgtcaagcacccatgtaacgccgttgtcatagctgaatcgcacatgctcaagtcgtgcggcgggaaccatgctgttcatatcatccattcacaaaacatcgtggtcaatccatatcatagcggccattgtcaccgctgacggatgcagcccgccagagaggtcatcacccggactgtcggaaataagcctcgtgcgatgaccctcttggcgggctgccctaggcggcgacttcgcgccgcgtcatgtcagcgattcagcaggttcgaaatcggcttgtacactaggaacgtgaccacgccgtgaatcacgaacttgatcaggttgaacggcagcagcgcgggaacgatgatggccgccacctcggagaccggccagccggtgtagatcggcgtgatgaccagattgccggcgatggccgcgaccaaggccagcagggcaccgacgaccaaaccgatgacagcgcccttgcgcgtgtgcacgtggcgatagatgagcgccgccggcaccgacagcgtcaaggccaccagcacggccatcagcgtgccccacgggtccatgaacacgtgcggtacgaagccgagcacactgacgatcgcggctgcggccgggccgtacgcgaagccggcgatcaggcacacgatgccggacgggtcgtatttgaggaacgagaacgccgggttcggcaggatcgggaacgagatgaagctggtcgccatcgccagcgccacgaacagcgcgtacatggcgatgcggcgggtcgaccagcggccggaatcggcgacgccggtcgaatgcgccaaatccgggcgcgtcggcttggccgcgttcgacgaatcggctgaattgggttgcgaagatacactcatggtgagctccgtttcttccatccggactttgaccgttggctccggattcccaccggatcagccgcttgcgcgggtcgcgggctgccgcggccgccgttatgaatcccggctccgcaggtcaccgccagtaaggaattgcaccttccctgaaacttgcttgaccatgtatacgccggggtgtggatgattgacgtaacgttgcccacatagcgaacatgaggcatccatgcgcgtaggtggccccatccactacgttgtgaccggttttcgcgctgtataccggcgcaattgcccatttcgacacgatttcgttatacaatttcgcgtacagccactatgacgtgcgtgtcgcacaccatccaacaggaggtcatgatgattgataccgctcaagcgtttggcgtggatatcggcggatccggtatcaaggccgctccggtcgacctgaacaagggggagttcgccgagcccaggctgaagatcctcaccccgtccgagtccaccccgcaggcgatcggatcggtgctgcgcaagcagctcgaacatttcgaggttccggagacggttccggtcggcatctctttccctgctccggtcaagcccggccagaagctgaattggatcgccaacctcgaccagtcgtgggtaggcgtcgacatcaccgaggcgctgtccgaggagtgcggccgtccggtcacggtcgtcaatgacgccgatgccgccggcttggcggaacagcagttcggcgcggccaagggtcaggagggtctggtcgtcgtgaccacgctcggtaccggcatcggcacggcgctgatctatgacggcgtgctcatcccgaacaccgagctcggccacatcgagctggagggcggcaagggcgacgccgagcgctacgcatcctccgcggtgcgcgagcgcaaggagctcagctacaagaagtgggccaagcgtctgaccaagtactacagcctgatcgaaaagtacttcagcccctcgctgatcgtcatcggtggtggcgtgagccgcaagagcgacaacttcgtgccgttcatcgacatcgatacgccgatcgtccccgcgaagctgcgcaacgaggccggcatcatcggtgccgcctactacgccagcaccaagtagcgcagaggacacaggcacatacattcgcacgccacaccttggccgaccatcgtcccggcaatgcaggacgcatggtcgcggtagggtagtggcgtgcgtttttcttcccgagtagatctgagcgagcccaatcccatagccgcagccgagacacattgccggcgcgaaggcatgcccctgggcaagctcaacgattccaatcccacacgtcacggacttgcaccggcactggtgccgggcacgtacaccgccgacccgagaggcccgcggcccgcacgggaggcgctggcctccttcctgaccgagcttcaccggggcgccgaaggtgccggcaccgcgccggcggcggatccgaatcgcctctatctgctgagttccacgtcacaggcgtactcgtggctcatgaagctgctgtgtgacgcgggcgatgcggtgctcgcccccaagccggggtatccgctgatcgaatccatcgcccgcctggaatgcgtcgacactatcgaataccagctgcgtttcgacgggtcatggtacatcgacgtcgccgagttgcgcgcgctgctggacgggccgcagggggcgcgtatacgcgctttggtgctcatcaaccccaacaatccgaccgggtcctacgtcaaggcgggggagcgcgagcagctcgtcggcctgtgccgcgagcgcggtgtcgccatcatcgccgacgaggtgttctacgattacgcactggagccgttccccggcaatgcacggctcgccggcgaggcgggggcgctgacgttcgcgttggacgggttctcgaagatgctcgccgcgccccatgccaaggtcggctggattcaggtgtcggggcctgagacggacgttcgcgaggccatgcgtcggctggatgtcatcgccgacgactacctgccgatgagcgacatcatcgcctcccgcatcccggacctgttggaggcggcgaaggtccagaccgacctcgtgcgcggccgggtgcagggcaatctcagggcactgcaccgcatgctggagtccgacctgctcggcgtcgtctccgtgctgcgggccgagggcggctggaacgtgctgctgcgcgtgccgggcgtcatcgacgagaacgagctggtgctgcacatgattgacgcgcatggcgtctccggccagcccggctatttcttcgacatggcctcgaacggctatctggccatatcgctgctgcccgaaccggacgaattcgcgcataacgtgcgcgtcgtgctggactcggtggccgaattgctggggtgattgtcgaaggacgctctcaaaactcgcagatacagattccacgttttctgcgttttggccattttccgccgttttcgcgtaaaagcggaaaacgtatctgcgagttttgagagcgtgctttccgctatcgtgccactttggaccgaatcaggtcctcatagaacgcggccgcggcggcaggttccccgtcgaataccaccgtgtggtcgtcgaccaccagcgcccggtcgatcgcgtactgcggccgtgtgatcatgtccacgtcatgcgtggcgaaaatgacctgcttgttgtagccgaacagcgccttcgccacgtgggccgagccgatctcgtccaggcccttggtgggctcgtccgccacgatcgccgcgggggagaagctcaacgcgctggcgatggcgagcaggtgccgctgctcgctgttgagcgagctggccgactgccgagccacggtgctgagcccgaaatgcgcgaacaggttgccgacgatagccagccgctctgattcgggcaccttgtgctttttcaacggctggtcgatcgcctcgcggatggtcgccgcacggtagtaactgtcggggatctcctcgcggcggacacgcccgacgatgtcctcgatgcgtttgagatcacgcttgacggcggggctgagcgcggtctcgccagcggtgatggagacggatccgctcgtggcggccaatgctccgtcgagcagcttgagcagcgtggtcttgccggcgccgttcagcccgatgaccgccacgcgcctgtcgtcgggtgtgatcgtcagcgatgtgggaagaagcccgacggaaccgtcctcataggtgtgtccggcttggtccagcgtgaaggtcacctgcgatggcaaggcttcgtccttgccgaagagcgagtcaaaaagtcccatgactcctatagtagcggcatcggcgcattcgcatcggcccgcatcgcgaaaaggcccggcggccgccggtacgcggtcgtcgggccttctcgtcatggcctgcgggcgatcgtcttcgcgtcaggcgaagtcgttgtcgaacatgtagatgtagtactggccgtcgggcagcagctggatggtgttgaagtggatccagtcccagctcccggatgcggccggatcggattcatcgatgccggagtggccggtggaagccttgtaatcggggaacatctcgccgaagtcgacgagcttcgtcaccttgccggtgctcgtgttgaccttgatggcctggtcctgcacggcatggtcggatcgtgtcaggtcggtggcgagggagacgatgttgccgtcatcgtcgagcgcgtagtcgtggtggaggatgaaccggtcacccaggtcgatgatcttctccagctttccgaaccggttcatgccgacgaaatgcttggtcgacgcggagaaccacatgagcccgttgtcgtcgaacagtagccggtgcgagcggtcgcacggtaataatgcgcagaggaaacgctatgtgttgtctggcgatttcctgaatcgcatgaatgtcgattatggcgggcggcttatacgtgtcgcggtccggtgccgtccgcgacacgcccgcgggcgtctacagcctgaaccaggcgacgaccgtgtcgtagaggaccggattgttgttgatcagcgagtcgtcgcggcccgggatgaagcaggccagcacagccaggatgatggatgccatcagcgctgccacaaccagtccgcggacgcatgcgagcaccatcgggtgacgcttcgtgacgtctcgccgaggctcgttgcgttccgacggatcgggcgcactggccacgatcgcgtcgccgtcgggatgcatgagatacagcatcggcgccagcgcggcgattgccatcatccacccgaaatcgcagatgtagcgccatcccaggcccgcggtgtggctgtcgaacaccgccagcagcaccgccagggccagggagcacgtggcgagcccccagtaacccgacctgtgcatcctgcgtcgcaggaacggggccgccagcgcgagcagcagcagcgggcatgtcgcgaacaggccgccggccatcagctcgtaatagccccattcgcggaacgctatgggcgtcatgccaatgaaggggaactccgacgtgaaccgcaacggcaggaacaggtaggcgcccaccgacggcaggaaattggccgtcggctgcacgaacctggtcatgtcggtgacggtcatctggtagtcattgccgaaatccagcggcgacccgaaccgggcgacgttgtaggccatcagcggcagcaccacgatcagggcggggatgatgacggcggccggcgctcgcagggcccttcgcgggggcagggagcggcttttcaacccctgcagcagcgaggtgatctgcggccagaagatcgggaagcacagcagcgcggacagcgcgaacgtgggccggcatccgaaattcgccgcgatgcatgccgcgccggcggcgagatagcgcagcgatagtggttgggcgcccgcgaccgaccagctgcccacatggacgtgctccccgcgcccgggatgccgttcgggtgtcgctttgagccacagccacaggccgagcgtcgtgaacatcagggatgcggcgaagggcacggagtagaaattcaggcggaaatgcagataactggcgttcgagccgagcaggaacatcacgatgacgatggacgtggccgccaccgatgcgttcgggcacagacggtgtgtcagccgtatcaccagcaggcatgcgaagacggcgaacaggaacatcatcagcagtatgcacacggacgtgggcagcatcatgccgccgggcgtccatagggacgttatcgcacggaacggcaggaagaacagcaccacgggcaccacgccgaaatacgaataccagtggccgccatagaaggcataatcccagaatatctgcgtcttgccggattcgaacagctgaccgcgcaccaggatgtcatgcgggttcgcagcctgcgccagctcgggggagaccggcagatccagccacacgcggccgttcagcagcgactgcgcgacatggtcgtactggtcgaagtcgtaggtgtagccatgcgggttggggaacaccagcggcccggagacgaggaattcgccgacgatgcgcaccgtggtatagatggccagcggggcgaggaatgccacgagcgcccaccgctgccgtacgctcgcgggattgagccgtatgcgccacaacgcggagccgggtcgccacagcgcgaccagtagcgccaccgcggccatgattgacacgcgcagccaactgaactcgaagggaacccgaacgttagctctgaccgcggagaacgggatacgagagcccacgggctcctcgatccacaggcgaaccgagctgcccggcttcaccttaaggtacagcgagcgcggcgccgacgtggagacggaggtgatctcgccggtgcgcgaatcggtgtcggcgcgcacgaacacgttgctcgccgctttgacgtcgccgccttcgggcgtgttcgccgcctcgatgcgcacgtatgacgacgtgccgtccgcactcacttccatgtacgccgacgtcgggtcggtgacggtgaggatgccgtcctcgccgcgtttgagaccgtctcccatgacgttcgtcgccgcggcggaatcggtgctggcaccgagcgtggtccagaacggcatgttgaatgccacgcattcgatcaccaggatcgccagcagcgtcacaagcatggctggcagtgaccgtcgcatgtggtctcgggaaatgatggaagaacgcaccccattattctatcggcttcatgtcgggttggattgaaagaatgtgtgccatgttccgaaacgcttcacacttcccgtcagaaggctctcttggagggctgatctcaggcctgtccggcgcgttgcgacaggtgggggacgccgccgcgtccgtactgggcgggcgtggcgttcgtatggacgaggacgggcagggaccgttcgaggcggcggtgcaggccgcggccgggtccggcaacgacacggatgcgatgatggccgcgctctcgaagcattcggtgagattgacgccgcttatcaagcgccgcgtgtttcccgacctgcccggtgtcccgcgcggtgtggcgctgggatgggcgcagctgacctcgggggagggcgccaccgtctcaatagggctgttcatcgggcatgaccgtttctcgcagatcgcgctcgccgacgggaacgggcgcgtgttcgtgacctccgacccgcatgccgatacgcatgatatgaagccgcggttcatgctcgtcaaggaggaggagctggacgccgtcgacggcgcgagattcggcgcgaaggcgcggccgccgtctgcggtgacgggggcctcgaccggcgagtcggcgggcacggtccgcgcgtttcagggcggcatcgtgggacgggacgccacagggcgcatgacatggcttgcctcgtggctgaagacgggaaaccggtacaccctggagcagatgcgctccccgctgcctgcctcgctgcggcagcgtctggagtaccgtgacgccatctccatcgccttcctcgccgcatacatgctgcccgaaatgcgggggctgctcatcgggttcggatcgggcaacatcttccgtcgcctcaaccgtgaggcgccgatgggtgccatacgccgcagcatacgcgacacgatggaggctcgcgcgcacggcatgcgggcatccggtctggaggatcatttcgccgacctgatgcaagaggccggcgccctcgaccatgcgtccggcctggaggcggtgcacggggccgaaccgctgcacctgtatacgtccagttactccggcgggtatttcttcgcgtgggactccggactggagttccgcgccgcgctgcgctcgctgagaatcgagggcaatctcaaccgtttcgccgcagtgagcgcgtggatcgaacgatccgcccgcaacggcggcgtgaccgaggacacggtcacgcgcgcgcaggccgcgcagatcgatcttgcgctgctggacgatccggcgctgatggcgctgccttgggaagggaaccccgcgatatccggaatcgatttcccgcacgacgacggcgtggcggcgatacgacacgtgtggcggtacgcgggcgagaccgctgaccggatgcttcaagacaatccgaatcccgcgggcgggcggctcggttccgacccaggggcgtcagaatgggtgtaccgtcaggcggtgtcccggctgctgcgccagctgaggctcccgtatcgcttcgacatggaattccgcagcaatctcgaacaggggacgaccgcggtggcgttcaccacggcgggcccctccatgatgccggaaagccgctatgacgagcgcgcccacgattgggtctcgttctcgcagggggaacgggccgccatgagcgccgcgtacaatctccgcgtcgggctcatcatcgcggcactgtgcttcggcgcgagcgaacgggtcgatcaggtgtgcgtgcgcatcgattccatcggtctggaagaggcggtcgccgagcaggacagcgcgatctccgatctgatgagcgcagcgctgcgatcgttcgagcgcctgcacacgggcgatgccggcgcgtccaaggccgatccgaaggacggcgaccatcacggcgatccttcgcatacgccttccgcggagccggcgcctgatgcccgcacaccgcaggcggatgccagaggcgcccaggacgcgaagacggattccgccggtgagtccgtttctgcgaccgtcggggatgatgatctgcagtcgttggagagcttcgccgacatgatgaaggacatcaatttcgaagacttcgtacgggactccccgcaggaagtccaggactccgactccggcgatacgggtcaggcggatgacgccggagcggcccccggcggcgaaggcaacgaagaaggcgacaccgaccccatggatgcgctgcgccgcagccccaccgtgcgaaacctcgtcaccgtaacgttcaccaggcaggagttgctgcagcggctgcgcgaagacgcgttgcggcaccccgccgacacctatcgcctgttcggcgcggtgatggacatcgacgagcggggcggactcgcccccatcagcgccgaattcgacctgcgcgacgcgaggttctccccgacgggctcccaggaggagccggaactgtcggacaaggtcttcccggcgactgtcgccggcatcctcggcacggacaacgccgagggcctgtccatccagcgggcggacctgctgcagcgctgcgtcgacgaattccaccggctcgccgccgacgggaccctggcgtcggtctccaaggcgcagcatgcgatgcatgtcatcgaccgcgtcgccgatccggagctgtccgaattgtcgtcacgcgtcaccagtgcgctcatcgacggtaccgacacaccggacttcaccttccagctggcggacgaactcgaccgggaacgcacgcgggcccgcgacctgctgttctccggtcaggacgatcaggccgtgaccgtcgccgaagcggccatcgaacgtgtggaatcggcttatgccgacaatccgggcgtgccacggtatttcaactcgtatgccgagcgcgtcgtctacaaccgcctgttcgccacggacggcgaacgcacggtgctgatccccgacaacctgttctacgcgcacaccgagctggcggacctgctgtctcagctcaagggcgcgaaggccgcgctgccgcaccttaacgcgatggtggcgtatgctcccgcttacccgttctcgcacatgaagctcgcagtgcagctcgcccgcaacgaggattgggattccgcgcgcgcggcatgcctgaacgcgctgcgcgtggcgctcgaccgtgatgacgccgcattcgcctactaccggctggcatacgcggaatggatgcgcgaccgtttcgatatcgccgccgcggcctacatcatgagcgagcacatcgcaccggggcagatcggggcgcttgacggcgagctgagggaactgctcgcacgcgccgaatcccaatgcatagcggtgcctaccgacgtggagtcggcagccggcgtgctgcgcatgcacgatctgccggtgtggccccacacccaggtcgccgcgatcgtgcgcgacgccgcccgcgtgtgcgtggacgagggcatgttcgttcccgcacggacgctgtcgatggcggccgcccgtatgaacgacggcgacaacggcggtgtcgacatggtgcagtcccagttcctgagatcgctcaactcctgatgccgtggcgcgggcgtcgccgaggcgggttcatgttttcgattacaatcgaatccagatgaattcgcacatacgaaggggaagtgatggctcgcgcagcggtttcgcaatcatccggcgaccagttggcttgggatttcgacgatccggacgccggggaggctccggcgccggtcgagaacgaaggcgcatcccggttcgcgcccggctcatcccagtgggtcgccgcgctgcagtccacggacgctgatgcggcccggctggatcggctggatgtgtcctcgctgtcgaacgaggttgcagcccgcctgtgggcacgcgtcgcggcgtgggtcgaggccgaccagatcgcctattacatcgatgacgcgccggtctcgtccgacgcggcctacgatgcacgcttgcgttgcctgcaacggctggaggcggagttcccgtcgttggattcaccgcaatctcccacgcaccgggtcggcggcacgttctccaatgatttcgcttcggtgcggcatccgtcgcgcatgatgagccttgacgacgtgttctcgatcgaggagctgcgcgattggtacgattcggtgctgcgtgatttggactggcctgagggcaagccgttgccgatgacctgcgaggtgaagatagacggtctggcattgaatctgatataccgcaacggcgtgctggaacaggggctgacgcgtggcgacggcgtcaccggtgaggacatcacgctcaatgtgcgcacgatcggctccattcccgccaatctcggcgggccggccgcggatatccccgagttcgtggagatccgcggcgaggtgttcatgcgttgggacgatttcaaggcgctcaacggtgaacaggaggatgccgggcgccctccgttcgccaacccgcgcaatgcggcggccggatcgctcaggcagaaggatccgcgcatcaccgccacaaggcggctgagcttttacgcgcatggcatcggtacgctgcgctggggctcggggcggcccgccggctcgcatgacgtcgtcgccgaccagtccgaggcgtacgcgctgtactccaagtggggagtgccggtgtcgccgcacaaccgtgaggtcacgtcgttcgcgcagatcctcgacatgatcgactattacggcgagcaccgcggcgacatcgagcacgcgctcgacggcatcgtcgtcaaggtcgacgatctcggcctgcagaggtcgctgggcgcgacctcgcgggcgccgcgttgggccatcgcctacaagtacccgcccgaggaggtcaacaccgaactgctggacatcaccgtgcaggtcgggcgtaccgggcgcgtcacgcccgtcgccgtgctcaagcccgtgtatgtagcggggtccacggtgtctcgcacgacattgcacaatccgttcgaggtcaagcgcaagggggtgctgatcggcgacacggtggtggtgcgcaaggccggcgacgtgattcccgagctggtcgggccggtcgtggaacgccgcaaggggcgtgaagacgacctgcgcgaattcgtcatgccggatcgttgcccgtcctgcggatcgaagctcgcaccggccaaggagggagacaaggacattcgctgcccgaacgtggaatcctgccccgcccagctgaccgagcgcatcatcaacctggcttcgcgcaaggcgttcgacatcgagcatctgggcgaccagtcggccatcgcgctgaccaacccagaggagaaccggccggattcgccggatacgttcgctccgaacatcaccgagattctcgtcaagcccggcgaggagccggagccgtacgagcccgtggagggactgcggctgccggaacggcagaagccagtgctgtcgagcgaagcggggttgttcacactggacgccgcggcgctcagggatgtgcgcgtgtggcgtgaggccgcgatcatcgagatccatgagacggtcacggctgacggcaagaccaagcgcactcgcaaacgcatcggtggctcgggcctatggcatcaggtcccggcgttctggaccgcgcccacgccggcgaagaagctttccgcgcgacggcaggctgcggccggcgcgccggccgacgctgcggctgagccgtatccgggatatgacgtgccggccgatgcggtggtcgtgcgcgtcgatcggaagaccacgcgcaacggcacggtcgacgtccccgtgtacgtccgccccggcgagaacacgcgcaagatgttcgacgagatggacaaggcccggcacgccgacctgtggcgggtgctggtcgccttgtcgatacgtcgtctcggcccgcccacggcccgtctgatcgcctccgccttcggctcgctggaggccatcgagcaggcgggcgtggacgagctgtcggccattgacggcatcggcccggaaatcgccgaatcggtggtcaattggttcgccgccgcccgtgagccgagggattggcggggcgagacgctgcgcgcctggcaggcggccggcgtcggggtcgccgccgccgagaccagcacgctgccgcagacgcttgccggaaagaccgtcgtcgtgactggttctctggagggattctcgcgtgattccgccaaggaggccatcatcgagcgcggcggcaaggctgccggctcggtcagcaagaaaaccgattgggtcgtcgtcggcgaaaacgccggctccaaggccgccaaggccgaagaacttggcatccccatgcttgacgaagcccaattccgcaccctcttggaaaccggcgccgtgcaatagactgccgccccctctccgctgacggagggctgtcgcggagcgactggggtggtccatgcctataaacccacccctcagtctcgcttcgcgagtcagcttccgccggcgggagcaagtacccgccccgcgctttgcggcccatttcacagggtggatttcacgccgcctctggcacgccgtcgattcacacgctagtctggtacgcggcaataaggaggataggatacatgacagacgcacgccacatcgaggcgcagatctacgaacggctcagcaaagtcatcgacccggagctcggacgctccatcaccgatctggggatgatcgccgcaatcaacgcggtgggcgtcacctcccagggcgacatgccgtcatatgacgtgaccgtgcatgtggaacttacggtcgagggctgtccgctgtcgcagaccatcaccaatcagatcaacggcgcaatcgtctcatatcccgacgcgaagctcaccccgcacatcgaggtctcatccatgagccatgacaagctcgccgacctggtggcgggtctcaaggcggagcgcaagcagaatccgttcaacaaaccgggcgtcaagacgcgcatcttcgcgatcgcctccggcaagggcggcgtcggcaaatcatcggtgagcgccaatctggcggcgaccttcgcggcgctcgggtacgacaccgcggccatcgacgcggacatctacggtttttcgctgccgaagctgttcggcgtgcacacgcagccgacgaacctcaacggcatgctgatgccggtgaccgcatggggtgtcaagctgatttcgattggcatgttcgccggtgccgaccgtgcgattctgtggcgcgggcctcgtctgcagcgttcgctggaacagttcctgtcggacgtgtggtggggggatccggacgtgctgctgctcgaccttgccccgggcaccggcgacatggcgatttcggtggctcaggcgttgccgaacgcggaactcgtcgtcgtcaccactccgcagccgtcggcttcggatgtggcggtgcgctccggtctggtcgcattgcaggtgccgatgaaagtacgtggcgtggtcgagaacatgagctggtatgagcataagggcgagcgactggagatcttcggcgcgggcggcggtcggcgtgtgtccgatcaactgaccgagacgcttggctatgacgtgcctctactcgcccagctgccgctcgaccccgatttgcgtgaggtgggtgagtccggccgtccggcggttctgaacgaggacggcgcactgcgctcggatgccctggggcgcacgttccgggagcttgccgagggtcttcttcgcagcgaatgattctcaataagaaaggtgcgaggattgcgcacaaatacgcacagtcgcacattcctgggagtggcggaatagagccgtttctgcatatttcgtgtgcgtttggccggcagtcggactcgcacctttcttattgagaaccgttcgctgcgagccagtagtgcaaataacgctgccggttgacgatgtcccgcaccatctcgatgaaggcccgccttgattcctccgtccgcaggtcatccgcggtgaccatgatgatggtccagccattgtgctgcagctcgttgaaccgcgcggcgtccttgcgcatctgctcggggctcgcatgatatgcgccctgatattcgaatcccaccttgcagtcggggtaggccatatcgatcagtctggttccgtgcctaagcctcactcggtaattcgcatacggcctgccgagccccgaatccaagagaatgccgaaaagaggtgtttcgggtggtgaatccgtgtcctcgacgatgtacgggagcgcctcctcgcattttctcttccccgcgaaacgggggctcgcgtcgagatatgcggcgaagtcgtctttcctggccttcttcctgcgttcctcgcggctggcaaacgccgaggctatcgtcgccagggcttccgtgtcgcagtaggttgccatctgcgcccatgccatggcgggggaggccatccagaaccgttcatattcgtatttgcagtattcctcctttccggagaacacatggaatgtgactccggcgatgtgattgcgatcctgtgcgcgaggcacgctgacatggacgcgattcgacgccagatcggttttcggcacgggagctccccagtatcgtatggcgttgatatatccgaccctgagcggtctcttggtgcgcatggcggcttcattgcagcgtttgcgttcgttccgccgcccgttgactatatccgtgttcatgaatcccatggggcaacggtatggaatggaatgtgccgatggcaagcgatttcggggtatgtggtcgaaggctaggcatttttggcatgtcttcggcgtgttatccacattccatgtatcagcgaacggttctcattaagaaaggtgcgagtcggttctgcaggcaaacgaacatgaaattgatgggaacggcgttattccgccgatatgagaaatgtgcgattgtgcgtatctgtgcgcaatcctcgcacctttcttaatgagaatgattcgctgatacatcgggggggggggaaaaaagagaaggagggagaaaaagatgaggaggggaagagagaggaagagataatgaaaaagcccctcggcactcgccaaggggcttttccatgagcatctatcagatgtggaagtacagctcgtactccagcggggtcggggccaggcgagcctggtcgatttcgccgcgcttgaggtcaagccaggtctcgatcagatcgtcggtgaacacgtcgccggcggtcaggaagtcgtggtcctcttccagggcgttcagggccgcgtcgagggagcccggcacctgcttgatgttggcgtgctcttcgggcggcagctcgtagagatccttgtcgaccggctccgggggctcgatgtggttcaggataccgtcgaggcctgccatcatctgggcggagaaggcgaggaacgggttgcaggacggatccggtgcacggaactcgatgcgcttggaagcgggggaggttccggccagcgggatacggatggcggcggaacggttacgggcggagtagaccagcgaaaccggagcttcgaagcccggcaccagacggtggtaagagttcagcgacgggttcgtgaacgcgaccactgcggaggagtgcttgatcagaccgccgatgtaccagcgggcgatgttggacaggccgccgtagccctgctcgtcgtagaacagcggcttgccgtccttccacagggactggtggcagtgcatgccggtaccgttgtcgcctgcgatcggcttgggcatgaaggtcacggccttgccggcgagcgctgcggtctcgtggacgacgtacttgtacttcatcaggtcgtcgccagcgtgctgcagggtgttgaagcggtagttgatctcctgctgaccggcgccggccacctcgtggtgggagcgctccagctgcaggccgaccttctgcaggttggcgaccatgtcgtcgcgcaggtcctggtagtggtcgcacggcggaaccgggaagtagcccttcttgatgcggttcttgaagccgatgttcggggtgccgtcctcttcggtgtcgacgccggagttccacggagcctcaatggtgtcgacctcgtagaaggagcgctgcatggagttctcgtagcgcaccttgtcgaagatgaagaactcggcttcgggagcgaaggaagcggtgtcggcgatgccggtggacttcaggtaggcttcggccttgccggcgacctggcgcgggtcgcgggagtacggctcgtcggtcagcgggtcgacgatggagaaggccacgtcgagggtcttgtgcttgcggaacgggtcgacgaaggcggtcgtgacatccgggatcagcttcatgtcggactcgttgatggcctggaaaccctgcacggacgaaccatcgaacggcatgccgtcggtgaaggcgttgtcaatgaattcgctggccgggacggtgaagtgctgctgaacgccgatcagatcggtgaaacgcacggagacgtactcgatgccttccttgttgatcagtgcttcgacctcttcaggcgtgtgggcgaaaatcttattctctgccacaatcgctcctttgttcttgagaacttgtttgagaacttacaatcgacaagtctagaaatgtgagtttcacgcgctcgtcaattgggttacgattatgtttcgagatgggcaacaggcggtgtaatccgcgtttttccaatgttttgggatttatgaaattcgtcgcgtctcagtgtcgcgtttcaagtagtggacggtctgacggttgtcggtcgggacccggccggatatgggaaagcccccgcggcgatgtcccgcgggggctttcccgatgtatgaatgatgccggttcggcgtgaggttgcccgccgaagatcagcggcctcgcatcgcgcggcggctgacgtgctgcatgcgcgtgggatcgatgcccttggggatgcccatgccgttcttggtctgcaatgtgcgcagacgggcgttcagtttctccagctcggccttggtgaggatgaaacgctcgcgcgggtggatcttcgccaggagagcgttcttgtggtgcgtcgggcggtacgccttgcggcggatgatgttgctacgcagcttcttcagcggcacctgaccctggccgttgccgaccatcacacggtacacggggatctgcgagccggcggtgacgctcttgatggactgctcctggcggtccatcgcgcgcttgacgcgatcgtaatcgccttcaccgagcaggtagatgccgttgtatccggtgccgcgccaaatggcgtccttggtgcgcggatccacccacaccggctgctcggggaagttgaagccggccttgttgatgttgcgcagcacgctgatggccgcgccggtcttgccgtcgagctgcttgtatccgaccatgtcggcgcggcgggtgagcacgatggtcgacagcagcatgccgagcatgatggcgatgagcatgaggaacacccacgtcagcaccgtccaacggaatatgatgccgaggatgacgaacacgatcacgggcacgaggaacgcgccggcgatcagcgccggaagcatcttgtcttccttgtgcgtgtacttgaagatcgttatgatctgtttgatcgtgccctgcttcttgggcttcgtctgcttggtcttctcgtccttgcctgccatcaacttcctcgcttggtctagggtgaacacactgagcgacaagtttaccagcagatgtgcccttctgccgaccatgagccgccgcgtcgctcgtttcgtggtgtctttatcgggtgtgcagcggccggtcgtcggctttgagcagcgtctcgcccagcgtctcgctgaaggtgggatggggatggatgagacgcgcggcgtcggaaagcggggtgtggttgccgacgagctgttccgcttccgcgatgatgtcggatgcgacgggcgcgaccatgtgcacgccgagcacgaccctgacgccgggctgttgcgcacggatgccgctgacgagcgacagagatccgccggagtcgctcatcatcatgcgggcgttggacatcatcgggtacacggtctccttgatatcggagaggtcgttgcgctgtttcgcgtcggtcgcggtcagtccgacgctggcggcctcggggttcgagaacacgatctgcgggatggtgtcctcatcgagcggctttgggtcgagtccggcgatggattccgcggcgatgatgccctgctcgaacgcgcggtgagcgagcgcgtgcccttcggtgatgtcgccgacggcccatatgcctgcgaccggcgtgcggccgtatccgtcggtcgtgatgaatccatggtcgtcgacggtcacgccggcgtcacgtatccaaccgtcggaggtcagcggatcccgcccgatcgcgacgagcacgaattcgccttcggcgatgtgctcggtggagccgccgtccttggcgctggtgtagtgcacgagggctcccatgttgacgccggtgtcgatgtgggtcaccgtcgagcggtcgatgacgtcgatgccgtgtcgtttgagctcacgcgtcagggtcacgccggcgcggcgatcccatccagagagcacacggtccttgcggataagcatcgtgaccttgcatccggcggcgttccacatggaggcgaattcggcggcgatcgcgcccgcgccgatgatgaccgcgttgtgcggcatcgccatcgacatcgcccgcgtcgaatcgatgatcgcgccacggaacggctcgccgggcagctgccgcgggacggatcccatggcgagcaccacatcctgagcggtgatgtcgaaggacgggccgatgtcttccggcacgtccgagcgcacggaccgttgcacgtcctgcccgtcagcaggtgcggcgatgtgcacggtgatgggacgtgccgcgccggtgatcgaggcggcgccccggaacacggtgacgccccgatgggcgagcagacctgccagcccttgcgtcatcgtgtcgacgatgcgcttcttgtaatcgtgcagcgtcccgtagtcgatgccgttgatggtggcggagatgcccagttcgccggcgtgccggatggagtcgattgcgtgggtggcgctgatcagcgccttcgacgggatgcacccgcggttgaggcaggttccgccgagcgttgcgtcgcgttcgatcatggccacgcgtttgccgagctcggccgcccgcaatgctgtggaatatccgccgggtccaccgccgattatcgcgatgtcaaaagcttcactcatgttcgactcctttgtgctcgtaccaaaaccatccccatcgtaataccttacgcccgccggcgggctgagctgtggagcaaatagcagggctgttcgtaggccaagagcgagcaaggtgggtgctgtcttgccctcgctggcggcggggctgtcgggcgcagcgagactggggtggtttcacgcagcctagggcatacaaaaaacggcgctcccactatcgggagcgccgtcaggaaagcagcagggaggctgtcacttcggccagttgccgtgcttggggctgcgcggtttgggcagacgccagcggcgcacctgaatcgcgcggctccaggcatacgatgcggagcgcgagcccttggcaacggatgcctcgccatacttctcgatgagcttcttcttcagcttgcgccacatgacagccacgtcgatgatcacggcaatcaggtacacgtacagcagaatcatcatcgggaccgacagctgcggcgcgatggtggtgacgagaatcgagccgagcagcatgatgaacgcaaccgggatgaagaactcgccgaggttgcggcgcgcgtcgacgtagtcgcggatgtacacgcgccacggcaaccgttcggccttcggcatgcggttgatgtcgccggtgcgcatcgcctcgtactcttcgtcctcgcgcttgcggatccgctccttcgcggccttggcgctggccttgcggtccggcggcaccagaggacgcaggttacgcgcctgcgcctgcttcatcttgggggtcggacggcctttcccgacggtcttggcgggcgattcctcttcgaccggctcctgggccttgtccttcttgaaagggttccatgtcataatccgtcagaatacggccacgcctcgacgctggaaagccggatgaaccggttacaatggcagctgatatgaccatctgttccaggccggccggttcgtgcaggcgggatggatgatgacgaacgcaacagtaaggagcatcatgaccgcagtgttttccgacgagctgcgcgcgcgggtcgaagccgatttcggccgcgtcgtcgatctgctgagccgtaaggtcgcgctgaagtcgatttccgccgagggcatcaccgccgagcatatgaagcggtccgccgaattcgtagcggacgagctgcgccaggtcggcatcgacgcgaaggtcgtccaatcgcgcaacccggatggcacgcccggtgcatgggaggtcatcggctcgaagatcgtcgacccgcaggcccccaccgtgctgctgtacgcgcaccacgacgtgcagcctgtgccggatccgtccgcatgggacactgacccgttcgtcgccaccgaggtcggcacgcgcctgtacggccgcggctcggcggatgacggcggcggcatagcgattcactcgggcgcgatgaaggcgctcggcgacgatctcaaggtcaacatcaaggtgttcgtcgagggcgaggaggagatgggctcgccgagcttcatcccgttcatcgaggatcatcgcgacgagttcgcgtccgacgtgatcgtcgtggccgactcgggcaactggtccgccgatattccgtcgctgaccacgtcgctgcgcggcaacacctgtgtggacgtgaacgtcaaggtgctgcaccatccggtgcactccggccagtacggcggccccatcctcgatgcgaacacgctcgccgcgatgctcatcgcctcgatgtacgacgccaacggcgaccttgctgtgccgggcgtggccgcgcaggagccggtcggtggcctgcagcgcgaccttgacgaggccaccgtgcgcgaggacgccggcatcgtcgactcctatcgtctcgccggcaccggttcgctcgcttccaggctgtggaccaagccgagcgtgaccgtgatcggcttcgacgcgcatccggtcgagggctcattcaacgtggtcagtcccgagaccacgttccgcctgtccctgcgcaccgcgccgagccagcacccgcaggaggcgcaggacgcgcttgccgcgttcctgcaggcacacgccccgttcggcgccgaggtgaaggtcaccaagttggagaacggcatgggctgggcgatggacccgaacgcggtcgccaccaaggatgcactcgcggccatggaggaggcgttcggcgtggcgccgatcaacaagggcgagggtggctcgatcccgttcatccctgagctgcagcgcatcttcccgtccgcgcaggtgctcgtcaccggcccggaggatccgaaggccaacgcacacagccccaacgagtcgatctcgctgcccggcttgaagaacaacatcctcgcggaggccctgctgctcgccaagctcggcgagtaaggccggcggctgcctccgtttccccgggaacaggttgggtggcatacccgaaacgggtatgccaccggtgtgctgcgacgatgcggtgccctccgttccggtagccggcggcggttttcggttgcccgccgtggctcttttggtggtgcgatgaaaaataaagggaatgaacacatactccgaaccggatcatttgaccggctattgcgccgatgccagagtcgccatcgtcgacaatgacgagcgcgccttggagtctgtagtctcgctgtttgctgatcgcctacctcaaacgatgttatctggtcgacgactgaggggttgagggcaatcaaatcatgcaaggagcatgagctcaagccggatctgctgcttcttgatatgtcatcggaaggcatccaggggccttcggtatgtcgtggcatccgtagattcgatgggagggcctgctatgaatggacttcatagcatcatatgaggggtgaacgggatcatcgaaccaaaggcggtcgaggatgaaaaaacggcgtaatcgcggcaaaaacggcaaaacagtcggcaatggcagcatctccaagacccgcaatagcggacgtatatctgtgatatggctgctgctggccgtggtggtcgcggtgtcgctgacggtcggggcatgcgctttgtggctgcccgaccgggcacccgcactgctcggctccgccaaggagatcacgagcgcgccggccggagtgcaggagtacacgggagccacccaggtcaccatgattcccacggtctctcagacgcgcgaactggtcggcaacgcctccggcacagtgacggaggacatgtcatcgcagggattgacctctggcaagaccgcgatgaaggtcaacggagtctcggtggtggcactggcgacagccacgccgatgtaccgcgacctcgccaccggggacaaaggcgacgacgtgctcgcactcaacaacgaactcgcacgcctcggactgccggcctcggcgaaatccaccacatatacatggaacacgtctcaaggagtgaagcagctcatgagcgccgccggcaacacgtcggacggttcattgccgctgaccgacgtgctgtggatacctgccgcgagcgtgcgggtcggcgaatgggccggcactgtcggggcgaccgtggccgggggaagcgtcgttgggaaggtgcccggcagtgtcacgaaattctccatccagaacgggcagccgtcggaactcgaccggacggtcaccctgatcgggcagaccgccacgctgaaagccggcaccaccgaagtggatgacgccgagttctgcgccagagtcgccgccacacaggaattccagtcactcaccagcgacatgctcgccacaggtctggaagccagcgtgcagcttgtgaatccggtgcaggcgctgcgcgtgccggccgcgtcggtgatcggcgtcaacggcagcaaggggtgcatcgtctcgggtggcaggaccatcaaggtgtcaattgtcggatccgagctcggggcgagtctcgtcgagccccaaggcgccgatgccgcggctatcacctcggttgagataggcagtggtttgaccggcgaaagctgccgatgatgacgggggaagatgtatacgccggtgccggagtcggtgccgcgccgcagccggagcgatcggtgagcgtacatgatttggcgcataggttccccggaacggacgtgttgttcgaacatctggatttcacagcgatacccggccagaccgtggcgatatgcgggccatccggatgcggcaagtcgacgctgctgtcgattcttgccggatgggagaagccgtaccatggcacggtggaacgcaagaacgtggaacgtgtaggctgggtgtttcagaacccgtacggcgtgcccgggcgaacggctctggaccatgtcgtgttcccgctgctggccaaggggctgcgccggcgcgaagcggagccgcaggcgttggaggccatggggctgttcgacttggagtatgcggccgaccggcggttcagcgaactgtcgggcggcgaggcgcagcggctcatgctggcccgtgcagtatgctccagacctgacatgctgctcgtggacgagccgactgcacaattggatacgcgcaccgcgcactcggtgagccacgtgctcgggaacctggccggacagggcatgatcgtgctggtcgccacccatgacccggacacgcgcgacgcctgcggtcgcgtcatcgacctggccgactacgcccccggcgataacgaggactccggttttgcccccgctggcggaaacgaacccgctgagcctaccgattccgcccccgctggcgggggctcccgcgaagcgggtgggggtggtcccaccgactcaactgacatcgccgaaaatggatcggaggtgcgctcatgagactgggatccatcatctcggagacgctgcgcaacatcgcctcgggcaccgcgcatgctctcgccatgttcctcgccgtgctgttcgccggcgccctgctcggaggatacgaggcgatgtcggtcatgaggttggaaaccgaagccgcggtgcgcatccgcgcattcgccgacgtgaaaaccgtggtcggcggcaatgtcgacggactcgcctgcgaccggctctccgaccatgacgacccgtcgttcatttccggggcgatgcggtccggcccgcaggtcgtgccgctggcaacgaatggcatcgaactgtcatcatatgaggtgaccgcgggcatgatacggctcatcaccgccgaagacccgcaggaggttccggactcgtccggcgtgtgggtgtcatccgacgtctcccatgatttcggtctcgtcaagggcagccgcatgcagacgaatcatggcacggtcaccgtggcgggcgtgttcgattggccgaatgacggcagggacatgcggttcgcctatgcgatgatcgcaccggcggcatcgagcggcggcgtgttccaggaatgctgggcaaagcagtggccgcaaagcgaccagatggacgagctgctgctgtccaccgccacgaagaacccgaaatcggagatgcgtcccggtgtgaccgctcttaacaagggggtcgatgcgcattatgacgcgcagaagggctatctgacccgtgtgacccgttggatgccgtatcttggactggcggtcggcctgctgctaggcgtgatttcggtacgccgccgccggctcgaatatgcaggcgcgttgcactcgggcgaatctaagggtgcgcagctgctcggtatcgaactggaatcactgatctgggcaggagccggcacgctcgcgacatgcgcgctgctctccgcgtatgcgctgcgcatgtcgcagtccgaccctcttgccgtgttgctggccgccgttcgtacgccgctcgtgttgctggccggagtgctcgtctcctcgctgttgacgggatcggtgatccgacagacgcagctgttccgctacttcaagaaccggtagcgcctaatcccgtgtcacttcgccagtcccatctggtatttcagggtcattacgcgcgttgcggaggccgtcaccttcttcgcgaaggccgggtcggactgcgcacgggcgatgataccgtcaagaatcggcgtcacatatgacgtatcgcctatgcacgccaaatcgccgccggcgtccaccagacgcacgcccaggtccttggtcgctatgccgctgaccgccgcggccgaaagggagtctgagatcaccacgccgtcatagccgacgctgccgcgcagcgtgccgtcgatgatcttgctggagaacgcggcgggcgccgacgagtcgatgcgctggtaggtcgccagcgacatcatcaccatagccggcttcgcctgcttgatcgtggtgttgaacgcgcctatctgctcgccatcaagcgtggtcgtggtgtcgaggatgccttcggtcgtgaaatcggtattgccggtcaccgcgcccaaaccggggtagtgcttgacggtcgcgccgacgcccgcgtcgcgcatgccttcgatgaacgcgatgccgtgctgcgcgtttccgttggaatccaaaccgaaatcgcggttcagcgcgccaatcggagcgttcgaggaacgcttgacctgcaccgtccccaataccggggccaggtcgatgttgatgccggcttgcttgagctggccgccccaggtctttgcggaggagcgcagcgtgtcagcgctcatctggccctgcgccaccgcggacggcatcgtgtcgaatccactgcccttgagatgctgcacctggccgccttcctgatcggtggagacgatcagctggttgccgctcggagcatagctttgcagcgcgtcagcggcggtcttggctgcggctgtgccgttgttccagttgccgatgagcaccacggaaccgacatggcgtgtgctgatgagggcgctgagatcggccggattgccgcctgcgaacatcggtgccatgatgagctgcccggcccgttcatcgagactcatcgtggcgatggcgcggctcgccttggccgcgggggagtcatcggctgccttctgatgctcctgagatttcggtgtgggggccttgtcgcggttcagcgtcgaagaggaggactgtggctgcgcgagatgttcgagcgcgtctttttgctgggggcgcagcatccaccatgccgtgcctgccgccacaagggccaccacgcagagcatggccgcgatgatggtgggggctgaactggggcgcggccttctgccgccgtgtttgatctgctgcatcctcatatgcactagcgtaggccatcatgtgtagtggttgtgagacggttgtgcgacggctgtgttctcagctcagagcatgaccagctttcctagcctttcgataggcttgtatcatgtctttttttgatatgttgggtatgttcgatcccggcgacgggccacgcgggccacgtcgggactccggtgcgaccgatgacgatccggtgatcgtcgacgtgcaggcggatggcgacgatcatggcgagacgccatccgccggcaagggggagccgccgaagcgcggcgtgccgaggctcacgccccgaccgttgccgaacgggcccagcaaggggacgaagattctgatcggcgtcgtgctggcgctggttgtcgtcgtcggcctgttcttcggcctgtcgcagttcatcacggacctgatgtggtacggacagctcggttttcagaacgtggtgtggacccagctgggtgtcaagttcggcctgtgggcggcgtatgcgttgctgatggccttggtcagctatgtgtccgcttggctggctatccgcgctcgccccgattcgtccgacggctcgacgttccgcatcaaggatgacgtcatcgaagtgggcaagtcgttcagttccaagaccgcgcgtcgcgccgccgtggtcgtgtcgctggtcgtgggcgtgatgttcggctcgcagttcaactcgaactggtctgagatcctgctgatgttcaacgcgcagagcttcggcactgccgatccgcagttcggcatcgacaacgggttctatgtgtttgtgctgcccggtttgcggctggtgatgtcggccgtatcgatgctgctgctgatgggcattgtgttctccgtcgtcacgcatgcgatgatgggcggcatccgcttcaccatgccggtgcatggtcgcggagtgctcgctgtgaccaagcgcgcccgtcgccagatcggcatctggctgatcctcaacatgctggcctggtccgcgcgccaggtgatcggcgtgttcacgcatctgacccagcagggcgaccgcatcaccggcgccgcatacaccaccgtgcacgcgaccattccggtcacgttcatcatggcggccattaccgcggtgctcggtgtgttcctcggcgtgtggctgatgcactcccatgcgttggaaggcgccgccaagccgagtgtccgcgccgccgcggctctcaaggcgtggcgtacgccggtgattgcgatcgccgccgcgctggtcgtctcgctggtgctcaccgtcgcatggccgatgctgttgcaacggttcaaggtgaacccgaacgcgcaggagatggaatccacctatatccagcgcaacatcaacgccacgcagcaggcgtacgggctcgacaaggtgaaggtcgaacagtacaaggccaccaccaagggcaagtccggagcgctgtcgtccgaggccgaatccaccgcgcagatccgactgctcgacccacaggtcgtcagccccacgttcaagcagctgcagcagtcgaagcagtactacacgttcgccgacacgctggccgtcgacaagtacgacatcgacggcgtcagccaggacacggtgatcgccgcccgagaactggatctggaaggcaacgacaaccgcaactgggtcaacgaccacaccgtgtatacgcatgggtacggtgtcgtggccgcatacggcaacaaggtggcggcggacgggcagccgcagttcttcgaatccagcatccccacccagggcaagctcaccgaatcgcagaagtacgagccgcgcatctacttctccccgaacgcccccgaatactcgattgtcggggctccgaagggcatggattcgtgggagttcgactatccgaccggatcgcagggcgcgaccaatacgtttgacggcgatggcggcccctcggtgggcaacatcttctcgcggcttttatacgcggtccggttcggatccgatcagatcctgttctccgaccgtgtcacctccgactcgcagatcctgtacgaccgttcccccaaggagcgcgtcgccaaggtcgccccgtacctgacgctggacggccgcgtgtacccggcggtggtggacggacgggtcaagtggatcgtcgacggctacaccacgtcggatgcctacccgtattcgcagatgaccgatctgggaagcgtcacgcaggattccaccaccaagacgtcgaacacgatccaggcgttgggttcgcagaaggccaactacatccgcaactcggtcaaggcgaccgtcgatgcgtacgatggctccgtcgaactgtacgcctgggatgccaacgatccggtgctcaaggcatgggagaagatcttccccggacagtaccacccgatctccgagatatccggcgacctgatgagccacctgcgttacccggagaacctgttcaaggtacagcgcgagctgctcgcgaaataccatgtgtcgtccgcaggccagttcttctccggcgaggatttctggcagacgccggtggatcccaccgaatcggccacggcgcagcagcagggcgttccgcagcccccgtattacctgtcattgcagaccggcgggtcgaagaagccggtgttctcgctgacctcctcgtacatccccgccggcacgtccacgcgagaaatcctcaccggcttcctgtcggtggattccgacgcgggcaacgaaaagggcgtaatcgggccgaactacggcacgatacgattgcaggagctgcccaaggactccaacgttcccggaccggggcaggcgcagaacaacttcaacgcgaacgcggacgtgtcgaaggagttgaacctgctcgaatccggttccaccaaggtcaaccgaggcaacctgctgacactgccgctgggtggcggtctggtgtatgtgcagccggtgtacgtgcagtccagcggatcgaccagcttcccgctgctcaagaaggtgctggtggcgttcggcgaccaggtcggattcgccgatacgctcgacgaggcgctcgaccaggtgttcggcggcaattcgggtgcgtccgcgggcgatgccgagaattccggcaacacgtctcaaagcggtgacgggcagaacagtggcgggcagaacggcactgaatccggtgatggcagcgagagcaacggcaacgcgaatggcagtggtacgaacgagggcaaggaccagaacggttcctcctcgcagggcggcagccaaagccccgagcttcagcaagcgctgaaggatgcggcccaagcgatgaaggactcccagtccgccatgaagaacggcgactggaccgcctacggtgaagcccagaagcaactggaagaagccctcaacaaggccatcgaactcgacggtggcaagtaagagccaaaccagaaaaccccagtactgtgaacgcccccacgccgggggcgttcactatttcttgccccgctggcgggggctgtcatgcacagcatgactggggtggttctcggcccagaacggcccccagccatgctctacccacctgaccatctgattcgctcccagcccgtgtgccacactaggcgaaaaacaccccaaaatcgcatggtgtggtacagcagaaggccacaccatgcgatgtgagccttcacatcatgtggtgtggcagaatgcgagtcgtgaaaaccgccattttccaatgatcggtggatgagcccggaatcacccttggccacaccagccccaaaaccctcaaaaatcgcatggtgtggtacaggcgagggctagatggcagtcggtcggtaaccatccccacaccttctctcgcggaagtcccatccggcggtcttcaaacggaactttcgcgggagggagggagctgactagtgggaaaggggaacctgactagcgggcggcgatgagatcgaatacgtgctcgactacgcgcgccgtgcaggagccgtgctcggggatggccacgttgcgacggatgaacgcctgataggcggcatggtcgaaatcgtcgtgctcgatggctctcacgatcgcctcggcatcatccgtgaacagcgtcgggatatcgcgcttcgggtcgatgtacaggctgcgtttcttcgaatagtccggccagtcgtacgcatagaggaacaccggcaggtcaagcagtccggcctcatagatcacggtcgaatagtcgctgatgacgtaatcggcgacgaacagcatgtcgtactggctcggatagtgctggaatacgtgcggattgttgatacgcaggtcgtccaacggatggcatttcacgatcaggttgtacttgtcgtaatcgatggcatcggcgagggctgctgccgcctgagtctgattggcgggcgtctttttgcggaacgtggggcagtagacgatgttgagcttgcgcccgagttccgggaactcgcggatgatgcgttcgcgctgctgcgcccggtacgagctgttgatcagcagatcggtgcggggcagtggcgcctcgtagatgatggacgggtcgatgtcgaagccgcgagcgtaatcgctgatgaacgatttggatgagatgagcacggacgtgtacccgcgatgcatgttcagcagcgaggcggtggagaacttccggccttccttggagcccaacgcggtgtatccgaacctcttcatgttgccgagcgcatgccacatctggatgacgggcacgtcgatgtagccggcgagcaggcttaccacgatggcgtaggtgtcgagcagcaccgcctggctggtggcgatgaaatacagctgccggatcatatggaacccgtatcgtaccgggttgtgcagcttcttggcgaggatcaccacggaataatccggatgcgtctgtctcacataatggcggatgagccggaaatcggtggtcggtcggtcgctctcgcgacttaggcacacaatcctacgcttgcgcgggaacgcgcggaagaacctatacataagaagcatcatcatccgaactgcattaatcagaagacgtttcattcttgttctcccttaccgaagcatcaggttggtgtgttagccggtctaccgtaactgcaactctatatattacatgggttaccacaaggggaaccataaggtgtcgtaaaggagcccggggatgtcactggacgttcaccaaatccgctggcggtcaagttacttggagatcgactattcctcgcgggatggtggtgtgccgtggctgtattgcgtgggacgtcgccagttcgttccgttcgagatcgtcgggcttgagagcggtgtccgccgcgcccgcctgaacctggtgctcggggacgggcgcgaggtgcttcccggcggccaatggatcatctgcgagaaaatcaaggagtctgcgctcttcagtctgcaggcgctgtacgccgaatacccgctcatgccgcagcgcgtcgactacgatgtacgtcacctgctgcccccggagttgcgtgacgatgatgaggcggtcgcacagtacaccgacgaagagcgtctggaactggtggctcggcacccctatgtcaccagcggagtcacctacgacgatgaggtgctggagcggcttgacaatctcgaccgcgtgttccgctacggcaagaacagctacgcctatactggtgtgttcgtgcccaagacgaatcgtgccggtctcatctatctcgcgttgcacatgcagttcttccagcgcaacaagaccccgcgccaccgtcagcgcagtcgtcgccagatgcagaaggacgttttcgcggcgacgtactcggtgatgaccaagctggtgccgcgcaagcgcaatcgaatcctcttcctcaaggagaacggcgagggcccgacggagaatatggaggcgttgcagagccgcatgatcgagcgcggcatggacaagcgcttcgatattcgtgcccggtaccgcaacgtattcgcgggcaggcagaacatcgtcgcctggctgcgcgacctgttcgagatcgcccgaagccggtacgtcttcatcgacgattacacccctgtattcaactttatcgaccccggtgaagatgtgacgctgacgcagatctggcatgccggcgtcggtttcaagtcggtcggctatgcccgttttggtctcaagggctcgccggatccgtacaattccgcgcaccgccgatacacgtacgcgctggtcggcaacgagcacctgcgtcgcatctattccgaggtgttcggcatcgaggaggaggcgctgctcgccacaggcatgcccaggctcgaccatttcctcgatgagaaggtcgagaaggaataccgcgaggagatggccgacaagttcccgtggtcggccaagggacgcgtcatcgtgttcgctccgacgttccgcggcaccggtcagcgcaccgcgtattacccgtatgacgagatcgacatggatcgtctgtaccgcatgtgtgtcgagacggacacgtatttcgtgttcgagatgcatcatttcatccgcaagcgtccggatatctctgccgagtacgccgaccgcatcttcgacctgtccgatgagagcctgacgaagctgttcttcatcgccgatgtgctggtgaccgactattcgtcgtgcttctacgactacctgttgctcaagaagccggtagtgttcttcgtgcccgacaagaccgcgtattcgctgatccgcggtgtgcagcggtccatcgacgagatggcgccgggcgtggtgtgcgatacgttcgacgagttcctggacgtgctgaggactcgccattatgagacggtttcccctcacccctcgtccatcgaccgcgccgccgagcgcagcggactcgccagcgaccgtgccatcgacactattatctacggcaaggatgttccgggtgtgcgcaaacaggcctccggtaagggaggcgcggtgccggtccggcagtccgacaagtcggccaagtccgaaaggaaggcaaaggaactgctggattccaaggtcgccgacaaggataccaagtccgcctccgacgaggaggagtgagcgtgccggggaaaacgagcatggccgtcgcgcccgccgccggcgccggtgagcccggcagtggctccggcgagactgcccggcacgcggcaccacgcggtgccgggcgcccatcatacgagctgctgtccaaataccgcggcgtgctgatgggcgtgcagatcctgctgatcatggcgttccactacaccgaggacctgtcgaacgcggccgaccatttcaacggtcccgctcaggtgttctacgactatatcggcagttccggcgtcgacatgttcctgatgatctcggggctgggcctgtactactcgtggaagcgcaacccggacgcgggggcgttctaccgcaagcggctgacccgcgtgctggtgccgtacgtcgccgtggcgctggtcgggtggatctggttcgacttcgtccattcggatgccggagtggtgcgtttcctcgccgacatcgcattcgtcacgtttttcacggacggtgtgaagtggttctggtacatagcggtgtgcctgatttgctatgtgctgtttccgctcgtgttcgccgtcgtggacggtacccgaaacgtcgccgcggcatgggtgcgaacgttggcattgtgtgcggccgcggtgctggtcgcggtggcgctgtacagattcgcgccgtctttctacgacaacgtcgatctgatcgtcaaccgcataccgtgcttcatcttcggcgcgctgctgggaaggctctcgcatgaacgtcgtccattgcccatgcccgtggtcgccgcatgcctgacggccgtggccgtcatgctctacccgatgcagctggttgatgtccctctggtcaaggtgtaccttcgcgcggcgttgaacctgctgttgtgcatatgcggcgtcgtcatcatggacgtgatggcccgcgcgggaaagcccgcgctcgcaggccttcacgacgtggtatcaaaagtgctgagctggttcggacggtattcgctggaactgtatctgcttcacgtgatgattcgcaagatgctgaacctcaacgacctgccgaccacgcacctgcgctatgaggccgtcgtgatcatcggcgcgatcgcgctgtcgatacccctgaaacggctgtgcaacctgattcagcacaggctgctgcgtgggaaacgtttacttaatgccaaagagtataggggcacatatgcggcttgatgcaccagcaggcgaaaatatggctgtattcgtttcacatgcctttgttctatatttgaaccctctgccggtacctcacatagatggcccgttcctgttcggcccgaaccgtttcttccgtgactacctagagggacgcaatatcgcatttgaggatcaagagttgcaggtggatttctcttccatgaatgagatgggaataacattcatggaagaatggaacaagatgtacatgggtgaggcgcaatcaaagctgtctgtcttcaaagagaaagatgtccgctattacgccgatgactatgccgcctatgtgggccagatggtattgggttgcgagatcggcgccgagcgtattcttgaacaccctgatatcgaacgtttgaaaactgagaacaagaaactatctgagaagcgaaagaagctcgaagcggatctcaagaaatctcgcgccgaggtccagaaactccgtaactcgaagtcgtggaaggtcactgcgccactgcgggcggtcatgcgtctgtttgaaaaggactgatggtggtccgtcttagtgcactctgcgtgccgaataccacagaaaggtgaatgctcggtaaataagtcgtgtctggaacatagactacgtatgagttaacggggctgcaagcccgaaagcgcatataacgatggagaggtcatgaacatcgctgtcatttttgcgggcggcaccggccaacgcatgaattcgcgaaccaagcccaagcagtttctgctcgtgcacggcaaaccgatcatcatctacacgcttgaggcgttcgatcagcatcccgacatcgacgccatcgtcgtcgtatgcctgaaggaatacatcgacgttctcgaacagctcatcaccaagttcggcgtcggtaagatcgccgcgatcgtgccaggcggctcatccgggcaggagtcgatccgcaacggcgtcgacaaggcgaacagactgtatcccgcggattcggtcgtcatcgttcatgacggcgtcaggccgctgatcgaccagcagaccatcaccgactgcatcgtcagtgtgaagaagaacggcagcgccgtcaccgtcgtacccgccaccgagaccatcgtgcaaagcgaggacggcgtgatcaccaacatcatcgaccgcaaacagtgccagctcgcccgcgccccgcagtgcttccgcctcggcgagctgcatgacgcacaccacaaggccgtggaagaagggctcggcgacttcatcgactctgcgtccctcatgtcgtactacggccacaaactgtacgaggtggaaggcgccaactcgaacatcaagatcaccacgccatcggacttctacatcatgcgcgccatcatggacgcggaggaaagctcccagatcttcggtctgtgacacgaacacggaggacaacgaccatcatgtttgatctgcaagaggaatatgcgtcactggcgcagcatctcgatatcgactgggatgcgctcgccggccggcatgtgctcgtcaccggcgccacgggccttatcggctcgctgtgcgcccgcacgctgctggaacgcaaccgcttgacgggggcgggcatcatcgtggacgcgctggtgcgagacccggccagggcacaggccatgctggggcagtacacggccgacgacgggctcgtgctgcatcagggatcgctcgaagatgtcgactcgctcgacctgccggcggactatgtcatccacaccgcctgtccgaccgcatcgtcgttcttcatgtcccatccggtcgagacgttctccgcgatcgtagacggcaccaggtcgatgctggaactggcgcgacaccgcggcgcggcctccttcgtctacgtctccagcatggagatctacggcatgggcaacaagcagcgcggcacggaacacctgcttgacgagagcgccgtcggctacatcgacccctgctcggtgcgcagctgctactccgaaggcaagcgcgccgccgaaaacctgtgcgtctcataccattccgaataccaggtgccggtcaaggccgtccgcctggcgcagaccttcggcccgggcatccctcgcgacgacgtccgcctgttcgcggcgctcgcacgcaacgccgtggccggcaaggacttcgtcatgaagacgaccggcgaaagcacacgaatgtactcatacaccgccgacgcggtgtccgccatcctcaccgtgctggtcgcgggggagaacggcgtctcgtacaacgtggccaatccctccacctactcgtcaatccgcgagatggccgatatggtgtaccgcgaattcggtacgggcgacgcgcacgtcatcatcgacgtcgacccgaacgcgccctacccgccggagcaccacctgccactcgacgtgtcacgccttgaggcgctcggctggaggccgcaggtaggtctcgaagacatgtaccgcaagctcatcgcatacatgggctgacctcgcgggagaccgcacctgaccatgagaagacaagcagatttggaagaacattgtttgcaacactgaagcaagtcgtcggcgagaactggcattggcgacggcaggtctggaatctggcgaagatcgatctggtgaagacgtaccgcggtgccgcgctcggcaagatctggctgttcgccaaaccggccgtgtacatcctggttttctgggtggcactgaaattcggtctgcgcagctcgtccgacgtcaacggcaagccgttcctgctgtggctcgccgccggtgtgttcccgtggttcttcatgtccgacatgattactaccggcagtgacgtataccgtcgatacccgtatctggtgaaccgcatcaaattcccgctgtcgctgatctccacgttctacacgctgtcgctgctcatcatcttcgcgtgcatgatggcgttcaccatcgtggtggcgctgctcaccggcgtgcatcttggccgctacatgctgcaattgccgctggtcatggtgttcatgttcctgttctgggtggcgtggtccatggctttgtcgcctttgagcgcgatatcgcgcgatttctcgaacctgctcaagacgctcggcaccccgttcttctggctgtccggcatcctgttcgacatcagcggctggccgcgcaccgcccgtctggtggcgtccttcaacccggtcacatgggtcgtgcagtcggtgcgtgactgctttatctacaacaaatggttcttcacggattgggagtcgttcctgccgttcctgttcgtgctgctgatcttcgtcgtgctcgcgttgcacaactaccaccgtctgtacatggaggtgccggatgtcctctaagctcccatcgaatgtcacgcgaatgggcgatgccacggtcatccgcgacgaggacgcgagcaatcccgtcgccgtgcgcttcgaccacgtcaccaagcagtacaagctgttcaagaacgacaagctgcgcctgttgtccaccttctccaagcgcattccgcacgatacggtcaacgcgagcgatgacctgagtttcaccgtgaaccgcggcgaatccctggcgctgctcggcgacaacggcgccggcaagtccacggcgctcaagatgatcaccggcgtgtgcttcccgacgtccggcaccgtcgaggtgcacgggcgcgtgtccgcgctgctggagctttccgcgggcttcgacatgaagctgtcgggcatggagaacatcgacatgcgctgccagctgtggggtttgtcgaaagaggagtccaaggagctcattcccgagatcgtggagttctcggaactcggcaagtacatcgaccagccgatgcgcacgtattcgagcggtatgcgcgcccgtctgggcttcgcgttcgtgtcgtcgatccgcccggacatcctggtggtggacgaggcgctgtccgtcggcgaccgcaagttcgcgaagaagtgccgcgagcgggtcaacagcatcatcgccaacgagaacgtgaccgtgctgttcgtcacccactcgaccggcaccgcgaaggagttctgccacaggggcatcgtcatccagaagggcaaagccatgttcagcggtggcatcgaggaggccgtcgacttctacaccgcctcgtgacgcttcgaccgttccgctgacggcgttgccggcaaacggcacggccgacgtccattgaccgcgttcggtcggatggtcgggacaactcccgcgcttcgcgattttgcggccgttgtcctgcggacgataacgcgggcatgtcccggatggccggaatttcgtggttttatgctggacaactgctgcaaagggctgttttgcggcagttgtatcgtgttcgttctggacaactcccgcatttcgtgattgtgcggccgttgtccacgttcctgtcggcggatcgaggcgaatcgcgcattatgcaccgctgaccccagtctcccccgccctatcccgccggcagggcggttgttatgcttgaagacatgtcctataccatccgcgcggccgttgacgccgacgttccggccatcgccgacatctacaacgaggcggtgatccgtgggggagcgtccgccgaccttgaaccggtgtctctggaaagccgtcgtgcgtgggtcgactcccatcagccacgtgccaagtatccggtcgtcgtcatcaaaggtcccgaaggcgccgtcgtggggttcggctcgctttcgaaattccatcagcgggccggatacgacggcatcgccgaactgagctactacatcgccggcgaccaccaacgccagggactcggcaccatgatggtgcgatggctgatcgatgccgcggcagagcgcggattcacgcatgtcacggcgatcatctacgccgacaacgccggctccgtcgcgctcatgcggcggttcggattcatccggttcggcctgcttcccgccgcggtgggcgcgctcgacggcaagctgcatgacatgagctattgggtcaaggcgttggcgggtggggtacaatccttaaggttgaagacaggagagtaacacatggcatccgatttctggctgatcgtggggctgggcaatcccggcaagaagtacgagggcacccgtcacaacatgggcttcatgaccgccgacatattggccgaacgctggtccgtcgccttttccgaccacaaggggctcgcgatgctcggcaagggcgcgatgaatctgcagggtcgcaacgtcaagttcttcctcgccaagccgctgacctacatgaacgactcgggcaacgcggtcgcctcgatcagcgcgtactatcagatccagccggatcacgtcgtcgtcatccatgacgacatggatctcgaattcggccgcataaaggtcaaggcgggcggatccgccggcgggcacaacggcatcaaatcaatcgacaaggccctgagcaccccgaagtacgcgcgcgtgcgcatgggcgtcggccacgctcagcgcggagcccacgcgcacgacaacaccgtcaactgggtgctcggcggtttcggacccgaccagcgcaagcagctgccggaattcctcgcagacggcgccgacgcggccgaaaccatcatcttcgacggactcgccgccacccaggagaagttcaatggccgctgagcagggacgcgcgcgcggcaaagcgtccgctgccacggccacacgcgtccagaacgcgctgatcgacggctccctgtgcggcatcctcgaacggctcgatgaggatccgacatttcatcggctcgtcagcggcggcatgagcatcgccgacgacaaggacatcgccccgatcatcactgtgggcgccccggacgggttgcgcccggccatcgccgcagcgcaggcggaacacacccccgtcgtcctggtcgtggcctccagccgcgaggccgaggacaccgtgaacgcgctgcggtcgtggtacgacggcgacccgaacgacatcgcacaactggaggcctgggagacgctgccccacgagcggctcagtccccgtgccgacaccgtggcgagccgcatggccgtattccgcaggctcacgcaccccagcgacaccaatccgatgttcggaccgatccgcatactcgtcatgccggtgcgttcgctgatccagcccgttgtcaaggggctcggcgacgtcgatccgctcgtcttcacgcaaggcgaggagctgcctctcgacgacgtgtcgcgtcgactggttgagaacgcctacacgcgcgtcgacctggtgatggaccgtggcgagttcgcggtgcgcggcggcatcatcgacgtctttcccccaaccgcgccacatccggtgcgcatcgagttcttcggtgacgagatcgactccatccgagaattccacgcgtccgaccagcgcacctacggcgagggcgtccgcacgatctgggcgacgccctgccgtgaactgcagctcaccgacgccgtgcgggaccgggcgaaacggctcatcgggcagattccgaatgccgacgacatgctggagtccatcgcgaacgcgattcccatcgaaggcatggaatccctgatgcccgcgctcatcgacgacatggaacccgtgaccggcatgctcgacaggcatgccatcatcatgctcgccgactcggaaaagctgcgccgcgcggcggacgacctctcgaaaaccgcgaacgagttcctcgccgccagctggcatgtcgccgcggccgggcacggtgccggagctcccatcagcttcgaccaggccagcttcctcgactacgaggagaccatcaactcgctcgcatactccagccacgacgtgtggaacctcaccagtttcggcgtggacgccagccgcccgaaccacgtgcagctcgccgccggcaacccgggcgaataccgcggtgacgagacgaaggccgcggccggcatcgaggggctcatcgacgcggggtaccaggtcaccgtcaccgcggccgcgcagggcacgctcgcacgattgaagcgagccatcaacgagaccggcatcgcctcgttcgacgtcatccgctcccaggccatcgacgggttcatcgacacggcggcgaagaccgcgctgctcaccgaacgcgacctgaccggacggtccagtgcggccggtcaggcgaagacccccaagcgccgccgcaaggcaatcgacctgatggagctcaaagccggagactacgtggtccatgagcagcacggcatcggccgtttcctggagatgcggcagcgcaccatcggcaccggggcgaacaagaccacgcgcgaataccttgtcatcgaatacgcgcccagcaagcgcggcgccccggccgacaagctgttcatccccaccgatcagctggatctgatcagcaaatacatcggcgcggaggcccccaagctcaacaagctcggcggctccgactgggccgcaaccaaggcgaaggcgcgcaagcacgtgcacgagatcgccgaggacctggtgaagctgtactctgccaggcagcgcaccaaggggttcgcgttcagccccgacacgccatggcagaaggagctggaggacgcgttcccgtatcaggagacgacggaccagctcaccaccatcgacgatgtcaagtccgacatggagaaaccagtgccgatggatcgcctcatctgcggcgacgtcggcttcggcaagaccgagatcgccgtgagagcagcgttcaaggccatacaggacggcaagcaggtggccgtcctcgtgccgaccacgctgctcgtgcagcagcatcacgagacgttcaccgaacggtacgagggcttcccggtcaccgttgcggccatgagccgcttccagacgaccaaggagatcaacgagaccatcgagggactggagacgggtggcgtcgacgtcgtcatcggcacccacaagctgctcaaccccaagatcaagttcaaggatctcggccttgtcatcatcgacgaggagcagcggttcggcgtcgagcacaaggagacgctcaaggcgctgcgcaccaatgtggacgtgctctcgctgtccgccacgcctatcccgcgcacgctggagatggcggtgaccggcatccgcgagatgtctacgctcgccaccccgcccgaggaccggcttcccgtgctcacctacgtgggcgcgtacgaggacgctcaggtcacggccgcggtccggcgcgaactgctgcgcggcggacaggtgttctacgtgcacaaccgcgtgcaggacatcgcgaagacagccgcgaagatccacgagctcgtccccgaggcgcgagtcggcatcgctcacggcaagatgggggagaagcagctcgacggcgtaatccgcgacttctggcatcgcgacatcgacgtgctcgtatgcacgacgatcatcgagaccggactcgacatctccaacgcgaacacgctgatcgtagaccacgccgaccggttcggcctctcccagctgcaccagctgcgcgggcgcgtcggccgtggccgcgaacgcgcgtacgcctacttcctgtacgacccgtccaagccgatgacccagcagtcgcacgaccgcctcgccaccatcgcgcagaacacggcgctcggaagcggcttcgacgtcgccatgaaggatctcgaactgcgcggcaccggcaacctgctgggcgacgaacagtccgggcacatcgagggcgtcggcttcgacctgtacgtgcgcatggtctcggaagccgtcgaacagtacaaggagccggagcggaccgagccggtcgcggtcaccatcgacctgcccatcgaagcgtccatcccggtggactacatcgattccgacaagctgcggctcgaagcataccggaaactggccgcttcgcgcaccgatgaggacctcaaggaactcgccgacgaactcacggatcgctacggcaaactgccggaggagttcgagacgctgttcggcgtggcccacctgcgcatgaaggcgcgggaactcggcatatcggagatcgtcgctcagggcaagaacgtgcgcgtcggcaagatcgacccgcccgaatcgatgcagatgcgcatcaaccgcatctaccgcggggcgcaataccggccggtcacgcacacatacctgatccccgcgccgttcgcgggcacgctcggcggcaaaccgatgccgggcgatcaggtcatggactgggtgagcgacctgctgcacgacttcgcatggaagccgcaaccgaggaaggcatgatgggctccggatccccgttcgaaggcatgcccggaggcatcggggagcggaacggcatgatccggctgccgtaccatcccctgacttcgctgatccggcatttcgacaatggccaggccctgacgctcctgcactcggggcggggcggacggtattcggtgctcggactgcacgcctaccatcggctcatgcaatacggcgatgacgtgatggaaggcaccctcgccgtctgcggagacgacgatgtctggcgggaccggctgctccccggccaagacgcgctcatgctgctgcacgaccggctgcgtgacgagcccggcgtgctcggattcatgtcatatgatgacggccgacgccgggaaggcgcgcgatcccggttcgacggcggcccgcaggcggcagagcgaaagacgccgccggacgccgcatggtggagtttcgacgacatcctcatcgaagaccggcagcggcgctcgctgaccctgctcagccatcatcgccacccgaacagtgcccggaacatcgccgccatacgatccgtctgccagtccgcccccgctggcgggggctgtcgcgaagcgactgtgggtggttatccagactccccgcacacctcagcctcccaccgcggcgcatggcgctgcgaccacgatcgcgcctcatactgcgaggccgtggaacgactcaaatcgcacatgcacgacggcgaagcctacgtagtgaactactcgttgcgtctcgacgtcaccagtcccgtgacgcccctggacatgttcctgcgtctgaacgacgacaatcccgcgccgttctccgcatatgtcaacggcggcggatggcagatcgtcagctcgtcgccggaacggttcctcgaatgctgcagcggccatgtcgtcacccgccccatcaaaggaacgcggccacgtggcctcaccgtgcaggaggacgcggccaaccgcgccgcccttgagcaatccggcaaggaccatgatgagctgctcatggtcaccgacctcgaacgcaatgatctgagccgcgcggcgattcccggaaccgtgcaggtcacggggttcgccgaactggagacacacccgcacgtgttccatctggtgtccaccgtcgaggccgaattgcccgatgcccgcgatctgtccgaactgcttgccgtcatgtcgccgggtggatcgatcacgggggctcccaagcgccgcgtcatgcaactcatcgaccggtatgaacggtcgcctcgcggcgtgtacaccggttctctcggctacatcaccgccgatggcgactgcgatctgagcattctgatccgctgcgcgacgcacgtcgggcgatgtgacaaggctggcctgtaccggatcggcgcgggcggcggcatcaccatcgaatccgacccggacgccgaatacgacgaggccatgcagaaagcacaggcgctgctcgacgcgctggactgtgacgtgtcggacagtgacgtgcatgacggaagacaaggacaatggcatgactaatagcaatggcacgcctggcggcgaaggcacggccgtcacattcgccctggatgagggataccagttcggcctcggcgtattcgagaccatcaacctgaccggcgggcgactcgtcatgctcgaccgtcatctcgaccggcttcggcgcggagcgcgggcattggatatcgacgcgccggacgatgatacgctgcgggctcatatcgccgaacatctcgacgcggcagaattgcctgacggtaggtcgttcgcggtcaagctcatggtgtcgtccgcgaacgtcatcgtcacgcatcggccgaacccgtatgcggattgggcgcaggaccgcggtctcaggcttggctggtgccgcgcctggcgcaacgagtgttcgccgctcacggcgcacaagacgctgaatcagggagacaacatactcgaatcgcgttcggctcggcggctcggcttcgattccgccgtgtacctcaacacgcgcggcgacatctgcgagaccaccaacgcgaacctgttcttcgtgcgcgacgggcggctgtacacgccggacgagcgatgcgggctgctacccggcaccgtgcgggcgtggctgtgcgaacgatacgaggccgagcaggggaccttccgacaggattcgctggacagctgggatgaggtcttcgccaccaacgccctgatgggcgtgcgcccggtcgtcgagctgggggatgcgggctatggaatcgggccggtgacgcgggcgatccagcgcgaataccgtcggcttgagctcggtatcctctgaccgccctcagtcggctccgccgccagtcctcgacagtggcggcggagccgactgagggcggtcagatgtacggaatctgtctatatccagccgaatgttagcgctcatattatttttccgagaaattctggcactcgtccacaaaaggcattattcttaagtctgtcatcacaacctaacagtcttaaggagtagttgtggcagctattgaaagcgtttacgcgcgtcagatccttgattcccgtggcaacccgaccgttgaggtcatcctcgacaccgaagacggcgccgaaggccgcggcctggttccgtccggcgcttccaccggtgaggccgaggcttgggagcgccgcgatggcgacaagtccgtctacggcggcaagggtgtgctgaacgcggtcaaggccgtgaacgaggtcatcgctccgaaggtcatcggcatggatgccaccgaccagcgcgccctcgacgacctgatgatcgagctcgacggcaccccgaacaagggcaagctgggcgccaacgccatcctcggcgtctccctggccgccctgtacgcctccgccgagtccgccgaactgccgctgtaccgctacatcggcggcaccaacggccacatcctgccggtcccgaacatgaacatcatgaacggcggcgcccacgccgacttcgccaccgacatccaggagtacatgatctccccgtacggcttcgacacctacagcgaggccctgcgcgccggcgtcgaggtctaccacaccctcaagaacgtcctgaagaaggaaggcctgaacaccggcctcggcgacgaaggcggcttcgccccgaagatgaagtccaacgaggactccctcaagtacatcatggacgccatctccgccgccggctacgagcccggcaagcagatcggcatctgcctcgacgtcgcctcctccgagttctacaacaaggagaccggcaagtaccgcttcgacggcgaagagcgcgactccgcctacatgctcgactactacgagaacctcatcaacgagtacccgatcgtctccatcgaggatccgttcaacgaggaaggctgggaagactgggccgagatcacccgtcgcctcggcgaccgcctgcagttcgtcggcgacgacctgctggtcaccaacccggcccgcctgcgcaaggccatcgacatgggtgccgcgaactccctgctggtcaagctgaaccagatcggttccgtcaccgagaccctcgacgccatcgagctggccaccgagaacggctacacctccatggtctcccaccgctccggcgagaccccggacaccaccatctccgacctcgcggtcgccaagaacacccgccagatcaagaccggtgccccggcccgtggcgagcgcgtcgccaagtacaaccgcctgctggagatcgaggaggagctcggctccaccgctcagtacgccggctacagcgccttcaaggcctgcaagaagtacatcgccaagtgattgtcgcggccgtaaggccgagacaatgctagcgtcgtgacaatgcccggcatattcgccaagtcgaatgtgccgggtatttttgttgccatgaacgactcgacccggaacatgcgaccacgcggcaaacgaagcaaacggcacggcaccggaccgatcgcgttcttcgtgtcgctgttcatcatcgcgctcggagccatccaactggtctccacgttccacacgtacgcgctgaacctcgcccagctcaacgacctcaagaatcaggaagccgcgcttatcaccaagaagcaggatctcgaaaacgacatcgaacgctggaacgatgacagctatgtggcgacgcaggcgagggagcggctcggcttcgtcttccccggtgagaaggcggtgcgcgtgcagcacccggaagcggtgacgggcacgagcgagggggccgcgaagaccaaaagcggtacatccgacgggaaggtgctgccctggtacagcgagctcgaatattcgttcaagaaagccgatgagcggccatcgaaaacggcctctggcagccaatcgggcgataccggcaaagccgacggcaactccggcagcgcaaccgacacgaactcgggcgacaagcagtagacgcggccggcggcagcgtcattcatccgactgcataagccattcgaccagttattcgataagccattcgataaggagccaagctggtgaccgaaccagaatcacaagacgaatccaccacacgagatgtcgcgaaactcgccgaccgattcctgcagcagcgtgcagatgagcgtgacatcgccattgtcgaacggcagctcggacgatacccgcgcggcatggtggcggtcggcgcccgctgcgcatgcggccggccgctcgccgtggtcacccggcccatgctgcccggcggcataccgttccccaccacctgctatctgaccagccccgaggcggtgaaggcggtgtcgcacatcgaagcggaaggccgcatgcgggcgtacaacgagctgctgcacgacgatgagacggtggccggcgagtaccgcggggcgcaccgcctgtacgtggcgttccgccatgagctggcggtgcggctcggcgatgacgaaagccgcatcgccaacgtcagcgcggggggcatgcccgaacgcgtgaaatgcctgcatgcgctgctggcgcagaccctggtcatgggggagggcgtcaaccccatcggcgatcgtgtgctggaggcggtgacggaggagttcagtccatccgtctgccggtgcggttcgctcgacgactgagcggacagacgaaaaaccgaacggccaaaagactggaaacggccgctgaacgcaatgattgcgccgagcgagacgatcatgccgggcgaacgcccccgatgatcgcggtcgcccggccggcgagacagcgggaaacaaaggagatagagatgaaatccgttaccgttgcgggcatcgactgcggcacgaactcgatccggctgaagattgcgcgtgtggacgatcagggcatgcacgagatcgtgccgaggatcctgcgcgtgattcgcttgggacaagacgtggacaagacgcaccggttcgctcaggacgcgcttgaccgggcgtacacggccgccgcggaattcgccggggtccttgcccagcacccggtggacgcgatccgattcgtagccacatcggcgacccgcgatgccgtcaaccgcgacacattcgaggatggcatcgagcagatactcggcgtgcgccccgaagtcatcccgggaacggaggaggccgatctgagcttcctcggggcgaccagcgtcgtgagccgcggcgagctcgaacccccgtatctggtggtggacctgggtggcggctccacagaacttgtgctgggcggcgacggcatcgacgcgccctccacgcaggtacaggccgcgttctcgatggacattggatccgtgcgcatgaccgagcgccacctgcgccacgatcctcccagcgaaaccgaaatcgccgaagcgatcgcggacatcgacgagcacatcgacgaggcgttccgcacggtgccggcgggacgcacccgcacgatcatcggcgtgtccggcacggtgaccacgatgagcgcgctggctctggggctcaaggaatacgatcaccgacgcgtggacggcgtgcgcatccccgtggacgacgcctacgccgtggacgacaggtttctgcgcatgacgcgtgagcagcgctgcgcctacaagaccatccatccggggcgtatcgacgtggtgggcggcggtgccgtcgtatggaaccgtgtgctcgcgaaggttgcccaggcggccgcggccgatcatggcggagtcatcgactcgtatgtggccagcgaacacggcctgctcgacggcatcgtgctcgactgcggacggcggttgcttgcagaacgctgaacaagcatgacataatggttctgccggcatatttgccggcacagcccccgtggcggaatcggtagacgcagcggacttaaaatccgtcgcttttggcttgtgggttcgagtcccaccgggggcaccttatcgcaacattctgggatggctgctttacatacagctgggtttgcggcccgacactgacgaaaggtgcaagatggcgaactggacgaacgtgacgcgcgagcccgagaccgggttgccgacgatgctggtgcaggcggtctccatcgcctttgtcatgtgcgtgtgcgagctggtcagcgcaccggtgatggtgagcgccgcgggaggcgcgttcgccctgatgccgtggttcctcgtcgcctgcctgttcgccgtcgcattcgtgtatacggtcggattcgtgctgctgtgggcggctgattcgttcgccgcccggctgaaacgccgcgatgcgctgatgccgctgatatatgccgtgatcggatgcgtcgggttcggcatctgggggtattgcgtgtatccggcgacgatgaactcgatcatcacccgagccggtctggccaccctttcgcagggcgactcgctgatgatcggcatcaactgcgccgtggtgggcctcgccgcgttcttcctgggaaccgccgccatgccgcgcgtcatgaagtccaagggcaggatcgccgtcacggccgcagccgtcatcgcgctcgccgtgttcggcggcgtcgtcctggcgatgacgtggtcgcatctggcgtgagaccagccattgcggaacgctgtcgtcgagctgacctgattcggcggttcgacggggcagcggagatggcgacggcccggccgtgcgcatgtgcgtggcggaggatatgatatcgcgatggtatcagccgtgaaagcgtgcataacagtgtgaagggattcgtcagtcatgttcagtgttctcgacatgttcaccatcggtgtgggccccagctcgtcgcacaccgtcggcccgatgtgcgcggcgcaggcgttcgcctcgtcactggaggaatctggcgccgtgtcgcgcgtcggccgtatccgcgtcgtcctgtacgggtcactgtcgctgaccggactcggccacggcaccgaccgcgcgattctcgccggattggaaggcaacgtacccgccacagttgatacggattacctgctttcagtccgagaacgctgcgcgcacgacggaaccatccatgtcaacggcacgaacgccatcgcatacgatgacgacggcgacatggtcttcgaccggtggaagcggctcgccccgcatcccaatggcatgcggttccaggcgttcgacgcccagggcaacatcatcgacgagcaggtctggtattcgataggcggagggttcatccgccgcggacggatcgacgacgcgctgatctcgaaccacgagcagacgccggcgtcgtcgcagtcgccggaggactccgggaacgacgaggctgccgaatacggcgacggcgtgccatatcccttcgtatcatgcgacggcctgatcgacctgtgtcggaagcaccatctgagcatcgccgacgtcgtctgggcgaacgaaacggcccggcgctcgccgcaggaggtgcgtgaccggctcacgcgaatctggaacgtgatgagccactgtatcgacgccgggtgcgccagtgcgacgccgacgctgccgggaggtctggacgtgccccgccgcgccccgctgatgtaccggcgtctcgcggccaacagcgacgtgctcagacgcgatcgccgcatctcttcggcgctggaatcctccgattccgcatgggtggcgttgttcgccatgtcggtgagcgaggagaacgccggcggcggccgggtcgtcaccgcgcctaccaacggttcggccggcatcattccggccgtgctggaatactactggcactttgtcgagtccgccgacgacgagggcgtcaggacgttcctgctgaccgccggcgcggtcggatacctgttcaagcgcaacgcctcgatctccggagcggaagtgggatgccaaggcgaggtcggcgtcgcctgctcgatggcggccgccggtctggccgcggtgatgggcggcactccggagcaggtggagaacgcggcggagatcggcatcgagcacaatctcggcctcacctgcgatccggtgggcggtctggtgcagattccgtgcatcgagcgtaacgcgatggccgcgaacactgcgatcaacgccgtgcgtatggccatgctcggagacggctcccacatcgtcagcctggatcaggccatcgccacgatgaagcagaccggcgaggacatgatgtcgaaatacaaggagacctcgaagggcggtctggcggtcaacgtcgtcgaatgctaggccgtcgccgtgccgaatatggcgaatatggcgatttgcgttgaaaaatacgctgcgagctgtgcaaccggggcttggggtgctagtgtgagtggcactgtctttttacgacttgcggccatgccatgaacggcatggcattattgataggaggtaggccatggcgaacatgcctgaggtcaatgccgtgtttggcgcggcgccggagatcgctttcccgtcggacgaggcgccgaagggattgaaggccgtggagatcgtcgagggtgacgggccgatggtccgccgcggcgacacggtgaccgtgaactatcacggtgtggtctggggcaagaacacgcccttcgattcgagcttcgcccgccaccagccggcaagcttcggcatcggcgtcggccaggtgattcgcggctgggatcagaccgttcccggccacaacgtcggctcccgtctggtcgtgtcgattccgccggagtatggctatggcagccagggcatgccggcggccggcatcggcggcggcgacacactcgtattcgtcatcgacatcatctcgacccgctgaccgtatgatggcggtcatctgacgcatcgattggatatcactgatacaggaggaacccatgggtgaggaaaaatccgttctgctgacgcaggaggctttcgacacgctgaaggatgagctggcgcatcgacagggccagtaccgcgaggaaatcaccaagcgcatcgcggcagcccgcgccgagggcgatttgtcggagaacggcggttaccaggccgcgcgcgaggagcaggcgaagaacgagggccgcatcaacgagctcaccgtcaagctgcgcaacgccaccatcgtcgaagctcccaaggccggcaaggtcggcaatgggtcgctggtgacgctggagctcgccggccgcgagatgacgtatgcgctgggctcgcgcgacatcaaggtcgcgacgaagtacgacgtgatcagccccgagtctcccatcggcgccgccattctgggcgccaacgagggagatacggtgagctacaaggcccccaacggccgtgagatttccgtcgtcatcaaggaagcgaagcctctgagctgaccatatgcgcgtcctcgctgaccggggactggtgattgttgcgccatcagggtcgacatgactcacttcgggctgtacggttttatgccgtgcagccctttccaatacaaactacgttgtcagagccgtctcacttgactatcattgagccataggttgttgtgttggcctatatatcgcagatgccaattcaatggagaagacatgaatgggaaaatgctctctgccgtcggcaaccgttataagtacgttgtcgccgagcttcctcccatctcaggcaatggctgcctcctgtcttacgcgcggtatgggatgtgtgtgcctaaaactccatacagtgcgaatttctgacatagcatatgtgaggagttgtttctgatgagacgttcaacgaagatttcaatcggcgttacgacggtggttatcgtagttgctgctgtcatctgatgatggtacgtacacgcccatcaatcccgccagcggcatgctcggagtcggtggacagcaggtcgctgctctctcatccgacggacgatccgccactggcgccacgcttcaggcctatgccgaggctgtggactagaaaagcgtttctaagtgcgcgccgaaacgatgagcgtgcgcacataggcacgcaaatggcccggtttgcgttcttaagtgcgcacggttgtcgtttcgacgcgcacttaggaacgctctagtgcgttgtatagcggtctcgattttgtttcgaccatcacgtgttacgacgagtgaaggcgatgttcgttgtgggctggtggccttcttcagactcgctccgcgagctggaccgaggacgtccgcaccacgaccggcaaccgcagtttcatggaagagctggccgagtgctcttggaatatgtaagcgtcttcgtgaaagcggaatggtctagggcgtcaattccgcctagagatctccgcccaatctcgtctctttatcggaacagcaaacacggtccatgattgacatgggcgttgacgctgattcatgaggggagtattctagatattacgacagacagttgtctggtaatgtccaaagggggactgtatgaatatcaaaaacaaaaataatggcgatatcgattgccagtatgttggcgctgtctccgttggggatggcgtctgcacatgagacaaccgtcagcgtcgcagacgatgccgcagcaaccacagtagaaccgcggtatggcgagaaaacgacaatgacgttgatatccaccgcgaaaaaaccggcgttaccggttattgcctgcagccgcctagtgctgctcattactatcaggcacgcatcaccaagaattacaccatcaaacattatcgtgttgactactacgagtacggagtcaagaagcgaactttttatcaggacatgtatgagcaggtatctgaagctccatatcttgtctgcgtctcataagttcgcatatcgaagggaatcatcgtgaacacgacgcgtaataaactgctgaactggtatccgatcatggcggtgctggtgctgattgtattcgtgggcggagcctggctctgggcgtaccgcacgactccaagcgcctccgcaatcaccggcgagctcaacgcgattcctgtcaatgtgaccagcgaacagctgatccgtgacggatacattgatctcaccaaagtaggagaatcctctaacgtcgcggtgaatgagtttcttgccgaagcgaaacagcaggaagcccccgtactgaaatacatcaacgtggagaaggggagcctcacggctcacgtcctgtggtatgacccatatgattcgaccccttgggccaaagccaaggatggttcggtcgtgatctaccacaaccagaccgggcgaatccgcgcatgggcgtggcgcaacggtgagattgtccaaaacggtgaacgctacagctccaaagcggtgacggtcacgaaggacggagtcgacaccgtgcttctgccgtggcggccggctgcgcccgatgtggtcccggaagatgacgacggggcatcatcgttggcgctgtattcgtatcgttcgtgattgcatagcagcatgcccccggttctgcgggggggggcatgggcgcatgtctttgtcgtgcatgcccccgcgcggccattccaggatggcggcgcgatgacgtcttatttggtgtccatggtcggggcatcacctgatgtgcggtgcgccgtcggtgccgcgctccaggtctatgctgaggctgtggactagaaaagcgtttctaagtgcgcgccgaaacgatgagtgcgcgcacataggcacgcaaatggcccggtttgcgttcttaagtgcgcaggattgtcgtttcggcgcgcacttaggaacgctttcatgtgttacttggcggtttgcggggggggggctgattattgcggattatagcgggtgatgatggtcgctgtagcctggtaaccgccctcagtctcgctttgcgcgccagctcccgccagcgggagcataagttgtgtggggctcgctggcggggctgacctgagcggcgatggtcacggccagagatgcacgatcaccatgtagatcgcgaccatgtggcaggcgtagccggcgacggtgccacagtggaagatctcatggaatccgaagacgcgtggccacgggtcaggcttgcgcagcgcgtagacgatggcgccgaggatgtagcaggcgcctcccgaggccagcagcaccacgacggcagggccggcggcgggggagacccagaagaagtacatgaacgccacgccggagactccgaacacgatgtagacgacggtatacagccagcgcggggcgctgatccagatcacatggatgatgagcgccaccagcgtgcagctccatatgccggcgatgatggcgttgcgcatatgcggggcgagcgcgaacgacaccggcgtatatgtgcccgcgatgagcaggaagatgttcacgtggtcgatgcgccgcagcacgtcggtcacgcggggcgaccagtcgccgaggtggtaggcggctgagttgccaaacaggatcagcgagcaggtcatgaacaccacgcaagcccatttcaggggcgcgccgtgggccaggcatatcaggacgatgcctgcggcgagcgacagcggcgtggcgattgcgtgaatccaccctctcatcaatggcttgggtcgtccgtgcacgtcgagacggatcttgcgctccacttccgccggggcgattccctcgatgcgtgcggcgtgggcctcgcccttggcgagggtcctggtggctttttcctcggccttatgtcggatcgcctcggccttcgcgcgggatttcgctctcaccgcgtcggccttcgcctgcaatgcgacttcccgcgccttgatgacagcggctcgcttcgctgccaccgtcgcgtcgtcctgtactgccatatgacctccccgattggttacggaaacgtaacttacgttagcgtaggttatagacttgtccgctcacggatgtgctcatgaagtacggatgacgattgcgtcatgcatcggcatggtattgcgtatcatggtactcatggctgatttcacacacattctggctactcgacctgacttcaccgaaagcgatcgcgaatggctgcaccatctggtcgccgactggcaggtgatcgccgatctgagcttcgccgacctgctgctgatcgtgcaggacggcgacggcaactaccgcatcgtcgagcagtgcaggccctccaccgtgatgaccctgagaatcgatgacgccgtcggcgcgctggtcgccccggaaatggtgggggagctggatgccgccatgcagtcgaagaccgtgttcaggtccactgtgctcagggcggtcggcaaatccacggtctgcaacgtgtacgcccccgtccgtcatgacggcaagacgctggggcttgtcgtgcgtgagaccaacatggccacgcgcgagtcgaacggccggtacgagtccgaaagcatcaacgcgggcaagcagttgtatgagatgattccccgtggccagttcccctacgtcaacgcgatcatgagccagcgccatgtcgcgcgtgtctcggacggcttcatcatgctcacgcaggagggcatcgtacgctacgcctcgcccaacgccatcagctgcttcagaaggctgggatgcctgatgacgatgcaggggcatttcctcagtgaaatcggcaccgacctgctgcgtcgcaacgatccagtccccgaggcgctgccgatggtgctgatgggcaaggatgcagtggattccgaaatcaacgccaaccgatccgcggtatccgtccggtcgctgcccctgtacgacaataacgggcgcaccggggcgatcatcctgtgccgtgacgtcaccgagctgcgcaggcgtgaggtcgaactgcagaccaagaacgccacgatctcggagatccaccatcgtgtcaagaacaacctgcaggcggtctctgcgctgctcaggctccaggcgcgcaagacgaagtccagtgaggtcaaaaaagagcttgaagaggcacagcgccgtgtgcagaccatcgccatggtgcacgagggactgagccagaccgccgatgagatcgtcgatttcgacaaggtcatctccaacctgctgaagatgagcgtcgacttggccacgatgtgcgaccagcacatccacatcgattacgtcggcaagttcggcatgatgcccgcacaggacgcgaccccactgtcactggtgctcaccgagctcatcaccaactgtgtggagcatggtttcgagggacgcaaggaggggcatatcaccatctccgccgggcgcagcggcaacagcctcaatgtcgtggtggaggatgacgggtcggggctcgccaacgaggaacacgacggtctggcacgctcctcgggctccggattgggcacgcagatcatcaacacgttcgtcaccaacgatttcggcggcagcgtgcgctgggagccgcgtcacgaaggcggcacccgggtcatcctcgacatgacgctgcgcgcggcgcagaacgagtgacggccgcttgacggcccgaaaacctgccgaaacatgattgaagggtggcctccctgtgggggagaccacccttttcgtagcatatggagctatgaatcggctgcggcgaggagtcggttgtgacgaggagcgactcagacctgcagctgcatggcctgggagcgacgcgcacgcatcgcgcgacgcttcagggcgcggcgttcgtcttcgctcagaccgccccagacaccataatcctgattggtgtccaacgcgcacttcagacaggcgtcaatcaccttgcaggtgcggcagaccgccttagcttcctcgatctgctggtatgcggctcccgtgtttcccaccgggaaaaacagttccgggtccttgtctcgacatgctgccttggcacgccaatcaaaagcgctgctcatgtgtatcaccctcctcccatcgcctattgccgacgacgagctttcaagtcatacattaggtaaccacgaaacgaatgttttttcaagaggttttcgctctcaagtgtgaagaacttcagattttggccatggcgcactgtatccacagggcgttcccttcgcgcagcagcacggcgcggcccgccgtcatgatgtcatccggcccgcattgcgacagcaggccggcgggtatgccatccatcaggtccacggtacgttcccccgtggggaagactattctcgtgccgcaatgctcggggattcggatgtgcttggaggtctccacggcgaacacgacggtgacgtcgtggtcacccagcgcgtccttgagccgtgcgcatagcgggtccgtgccgaacggatcgaacagtgtgtcggcatcgtccaccagccacagcagatgcggggatacgggaggtggcgattcggaggagaaccgcacccgtctgtgatggcgtaccgtcgacgtgacgaacgcccgtccctcgcggcgtgtccagcgcacgcacaggccgagaatgtcgcgtgaacggtgcgctagcaaggcgagaatcgtggacttgccgcgtcctgcgcttccgatgattccgacattgccggcgtttacggcgagttccgccacatcgatgccgatgccgtcatcggcaagggcgaagggcactgagggaacgtccgatgaccgtgcgggcagcatgtcggcctccacgatgcggggcagcggggccgtgaacagcgccgaggcatggaccagaccatggaatgccgcagctgtgcgcgcggcctcgaccatcgcgccgatgtccgatacaaaggcgcatcggaacggctccacggattcaccgtcgttgcgccatgcgcacccgggagcggacgggctgatggatgccgcccgcccgtctcccagcaattcgatggattgcaggccgtcccggacacgcaggcatatgttcagcgccatgttcgctttcatgtcggcgctgacctgtcccagcgggttctgcgtacaggcgatgacatgcatgcccagggaacgccccagcgaggcgatgcgcaccagccggtccacatagtcgggcagctggttgttcagcgcatggaactcgtcgatgacgacgatcagcgagggtggcggggattgcaactgcccgatcgagccgacacgctccgcggcgaccagatgctccctgcgtcgcagctccagctccagcgccctcaacgcgcgaacggcgtgattcagatcgaggtcgcacacgctgcccacggtatgcggcagccgctcgatgacgctgaacgccgaacctcccttgaaatccaggaacacgaaatgcagccggtcgggcggattgcgcaccgccatggccaggcaccagctttgcaacagcacggatttgccggagcccgtggtgccggcgaccaaggcgtgcggcccttggcggggcagatcgatcgtgaacggccgctgccctgaccccatgcccacggtgacgcacagcgacggggaggcgagccatgttctcgcgatgatgcgccatggcagcggctcggcctgaagccccgtcagctcctccagtgagggcgagtgaatccgtgacggatcctccgattcgtcgccttcatccttgtcccgatcggctccgtccgccgatccatgatggcggccccgggctcctgccatatcggtgggccgacttgggcggccgcccgcagcgtcgtggctcgtcgtcccggattcgtcgcggcgtgacgatccacgacggtcagcaagggatgacgccgccgaagccatgcatcccaccatgcccggcgcgaccatggcggcgaacagccaacgtcgctccagcagaagcatgatgaccatcaacgcctgtgcggcgatgggcgcgaccagcgtgatcatcggcagagcggacgatccgcgcacgcgtcgctcgcgcctgggacgccgcctgcctcggccgcgccgcccgcgcctcgaatccgggttcctgccttcgtccatgccctcagtgtggaacggcgtcgccggtatgcgcaagcttgggggaacaatgtggtcgaaggctaccgagttatccacatttcggcgtgtcgtggccagcgggtggaacacgccaaccggccacgacgaggaatgcggcctgccgcatcattctgcgatcactggttggccagcgtgcccacggcgcccggcttgtggctgcccgaagcgagctctctgaacagttcgaggttcttcgcgtcatccagcagcaccgacgagccgaccccggacacgttgtagccgggattcgtccaatagacgctgccgctgatgccgttgtcggaggtggcgtcgcggaacgcgaacaccatctgtgcgagcgtgtacgggttcgtcttggaatcgacggtgatggacgccaaagcggctttcagcgtcttgttgagtttcgggatgttggtcagcgtcttgccggacatggccttcttcgcgatggctccgatgacctgccgctggcgttcggcgcggccgaaatcgcccttcgggtcggagtagcgcatgcgcgagaacgccagggcggtcgccccatcggccgtgtggcatcccgcggtccagttgagattggacagggcgtcgttcacggtctggtcatagcacaggtcgaccccgcccaacgcgtcgaccacatccttcaatccgttgaacttgatctgcgcgacgtggtcgatcttctggccggtgatggtctcgacctgctggacgagcgccttctcgccggacagctgggcgacggcgttgatcttcatataggtgccgttcacctgcaccagcgaatcgcgcgggatggagatgagcgagcgggtgccggaattgggcttggtcagcacgaggatcgtgtcggtgcggaacccggtgatcgtcttcgcctcttcgccggtgcgctggtcggatccgaggatgagccagctggtgcctgacgtgttggccttgtcggacagccagggctgcttgtcgagctgaccgtcgacccagttccacagtccgaacgtcaccagcatgatgacgaccagcagagccgccaaaacacttgcgacgatacgtcccacggggcgctttctgcgcatggcggtggctgccggcctcccggacatgccacggccgccaccctgtgcggccggcatgccgtaaccgtaagggctctgcgggccctgacgttgtgcggaggcgaacatcgactgcgcacccgcgccctcgcccggacgaggctggttcgaaatagtatgcgtggagcccgctgcacggcggggctggcgtcgggccgcagaagcggcgtcctgcatgggagagaccggttgcaggcgggcgtcctgctcggatgcggaccgcctggtcgacccggatacgcgacgcgatgaattcggcgtgaaactgggaatcacgtcctgtgcggccggcatgctttgcgctccctgagcgcctgccgaggtctgccgacgcgacggcacgcctgcctgcggaccggctccgggcacggcctcgccggcggccgacggacgcggcacctgcccgctggggcgacgcttgcgcgtgccggagggaatgaagctgggaggattgtcctgtgggctgactccactgtttccttcgctcatggttcctccagtgcctcgtgttctcaatcccttttacacgttgtcatgagtcattgtcgtgtccgttgcccattcctctgcagtaacggcacatacgtgaagggctggtggtcggatgtgacagggaatgaggaaggcatgggggtgaaggctgatgtctcttaccacactttcgcccttctgcgctgcattgacacggggcagacttgacaaaggtaagtcgcatgtgtgtaattaccctgatggacgtccatagcagcatcggcaaggaggagcgacacatgtggggagtggtcgacgattccgccgaggatccgatgagtgagctgtggggcctgttcaagtcggacgacgatgtttcctggcagcataaggccctgtgctcccagaccgatccggaagcttttttccccgaaaaaggcgggtcgacgcgtgatgcgaaacaggtgtgcgcccgctgcgaggtgcgcgagcaatgcctgcaatgggccatcgaacacgatgagcgtttcggcatctggggcggtctgagcgaacgcgaacgccgccgctataagaaggaacacaaggaacgtgcgtgacgcggcggccgtgcgtcgcatagactggagattatgagttccacaggcaatagcgatattcagcggattctggccgatgtcatggcgaacaggccatattcgcatcggcagaatgtcgatccgaccgtcgtggcggtggtgaccgttgaagaggacatgcggtttctccccgacaccatgggggcgctgctcagacagacggtgctgccgggcgtgatcgtcatcgccgattgcgccggcggcgacaatcctccggtgcaatcgcagttccaggtcattcctgcgccgtcgggactggtcagctccgttccgcagcccaagactgtcacggtcgagctggtcggcgtcaagggcgcccgttcgttctatcacggcgttgccaaggcgctgcatgacgcgcaactcgactcgtccacccgcgcggtctggctgttgcatgacgattcacggcccgcggacgacacatgcctcgaatcattgctggagacgtggcgtaacgatccgaccgcatcggtgctgggagccaagcagctggactggcaggccgaacacctgcatgacgtcggcgcgtatgcgtaccggcatcgcgtggagtcgctggtggtcgacggcgaaccggatcaggagcagtatgacggccgccgtgacgtgttctcggtgagcctcgcgggcacgctcgtctcgatcgagaccatgcacgagcttggcggtgccgacgactggttcaccacattcgccgaatcggaggatttctgccggcgcgtatgcctgagcggccggcgcgtcgtggtggtgccccaggcgcgtatcgcccatcggcgggcgcgattcgaaggggtgcgcaccaagggcggcgagcccgtggacgaggatcgtcccattgacagttcgatggctcgcatcagggggaggatgcgctactcctatacggacacgcgcctgatgatgtggccgttcgtctgggtgttcggcgtgttcgccgcgattggcaaggcgatcgcgaaactgttcgccaagcgtccgtacgaggcgctgtgtgaactggtcgccccctggacgctgtggggcggcctgcctcgcgccatcgcggcccgtcgccgcgtcagccgccaggagtcggtgccgatcggatgtctcggcgtcctcgtcgccaaccggcagcaggtggcgcagtggcatgaccgcgtacaggcgctgtcggaccagcgccatgtcgtcctgctgtcgccgctggccaaggcccacttgcgccggcgtgcgattcagcgctggctgctcgcggtggcgatggccttggtatgcttcggcgtcgtggcggtgatgcacggcaccacattgcgtgccgttctgtcgggagcgtccctgtactccgattcgctgctgccgaccggcggggacttcggtcagctgtggcgagccgccaccacgtcgtgggtgttcggtgacggcatcgccgccccgcccgcaccgtggctgctggtatggggactggcctcggtgataacggccggcaatgtgtctgccgcgatcgcgttggtgacgtttgccgcggcacccctcatggcgttgtccttctgggcgttcgccggcgtgttcacccgttccgacgcggtccgtgtcgcatgtggactgctgtgggcgtcgttcgcgctcggcctggggctgttctccgcaggcgatgtgccgatgctcaccgtgatggtgttcctgccggccgcgttcgccttcgtgttccgcgcggtgggtctgtatcgcaccgaggaccaggtgacggcccatccttccgttcaggctgcggctcttgcggcgttgtgcttcgtacccccggtcgccgccgagccccagctgatgctgtccctgatcgtggtgttcgtcgtgttcctcgccgtggtgccgcggcatcgcgcgatgctgctgctgattccgctgccgtcagggttcgtgatcgcgccgaccatcatcaacgcggtgcaccatgcttcggaagggtcgtggcgtcagctgttcggtgatgtgatggtgccgttatccgccaggaacggcgctccggatgcttccgggttcgccacgctggccatgcgtgcgttcggtgtcgatgatacggccggcaacggtctggcaggcctgtcggcggccggcgttttcggtatcggcgtcctggtgctgctggccgtggtgacggtgcttgcggtggcgtcgctgttcctgcccttcgcattgcgcgcctcgcgcatgatgtgggtcgtcacgctcagtggtggggcgcttgccgtcgcatcgtcgaggatcgtcgtggccgtcgatgatgacggtcctgtcgcgggttccgtgctgcccggcgtggtgttcgcgttgcttggtctgctcgcctgcgtcggattggtctccggaatggcggtccaccggttctccttgttgcggcaggggaatggctcgcaacccgtgctgacacgtcttgaaggccgtaaggccaaaaacgccaaggtgcatgcggtgttcgcccgtatcgggcgcggcgtgctggtggccgtgctggtggccggtgccgtgtcatgcactgcggcgtcagccatggaaccagggtcgaacggtctgcacgcgtcccgttccgatgacgggctgcccatggtcgccaccgattatctcggcaaggacgacgcgcaccgcgtgctcgccatcaccgccgaatcatccaccggcgtacggtatacgacgatgcgcacgtcacgcggcgatctgatggacagctctccggcattgcgtgcccgagtcgcggatggcggtcatgactcccgcgacgccgtactgtcgtccgcgagcgcccgactgctggtcagcgccgatgccgacgcgatcgccgatatcagcgcgttgggttacggcggcctgtatgtggtccgcccatcggctgacgatggcggctcccaggccacggaacagttgatttcgaacatcacggcgagtgagggtatccaatccgtggtgagtaacacgtcgggtgtctattaccggctcacgctcgtcgacagcgcgacgcagcgcgtgccgcaggacggtatgctgaaacagcggcatcttgcctaccggtatgcatggctcgtgtgcatgggcgtggtgatggggctgtattgtgtcgtcgcgttcccgcgcagccaccgtcgtttcatcgaggaggaccaatgagcagccaagtcaaacgcggaggcaaggtctggaaggctgtggtcggcgtcatttccacggtgatcatcgtcggcctgttcgtcgccctgctggtactgacggcatcgggccgttgggtcgactccgtctcgtcggattcggcgtccgtctcgcacgcggtgagccagaggcggatcaccgcatactgcccgtcccgcatgacattgccggatgcgtcggcgtacggtgacagcgaatatcagccgagtgaaggcgacatctcgtcttcggccggattcgccgcgttcggagcggtgtaccggtctcagttcggcgcgcttggcggctccggcgataccacgcagctcaaggacctcgaccctacggataccgcgaaagtcatcgcagcctcggccgacgtcgaccgtacgtcgctgctgttcgacacgcagctgttggaatcggccgcgggcgtcggcgcttccgcgtccgtggcgtcctgggcgacgaagggcgacctgcgcggcctgtccgcgacatcctgcgatgtcggtgcgctggagcagtcgttcgtgctgcctgacacgcagaccggcaccacccagcagctggtcgtggccaattcgtcttcgaaggccactgtggtggatgttcgggtgtggggtacggaacagtccggtgcgctggcgttgtccacgggaagcacgctgaccgtcgcggcgaacgccgaatccgtgctgagtctttccgcggccgcaagcgggcagaaggggctgtatgtcacggtttcgagccggcaaacgccggtatcggcatcggtgcgcgtgatcaggaccgaagggctgaacccgaagggatcggattacgccgccgcggccggggaggcgtccaaggagctcgtcttcccggccgtcgcggagggagacaaggcgacactcaccgtatacgcggccggttcggggtcgctcaccgccgcatgggtcgccgcggccgggcagtccgtccatcagtattcgggcgaccgcgtcaccaccatcgatctgggcgatgttcccaaagacgcgtcggcgctgaagatcacggcggatacgaaggtgacggcaggtgtgaccgtcagccgtgacgggaacgggaaccagtccgatttcgcgctgatcggcgccgcgcagacagacgaccggtcggccgccgtcattccctccggtcttgacggccgtgtgagcgtggtgaacgcgtctttatccagcaaacagatgcacatgaccggttacgacgacaagggtgccgcggtgggggagaagaccatcacggtggacgccggtgccgcggcgagcttcgacgcgtcggatttgggaaagaacgtcttcgcggtggccgccgacggcaagggactggcatggggtgtccggttgtccagctccgcggtgagtgacgccaagctcgccggcatcgcctacatcggtgccacgccgttgatgccgctgcaggagaggatctgggcgcggtcggatatgaccatcgttcactgacggtcgggcggcggaacgttccgtggtgctccctatgaggggtgctctatgaggtttcgccccgacagagccttacaggctccaatccgggtcgatctcatccggccggcggccatagagctcggcgagccgaagcaccacctcatcgcggatggccagttccagatccatgcggctgcgtgatttgctctgtatcggcatgcggtacagcacgatgcgggcggggatgccgtggctcgcagggaaacactgggacgcgaacgacggctccggctcccaaggagccggctgcgagggcggcacatcctccacggcgaactgcaccggcttgaccagttgcggccaggcaccgttcagacgccggatctgggccgcgaccatgtcgtcgaacgcgccgctgcgggtgcggtagcgcgggagccgcgtgccgaacatcggcgtgcgcatgccccgcccgtgacgattgcgatacgttggtcgttcccatggtgcctgttgcatggactccactgtaggacaagccggcggcaatgcgttaggatacttatcatcgacaaggtttcctggggaggtgtgcagatgccaacagcgaccgtgcacgcttggaatgataccggttggcgacacgacggcgcacatgcgcgtctgatcgccttcgacctggacaacacgctggccgtctccaaacaaccgatgaaaccggatatgaccgttcgcatcgaggcgctgaccgaactgatgccggtggcgattgtgaccggcggcgggcgtgaactggtcatcagtcaggtgctcgacgtgctgggtccccgagctgacctttccaacctgcatgtgatgccggcggggggatcgagctattaccgctggcgcgagggcgcatggcgtctggaatacgagaggacgctgtcggcccgggacagggacgcggccatattgtcgctgactcgacgcgcccgagagctgggcatgtggccggagcacccgtggggggagtccatcgaggatcgtggcagccagatcacgttctcggctctggggcagctcgcgccgatcgaggagaagcgtcgttgggatcccgacgacaccaaaaagcggcggctcgtcgccgcggtggcgggcgacctcggtcatctgcgcgtacgcgcgggcggctacacgagtgtcgatgtgagcgccggaaacaccgacaaggcgttcgccctgcgcgaattggcggtacggctcggcatcagcaccggtgacatcatcttcgtgggcgaccggatgacgcccggcggcaacgactatcctgccgcgcaggcgggggctatcgcgcttcaggtcaccggaccgcaggataccgtgcgtctgtgcgacatcctgctgcctttgctgggtggcgagccggttcggcaggacggatgaaccatgggatggcacggtttcgcgcgaatgctcacagaagtggccggatcgctgcgggacgtgctgctgccgcgtggctgtgcgggatgcgacatgccggacgctgtgctgtgcgatgactgtcgcgcttcgggtggcggcttcatgtcgttcgctatgcctggcacggtttcgggccgggcgattgcctgcggcgcatatcgcgggccgctgcgccgtgcgatactgcgatggaaggatcatggcgacgaggaatgcgatggcccgttcgccgatatgatggccgacgcgctgctttcgtcgggcctgctggcttcggatccgatgccggtgacgacattggtaccggccccatcctccccgcgttcgatgagggagcgcgggcggtggcatatgcgtaacgtgacgaactcattggcgcggtcgctgcggcggcgtggcatggacgtcgatacggccgcgctgctgcggacgacgaagacgagcggcaaatccgtgcagatgcacggcgccgcccagcgttcgcggcgtctgcaggggcatatcgtcatcgctgcgcgcccaccctacccacgcaacgtgatcctggtggacgacatcgtcaccacgggcaccacggcccggcaatgcgcgcaggcgctcaacgccgcgggaatacatgtgacaacggtcatctgcctggcgcgcaccctgcgcgccggcgaaaacacagacgactagccaagtcccctcccgctggcgggaggggacgcgcagcgccggagggtggtcgccacccggtcgagccgcacacccgccatccgcgcagatcaccagcgcaatccagttatttccgtcgcagccgacgctgtggatgaaaactgcccgtgaccacgccccatatcacgacatccccatgttcggaggggacgaaatcggggtagcggggattctccgcgtgcagcatggggcggccgtcgcgcgacagcagtcgcttgaccgtcagctccccatcgagcacggccaccaccacatcgccgtcctcgggcgtcagcgaacggtccacgaccagccaatcgccgtggaaaatgccggccccctccatggagtcgccggcgacggtggcgatgaatgtgtattccgggtgcttgatcacatgagcgtcaaggctgaagccctcctcccgcccgtccaaggcgggggaggggaagccggccgctaccatctcggtgacgatcggcacgggacggtgatccggtcgcgcatgaaccaccgaacgtgccgtgcaggcttcgggagcgcaattccggctcacaacagggcccgcgccgaaccgtcggtcgccggctcgtcatcggcgatatggtatttcggcagcacgatctcgaaatccgcgccgcgcgggtcgtcgaccacccggaccgtgccgccgtgcagctgtgcggcccaacgcgcgatcgacaatccgatgccggtgccgcccgattcggtgccggggccgctgcgccccttgacgaaccggcggaagatgtcggaacgttcctcgacgggaatctgagacccgaaattcaccacattcgtgacgattgtgccggtgtcggcattctcccgagcctcgatcagcacgctggtgccgtccgcggaatgcttgagcgcgttcgcgatgatattggtgaacagctggcgcagccgatcctgatcaccctccatccagatatcggaatccacgtgcagcatgatgtcgtgcgcgtgcccggcgtccgcgatctccagcggctcgatcgtctcgtcgaggaaatcatgcaggcagaaacgttcgatgttcaggctcgccgcgcccgcctccatgcgagacaaatcgagcaggaacgctatcaggtcggatagccggtgcgtctggcccagaatgccctcaagattggccggcgtgggctcgaccaccccgtccgccatgttctccaccatcgcctgcagcgcggagacgggggtgcgcagctcgtggctcacgttcgccaccacatcgcgcctcatctgatcggcgtgctgcagttcctcggccatttcgttgaacgtgcgggccaactggccgatctcgtcgttgctgttggtcgccacgtggacacggacgctgtaatcgccctccgacatcgcctcggccgcgtcacgcagctgcctcagcggcgcgatcagaccccgtgagaagaaataggtgatgcccagtgcgacgatcatggtcagcggcatggcgatccagccgctccacccgtacttgagcaggaaccagaccagcacgaacgcgatggacgtggcgatgacgatcaggacgctcaattccattttcagggacgaaaacagcccgatcggacgatcgaaatccaatcgggcctgtttcctgtcccacttctgacgcggcttcatcactgttccggcggctcgaaagcgtagccgacgccgtgcacggttcggatggtctcggaaccgagcttgtgacgcagcgccttgacatgggagtcgacggtgcgggtgccggatgcatccacccagtcccagacctcttcgagcagcttctcgcgggtgagcaccgacttgggtttgcgcgcgagcgtgaccagcaggtcgaactcggtcggcgtcaggtgcacctgctcgccgttgaccgtgaccagacgctgtgccgggtcgatgaccagcgagccgaagttgaggatcttctcgttctcggagttcttcgcgatgaccttcgcgcgttccacgcggcgcagcagcgccttgcagcgggcgatcagctcgcgcatggagaacggcttggtcatgtaatcgtcggcgcccgcgccgaggccgatgaccttgtccgcctcggcgtcgcgggcggtcaggatgagcaccggcaccgggcggtcggccacgatgcgcttggttgcttcaagaccatccatgaccggcagcatgatgtccatgattaccaggtccgggcgcagctgcttggcggcctgaaccgcgctggcgccgtcggacgccacgcgggcggaccatccctccgcggtgatgcgctgagcgatggcggtggcgagggtcggctcatcctcgaccaccagaatggtccgcggcgtcgtttgacgtgttggagaattaatcatgacgattcacctttcagttttccggtttcaagaataccgcccccaatgccggaatggtgagttttgccgaccaatcacgcgaatggtactcgcccttcaccgcggcgaacgtgccgttgtggatgtcggagccgccgtacttcttgtcgtccgtggtcagcacctcggtccagttgccgccctgcggcagcggaacctgatagtcctgccacgcctcgccggagaagttgaccacgacgacgagctgttcgcccttgctgccgatgcgcaggaagctgagcgtattgtggtcggcgtcatcgctggtcagccactggaatcccgccgggtcgaagtcctggctccagatggccggcgtgtccttgtagaactcgttcaggtcggcgacgagcttctgcacgccgcggtggtcaggccagttgagggcgtcccagtcgaccgaaccgtcatgattccactcgccgtactgcgcgatctcgttgcccatgaaggtgaggttcttgcccgggtgcgcccactggtaggcgaacagggcgcgcacgccggcgtagcgctgccagtcgtcgcccggcatcttgccgaacagcgagcccttgccgtacacgacctcgtcgtggctgatcggcagcacgtaatgctccgaataggcgtacaccatcgagaaggtgatctcgttgtggtgccatttgcggttgatgggggtctcgtgcaggtactgcagcgtgtcgtgcatccagcccatgttccacttgaggccgaatcccagtccgccggcgtcggtcggtgcggtgatgccggggtaggcggtggattcctcggcgatcatcatgacgccgggattgttcttgtacgcggtggcgttggcttccttgaggaagtcgatggcttcgaggttttcgcgacctccgtagatgttcgggcgccactggccgggcttgcggctgtagtccaggtacagcatcgaggacaccgcgtccacgcgcagcgcgtcgatgtggtattcgtcgagccagaagcaggcgttggcgaccaggaagttgcgcacctcgcgcctgccgaagttgaacacgtacgtgccccagtcggggtgctcgccgcgcagcgggtcgggatcctcgtacagcggggtgccgtcgaagcgtccgagcgcgaaatcgtccttcgggaagtgagcgggcacccagtccatgatgacgccgatgccggcacggtggaacttgtccaccaggtacttgaagtcgtccggattgccgagtcgggagtccacggcgtagtagccggtcacctgatatccccacgagcccgagaacgggtgctcggtcagcggcatgaactcgacatgcgtgaagccttccttggccacgtagtccacgagctcgtccgccagctcgcggtagttgccgatgcctttcttccagctgccggcatggacctcgtagatgctgaccgggccggcgtgcgggtcggtgtgcctgcggtggtccatccatgcctcgtcgttccattcgtggtccgattcgatgacgatggagccggtcgccggcggaatctcgtgggagcgttccatcgggtcggccttcatcttccactcgtggttcgcgttgagcagctcgtacttgtagacctcgcccgccttgacgccggggatgaagatctcccagatgcccgaggaaccgagctcgcgcatggcgtggcggcggccgtcccaggagttgaagttgccgaccacgcggaccgcgtgcgcgttgggcgcccagacggtgaacgaggtgcccacgacctggtggccgggagcaccgtcggcgccgcccatcgggtcgtcgtagcggcgaacgcgcgcgcccagggcctcccacaggcgttcgtggcggccttccccgaacaggtaggcgtccatgtcgccgatggagggcaggtaacggtacgggtcgtcctccatgacggacttgccgccctcgtaggtggtgcatacacggtagtcgggcacggcccagccgtccgcggtcttttcggccgcgatgacggtcgcgaagacgccgttgaattcgtgccgggcctcggccgttcccttctgggtgtatatggtgacgctcttggccagtggcctgagcactcggatggtgacggttccggcgtggtctccggaaccgaggtgaccgcccagcacttcgtgcgggttgtagaacgttgcattgctcaccgcgctcaaatcactttgattcactggcacgggagcgatatcttcattgatgttcgtgtaagtagccataacacagagggtaataccttcggggtactattgcgagattttggcaagtcgtgtccggagtgttcccatcgtcccggctgtatggcacaatacgtaaggttaagtatattgttgtcacggaggattcatggggtacaaggtcggcgatatggtcgtctatccgcgtcatggagcggcaagggtcgaggccattaccgaacgggtggtcaagggcgtgaagcgggaatacttgcaactcaccgtgctgtcttccgacggtctggtcatcaatgttcccgtcgagaacgcgcagaaggtcggagtgcgtgacatcgtcgacgccaatgaggtcgccaaggtcttcgagatcctgcgtacgcccatcgtcgagaaggagatgaactggtcccgccggtacaagctgaacgtcgagaagctggcgaccggtgacgtcaacaagatcgccgaggtcgtccgcgacctcgcccagcgcgacgtggacgagcacggcctgtccgccggcgagaagcggatgctcacccgcgcccgcagcatcctgacctccgagatcgccctgtccgaagaccttgacgaggccgagatccagcgtctgctcgacgtcaacctcggtttctccgagccgaagccgggcgacgagaagcatcacagcgaggcacccgccgagcctgccgaccggaccctggcccgcatcgaatccgaaagcaagaagtcccggcgcaagtagccggcgacgagcatgtccatgaacgctgttccagcgattggtcaagggtttgacgcgcatcgtttcgccgaggatccagcccggcagctatggctcgccgggcttttatgggatggcgtcggtatcgagggggattcggacggcgatgtggccgcccacgccctgatcgatgcgctgttgtccgccgctgggctgggagacatcggcggactgttcggcgtgggagccgatgctccgggagccggcatgcacggctgcgatatgttgcgaagaaccgtcgatgtattgcgatcgcatggaaggatgccatccagcgccagcgtggtcatcatcggcaatcgtccgaagatcgggcgacgccgggaggaagccgagcgcgcgctgtcggatgccgtcggatgccgggtgacggtgaccgccacgaccaccgaccatatgggattcaccggccggggcgagggaatcgccgccatcgccaatgcgctggtgatgtaatcgagcggaatcatgcgaatctcagcggggattcgcatgattccgctggataacgcccgcattcgcccgattcgcgggcgtcgtccagagtaatcagcgatgacgcagcgacgtcacgcccttggcgatcgcccagaacagcgtcgacaacgtgacgatgatgaagctcgggggagcggggaacatcgcggacagcaccagaccgccccagatcgacatcaggcacagcaccgtcgcgatcaccatcgccttgaacggcgaggcgacgatggcgttcgccgtggcggccggggtgatgaccagcgcaaagatcagcagcgtacccaccgcggggaccgcgatggtgatgacgccggccatgatcgccatgaacgcaacgttcatcagcccgataggcacgcccttggcctgcgccacctgttcgtcgacggagctgaacagcagtggccggtacacgatggccagcacggcgagcaggatcacgtcgaacacggcgaagccaaggatctgatcggtggttatagtcaggatcgagccgaacagaatggactgcatctgctgtgacgcggacgacgagagtcgggcgaagaacagtccgaggccggtggcgaaggcgagcacggtgccggtggcgatctcccgctgcgtggcgcgcttgcccaacgctccgatgaccagcgcgccgcccagcgcgaacactcccatgccgagcgagaccggcagccccagcagcaccgcgccggtggcgccgggcagtccgatatgggccagcgcgtgcgcggcgaacgtcgaatggcgtgcgatggtgaaatatcccatcacgcccgcggcgagcgagatgcacaggcccgcgaggaaggcgttggtcatgaacggggcggacagggtgtacatccagtcgggatcgaaggagaaactgatgccggtcattgtgcccgccctttccgctcgtggtattcgtgatggtggaattgtgcgacctcgctggtgtcatgcgtgtcgggaacgacgtcatccgcctcgtcgggggtgggggtgacgaacatgtccccctgcggcgtggtgacgacctgaactttggtgccgtacaggtgcgtgagcagcttggaatccagcacgtcgttcatcgccgcgtagtgaggatgcccgtccagcagatagacggcgccggtcaggatcggcagcagcatattgagatcgtgcgcgacgacttggatcgtcatgccgagctccttgttgagccgtgccagcacatgcaccacggcgcgctggctggccaggtcgagattcgcgagcggctcgtcgagcatgagcagtttcgggtcgcataccaaggcctgcgcgatggcgacgcgctggcgcagaccgcccgaaagctcggacagccggtagtgggccttgtcggcgatgccggtgaaggtcatggcctccttcaccttcgcgcgttgcgccttggtgacgaagtggacgccgaaacgggtgccggtcaggccgagcagcaccgactgctcggcggtgagattggagtcgatatccgaagtgtagctttgcggtacgtacccgatctggcggttcatctcgcctgccgggcgtccgagcacgtgcacggtgcccccggcgagtgggaggaggccgagctccgttttcatcatcgtggttttgccggtgccgttcgtgccgactatggcggtgaccgaacccgccggtatggagaagtcgccgtgttgccagatcagccgttcgccgcgtttcaccgaggcgttgctgaacacgatgcagtcgggccgttgttcctggtcgccgctgttgctgtgcatatgattcatcgtcctgtctgtacggggccggcatcacgtccgccggtgcgacatgtacggcaacgcattatcgcaaaggactatgacaatcattctcattagcggtggcggactcattagcggcgggggagacggcaatggtaacggtctggagcgggcgggcgaactcagttgctgctgccggcgccggtatcgcttttgtcgtcagcactgttgccggcatcgttcttggcgctggcgccgtctttgccgtcggaactgccgctttcgtcgctgtcgtcgatgatggcgcgggagacggtcttgtcaagccgggccaccagatcggcgatccaatcagtcagcgtcgtgtacgcctgcggcatctgctcactgacgtcgaacacggggacgccggcccgtccggccgtccctgtcagcatgttggtggcgtcgctggattcctgcgtgttgttgaccagcacgctgatgccttgtgattcgatcagcgactggaattcctgcaggtcggccggggcaggttcgccgcccgaggccgcggatcgggcgaaccccttgggagtgtcgtcctggaagcccatgtccgacatcaggtagtacgccacggcctccgtcgcaccgtacgtggcgttcttgcggttggcggcgaactcgcccatcgacttctcgatggccttttcctccttttgccatgccttgaggcgcgactggaacgccttcttcttggcggggagcgccttggaaaatgcctccgtcagttcggtcgccatgccgttgcgggcgtccttggagaaccataggtgggggttgtcgccttccatagctccgaccgtctcggcggccgagacgatggtcgagttgcggcctacggacttggtcgcccatgagtcgtatccggcgccgttcgacacgatgatctgcgctttctgcagcttggcgacatcggatgttttcggttcgaaatcatgcgcgtccacattcgtggagctgaggatggaggtgacgttcacgtcggtgccgccgatctgctcggcgagggagccccactggttgatggacgcgacgacggtgatcggtccggtcggctccttcgcggagggccgctcggattgcgagccgccgccggtgccgcaggcgctcgacgccatcagcatgcctgtggcgaggatggcggcaatgccggtgaccagacgatgcgggtgaatgttcatatcgctgccttcttcgaatatgccgtcgacggtccgccgtcggattgtcattgacctgagtccacgatagcctaacgctacgaagaatgaacgaactctagggaaggacgcacatgaccatcaaactcgatggcaagcgggtcgcggccgaggtcaaggcgaacctggcggaacgtgtttcgacgctgaaggagcacggcatcgtccccggtctgggaacgttgctggtcggggaggatcccggttcgatgaaatacgtcgcgggcaagcatgccgactgtgcggaggtcggcatccgttccatccggcgcgaccttcccgccgacgcgagtttcgatgacatcgccgctgcggtgcgcgacctgaacgaggatccggcctgcaccggctacatcgtgcagctgccgctgccgcgcggcgtcgacgagaacgcgatcatcggcctgatcgatccctcgaaggatgccgatggcatgcacccatacaatctcggcgaactcgtgctgcatgtgcagggcgacatcacgaccccgctgccgtgcacgccgcgcggcgtcatcgaactgctcgacgcctacgacatcgacctgaacggcaaggaggtgtgcgtgctcgggcgcggcatcaccatcggccgcacgatcggtctgctgctgacgcgcaaggcggtcaacgccacggtcaccctgtgccacaccggcacgcgcaacatcgccgaccacatgcgtcgcgccgatgtcatcgtcgcggccatggggtcagccgggttcgtcaagcccgaaaacgtcaaggacggcgccgtgctgatggacgtcggcgtctcccgcgtgttcgatgagcagactggccgtttccgcattaggggagacgtcgacaaggcctgttatgacaaggtttccgcatactctccaaaccccggcggcgtcggtccgatgacccgcgccatgctgctcgccaacgtcgtggagatggccgagaggaaaatgtagccgaattcgggcgtgtcgcgctggtttttccgcccattttgggcatggctgtaggtatcctgataacttgtgtgtgctcatatgggtgcacacgtataactgaatatcgagtaattattcatccactattagaaaccatatatttacatggcagagaacaacactgaagtcaccaaggtcgccatcaacgacattggcaccgaagaggacttcatcaaggcagtcgattccaccatcaagaacttcgacgatggtgatctggtcgaaggtaccgtcgtcaagatcgatcacgacgaggtcctcctggatatcggctacaagaccgagggcgtcatcccctcccgcgaactttccatcaagaaggacgtcgatcctgacgaggtcgtcgaggtcggcgacaccatcgaggcccttgtcgtcaccaaggaagacaaggaaggtcgtctgatcctgtccaagaagcgtgcccagtacgagcgcgcctggggcgacatcgagaagatcaaggaagctgacggcgtcgtcgagggcaccgtcatcgaagctgtcaagggcggcctcatcgtcgacatcggtcttcgtggcttcctgcccgcgtccctcgtcgaaatgcgtcgcgttcgcgacctctccccgtacatcggccagaagatcaaggccaagatcctggagctcgacaagaaccgcaacaacgtggtcctgtcccgccgccagtacctggaggagactcagtccgaagtgcgcgagaccttcctgtcccagctcaagaagggccagatccgcgagggtgtcgtgtcctccatcgtcaacttcggcgcgttcgtcgatctgggcggtgtcgacggcctgatccacgtctccgagctgtcctggaagcacatcgaccatccgtccgaggtcgtcaaggtcggcgacaaggtcaccgtcgaggtgctcgacgtcgatctcgaccgtgagcgcatctccctgtccctcaaggcgacccaggaggatccgtggcagcgcttcgctcgcacccacgttccgggccagatcgtcaagggcaaggtcaccaagatcgtccagttcggtgtcttcatctccgtcgaggatggcatcgagggcctggtgcacatctccgagctggcgaaccgccacgtggagaacccggagaccgtcgtcaagtccggcgaagaggtcttcgtcaaggtgattgacgtcgatctcgatcgtcgccgcatctccctgtccctcaagcaggccaacgactccgtcgacccggcttccgaggacttcgatccggctctgtacggcatgccggcagagtacgacgagcagggcaactacaagtaccccgaaggcttcgacccgaacaccaacgagtggatcgccggttacgagaagcagcgcgaggaatgggaatcccagtacgccgccgcccacgaactgtgggaggagcacaaggcgttcgtcgccaaggagctggagaacgccgcggcttccgctgccgaggatggccaggctccgaaggaagagaaggtcgaggagacctccaactactcttccgacaactcctccacgggtactctcgccgactccgaccagctcgccgctctgcgcgatcagctgctcggcaagtgagtcatcacatcccgagaagaagtagaatgccggtaggatttgccggcagataggaaaacgggaatcgccccacacgggtggttcccgtttttcatattccgctcccgccggcgggagcggtcgagcatagcgagactgagggtggtctttgcgcgatgccggtcatcctcacttcccggctgccttgaacaaccgcgacacgcccggatatccagcaagcctgccatgcgcgaatcagtgaaatggcggaatgctgcgagagtccaaaaaatcgccttccatctctgccacgaaaccgggcgtgtcgcgaatagcatgatgtcatgagcattcgtatcggactgaccggaggcatcgccgcgggcaagagcaccgtcgccgcccggatgcgggaactcggcgcgctggtcatcgactatgacggacttgcgcatgagatcgtggcgcccgggggagtggcgttgccacggatcgccgccgtgttcggcccggacgcgctgctggccgacggatcgctcaatcgggcgtggctcgccgagcgtgtgttcggccgtgacgccgctcccggcgcacgcgaacggttggacgacatcgagcatcctctgatatatgccgaagccgcacggctggagcgacggaatcccggcgcgaaggtcatcgtccatgacgtgccgctgctcacagaggtgatccggtcgattccgttccaattcgatcacatcgtcacggtggaggcgccggaacagatgcgcatcaggcgcatggtcgcgacgcgcggcatgaccgaacggcaggccgcagaccgtatccgcagccaatcgagcacagccgagcgccgggagcttgccgacatcgtcatcgattccacccgcccgatccccgacatgctggcgcaggtcgatgggctgtatcgccggtggaaggctcactgaatcattcgcccgtgaaaaggtgtgagcccggcagcgccgcaaaacgcacatgaaacccgccaaatcactgtatttccaagacatgcatgttttgtgcgattgtgctgtcttgtgcgttatcctcgcacttttcttattgagaaccgttcgctgaacggatggcggtaagctggaagccatgggattcaacatcgagcgcgcagacaagccattcgtcgtcaaatcaccgtacaagccgtccggcgaccagccgcaggccattgaggagctggccacccgcatcgagaacggcgagaacgacgtggtgctcatgggagccaccggtacgggcaagaccgcgacgaccgcatggctcatcgaacggctgcagcggccgacgctcatcatcgagccgaacaagacactcgccgcgcagctatgcgccgaattccgcgaactcatgcccgacaacgcggtcagctacttcgtcagctactacgactactaccagcccgaggcgtatataccgcagaccgacacgtacatcgagaaggattccaacatcaacgacgatgtggagcggttgcgccatcaggccaccgcgaacctgctcacgcggcgtgactgcgtggtcgtcgccaccgtttcgtgcatctacggcctcggtacgccggaggagtacgccggccgcatgctgttcctccaggaaggccagcagattgaccgcgatcagctgcttcgcaagttcgtcggcatgcagtacaagcgcaacgacatcgcgttcacgcgcggcacgttccgcgtgcgtggcgacaccgtcgagatcataccggtatatgaggagctggctatccgcatcgagttcttcggcgacgagatcgaccgcatctccacgttgcatccgctcaccggtgacgtgatcgaccacgagacctccgtgcacatcttccccgcctcgcattacgtcgccggccccgagcgcatggagcatgcgttgaagaccatcaaggaggagctggaccagcgcgtggccgaactcaagaagcagggcaaggagctggaggcgcagcgcctgaccatgcgcaccacatacgacctggagatgctgacacaggtcggcgtgtgctcaggcgtggagaactattcgcggcatttcgacaaccgcgcacccggtacgccgccgcacacgctgctcgacttcttcccggatgacttcctgctggtcatcgacgagtcgcatgtcaccgtgccgcagatcggcgcgatgtacgagggcgacgcgtcccgcaagcgcacgctggtcgaacatgggttccgtctgccgtccgcgatggacaaccgcccgctcaaatggccagagttcctggaccgcgtcgggcagaccgtatacctgtcggcgacgcccggcgactatgagctcggtctgtcggacggcgtggtcgagcagatcatccgaccgaccggtctggtcgacccgaagatcgacgtgcgcccgaccaaggggcagatcgacgacctgctcgccgagatcaaggaccgcgtcgacaaaaacgagcgcacgctggtgacgacactgaccaagaagatggccgaggatctgaccgactacctgctggaacgcggcatcaaggtcgaatacctgcattccgacgtcgacacgctgcggcgcgtcgaactgctgcgcgaactgcgcgaaggcaagatcgacgtcatcgtaggcatcaacctgctgcgagagggactggacctgcccgaggtatcgttggtggccatcctcgacgccgacaaggaggggttcctgcgctcgtaccgctcgctgatccagaccatcggtcgcgcggcccgcaacgtatcgggcacggtcatcatgtacgccgacgagaccaccgacgcgatgcgcaaggccatcgacgagaccgaccgtcgccgtgtgcggcagatcgcctacaacaaggagcacggcatcgacccgaagccgctcatcaagaagatcagcgacgtcaacgacatgctcgccaaggaggacgtggacacggccacgctgctcgaaggcggctaccgcaacgcgggcaaggccggcaacacccatctgggtgtgccctccctcgacgctgcggaggccgacaagcgacatgaggagatactcaaggcggggcttcccgcgcaggatctcgccgaccttatccgtcagctgagcgagcagatgcacaccgccgccgaacagctccagttcgagctcgcagcacgcctgcgcgacgagatccgcgacctcaagaaggaactgcgccagatgacggaagcgaacaagtgagcatttcgtgacagagagcgtcacagccctttcctatgctggtagacatgtctgaaacccctgtcgcttttatgatcgccacctttgcggtgctgatcgcatttttcgttgtggatctgttcgtcatcggccgcaagccgcatgtgcccagcaccaaggagtgcgtgcagcacatcgcctttttcgtggtcatggcgctgattttcggcggactggtatggtgctttgccggttcgaagcccgcgatcgaattctattcgggatggctcaccgagtactcgctgagcatcgacaacctgttcgtcttcgtcatcatcatgtcgaacttcgccgtgccgaaagtgctccagaagtacgtgctgtccgtcggcatcaccgtcgcgctgattctgcgcggctgcttcatcctggtcggcgcggccattattcagcggttcacgtgggtgttcttcctgttcggcgccttcctgatctatacggcgatcaagctggtcgtcggaggcgatgatgatgaggaataccatgagaacggcctgatccgcatgctgcgcaaggtgattcgcatcaccgacgattatgacggcgagaagctgcgcaccgagaaggacggcaagtcgtactggactccgatgctgatcgtgttcctgaccatcggcacgacggacgtcatgttcgcgtttgattccattcccgcgatcttcggcctgacgaaggatccgttcatcgtcttcacgtcgaacgtgttcgctctgctgggcctgcagcagctgtacttcctgctgggcgcactgctcgacaagctcgtctacctgccggtcgggctcgcgttcgtgctcggcttcatcggcatcaaactggtgatggaggcgttgagcggcaatacgctgccgttcatcaacggcggtcacccggtctcttgggtgcccgaggtaccgacgtgggtgtcgctggtcgtgatcgtcgtcgccatcggatcgtcggccatcgcgagcgtcatgaagatgaagtcggtcgaggccgcgaagagcgaagcctgagccgcccaaaaaaatgtgagcgctcacaacacgcccgtgaaaacagtggctcacgtcgcccaaacctagtacacttgcctgtggcagtggaagtcgcaagacttcttcctagaagaaatcacataagaataggtaggcattcatgcgtaaagccaagatcgtagacaccatcggtccttccaccgagtctcccgaaggcatcaccaagctgattgaggccggtatggacgtggcccgtctgaaccgttcccacggcactccggaggatcacctcaaggtctacaacaacgtgcgcgcggcctccaaggcgaccggtcgtaacgtcgccgccatggtcgatctccagggcccgaagatccgctgcggctggttcaagaagaacgccgagggcgaggacaaggtccagcttgaggaaggccaggagttcatcatcaccaccgacgatgtcgaaggcgacgagcacatcacctccaccaccttcaagggcctgcccggcgactgccaccccggcgacccgatcctgatcgacgacggcaaggttcgtctggaggtcaccaaggtcgagggcaacaacgtgcacaccaaggtcgtcgttgccggcccggtctcctcccacaagggcatcaacctgcccggcgtggccgtgagcctgcccgccctgaccgagaaggatgaggccgatctgcgttgggccatccgcaccggcgccgacatcatcgccatgtccttcgtgcgtttcgccaccgacatcgaccgcgcccacgagatcatggacgaggaaggccgtcgtatcccgatcgtcgccaagatcgagaagccgcaggctctggagaaccttgaggacatcgtcaagacgttcgacggtgtcatggccgcccgtggcgacatggccgtcgagtgcccgctggaagaggtcccgctggccaccaagcgcatcatcgagctggctcgtcagtacgccaagcccgtcatcgtcgccaccgaggtcctgggctccatggtccactccccggttccgtcccgtgcagaggcttccgactgcgccaacgccgtgcttgacggtgccgacgccacgatgacctccaacgagaccgccgtcggcgagtacccgaccgagaccgtcgccacgatgagccgcatctccggcttcgccaccgagcacggcttcgaccgcatccccgagctgaagaacctcgacatgtcctccaccggcgccgtttcctccgccgccgtcgacctggccgagaagctcaacgccaaggccatcgtcgcttacacccagaccggcaacaccgtgcaccgtgtgtcccgcgagcgtccggccgccccgatctacggcctgaccaccaacgagcacacctaccactggctggccctctcctggggcaccgaggccttcctgctcgatgaggactaccacgacaagacccgcaaggatctcatggccttcaccgacaaggtcctcaagaacgccggcaaggtctccgacggcgacaagatcgtcgtgctgagctccgctcagggcgagcacgccgctggcagcaccgacaccatctacgtgcacaccgtcggtgccaacgactgatttcagccgatagcagattcggcttccgctgcgtgacgacggaagccgaatactcatgcgtgagcccccgctccgaaacgagcgggggctcacgcgctttcgccagggaaccgcatcggctcaaggacgatgcggaaggtcgtcgcgcggatgcggggcagatgcgcgactgtctcgtgcggaaggcgaaccgcacaatctcacatgctcacatgccgatgtgctccagcagtccctcatgcaggcgaaggatcgcgataatcgtcttcgcatcaatgatggtgccgttggtcaccatctccatggcctcctgttgcgtgtacaggcgtaccgcgggacgtggcgtctccgggccgatcgcggaacggtccacctccttgagtcccgtcgccagatacagcgcggtgtactgcgaggagaagctgggcgtgttgatgaagcgcgtgaactgggtgagctttgaagcctcgtagccggcctcctcgcgcagctttcggcttgcaacgtccagatactgctcgcttggcgcgttggcatggcctgccggaatctccaacgtccagcgatgggtcgggatgcggtactgctcgacgaacggaatcttcccgtcagcggtcaccgcaaggacgccgacggtgtccccgttgttctcatgcaggatgaaccgttcgaactggccgacctgcgccgaactgaacgcgaccctgtccacgttgaaataatgggtctcgacgatttgcttgcgggactcctccttgaccggtgtcggacgccacggatcgaagggtctgtaagtgtcactgtccatgctcataagcctcacctttgatagttctcttatgtgtttccattgtaggtccgcgctggtgagttgcggggatattcggcgcggcgttgatgctaccggcgtaaatcgcgtgccggggcgtatggcgtccacggaaccggcgtgactcgctggaatgatgcgcggcacgcctgcaatggacgaatgacgtagcgatatgctaaactatcgcgagtgccagaaacgccctcgtatcccaattggtagaggaagcagcctcaaaatctgcgcagtgtgggttcgagtcccaccgagggcacgttgcattatcgggtgagccacagtgccgcatcgccgaatctctatgttatcgttatacatgaagttctgtcgatgaatcactgtgtcgtggaaaagaggttgtgagcatggtggcaagaaagaagacctcaacgcaagagcaagagggtcaggtagaggaggtgctttccgccgacgagctgaaggcagtctccgaaggcgagcccgtcgagagcgccgtgcacaagaagcgcacggtcgttgtcgccgaggacgagtcggtgaaccgcatggatctggtggccatgctggaggataacgggtatgaggtcgtcggcgaggcggccaatggtgaggaggccgtcgatttgacgcgcaagttccgcccggatatcgtgtgcatggacgtgaagatgccccgtatggacggcatcgccgccgccggcgtcatctgcgacgagaacatcgctcccgtggtgatgctcaccgcgttctcgcagcccgacctggtccgtcaggcgaccggtgcaggtgccatggcctacgtcaccaagccgtatgaggaatccaagctgctgcccgccctggaagtcgcgatgggccgtttctccgagatcaacgacctgctcgacaacgtcgagaccagcgagaacaagctcaaggagaccgaagagcagctcaagaaggccgaggagaaactcaagaaggccgaagacacgctggaggagcgcaagctcgtcgaccgcgccaagggcctgctcatggacaaggcggacttctccgagcagggagccttccgctggatccagaagacctcgatggatcagcgcatcccgaagaagcgtctggccatggcgatcatcgccaagtatggcgatcccaagccgtcggaagtaggggaatgagcgaatcgcgcgacgacgcccagacgaaaacgcgtggaacgttgctggtggtcgatggccactcgcttgcgttccgcgcgtttttcgctttaccggcggaaaatttcagtactcaggccggacaggccacgaacgcggtatggggtttcgccacgatgctgtcccaggtgctggacagcgagaagcccgaccatctcgcggtcgcgttcgacatgaagggcggcaccttccgcaacgagatgctgccgcaatacaagggcacccgcgaagcggcgccggaggacctgctcacccagctgccgctcatccagaagatgctcacggcgctgggcgtcacctacgtcgaaaagcaggggtatgagggcgacgacatcatcgccacgctcgccgcgatgggggagcggtccggatacgacacgctggtgctgtccggcgaccgcgacgccttccagctgatcgacgagtgcgtcaccgtgctgtatcccgggcatcacttcaaggacctcaagcacatgacgccgcaggcggtggaggacaagtaccatgtcggccccgcgcaatacccggatcttgcggcgttgcgcggcgagactgccgacaacatccccggcgtgcccggcgtcggcgacgggttcgcggcgaagtggatcaaccagtacggcggacttgagggtatcatcgagcacgccgacgagataggcggcaagaagggcgagtcgctgcgcgagaacatcgagcaggtcaagctcaaccgcaaggtcaacgctctgcggcgcgacgtcgacctcggtatcggcatcgaggacctgacattcggcgaggtggacgccgacgcgctttcggaactgttcaccagcctcgaattcggcccgcgcacccgcagcaaggtgctcaagtcgttcaacgccggcaagcaggccggcgacgcagctgacaagcacgcagacgacgaggacacctcctccgacgacctgaggattcccgaggccgtgaccatcgcggatgaggcggcgttggcggcatggatcgactccgcacgagacggtctcggctcgcctgccgacaattctgatgatgagccgcgcaaccgggcgcactgcgccgacgtcatggcatcgacctgcgcgctgtatgccgaaggctcatccaaacccgggaacccgggatgcagcgtgctgatgctggaggtcggcggcaaggcggccgtgctggaagccggcgtgatcgccggcgtccgtcccgcgttgcagcggttccttgacgggcacgccgaccggatagtcgtgcacgggtacaaggagcagtcgcacatcctcgcgtcgctcggactggacctcgccgagccgtggttcgatacgaaactcgccggatacctggtccagccggactatcatgccgattcgctggaacaggcggcatcccatttcctgcagctgcaattggacaatgccgatgacgtcgcgcaggggcagctggacttgagcggcgacgtcgatccggccgaccagcgcaaggatctgcttcatatggccatggttcgcgccctcgccgacatgctggccgcgaagatcgacgaacgcgagcagttcaggctgctgcagtccatcgagctgccggtgtcccacgtgctgttcggcatggagcaggtcggtgccagcgtggacttcatgcgcctgaccgagatgcgcgaccggttcgccgtcgacgctcgcgacgcgcaggagaccgcctggcagttcgccgggagccgcgtcaacctgcaaagccccaagcagttgcaggccgtgctgttcgacgacatgggcctcaagccgaccaagaaaacaaaatcgggttcgtacacgaccaatgcgtccgcgctgcaggatctcgcggtccgatccgtcggcaacgagcgcgccaacggattcctgaccgcgctgttgcgacatcgcgagacgaacaagctcaagcagatcgtccaaagcctgatcgatgcggtgaaccccgatgacgggagaatccacaccacgttcgagcagaccgtggccgccaccggacggctcagttccgtcgacccgaacctgcagaacatccccaaccgcaatgccgagggccgcgagattcgctccgcgttcgtgcccggagagggctacgagtcgctgttgagctccgactactcgcaggtcgagctgcgcatcatggccgacctgtcgggcgatgacgcgctgatcgaggcgttccgctccggagctgacttccacaagtacgtggcgagcctcgtgtacggcatccccgttgacgacatcacccccgaccagcgcacccacgtaaaggcgatgagctacgggctggcgtacggattgagcacctacggtctcgcccagcagctcaaaatcagccccggcgaggctgaccggctgaaatcgcagtatttcgcgacgttcggcaaggtccacgagtatctggaatccctggtcgccggcgcccgcgagaagggctacaccgagacgatgttcggcaggcgtcggtacttccccggactgcagtcgccgaaccgcaacatacgcgacgccgccgagcggggagcactcaacgcgcccatccagggctcggccgcggacatcatgaagatcgccatgatccacgcgtccgacgcgctcgccaaggccaaggtccgtagccgtatcatcctgcagatccatgacgaactcgtggtggagatagcccccggcgaagccgagcaggtgacgggcctggtgcgcgacgccatggagcacgcggtcgatctcgccgtgccgttggacgtgtccaccggcatcggctccgactggcagctcgccgcccactgacggcgacggcacggcggcgagaacaacgacggcaagaaaagaaaaagaggacaagccatgaccacgcttcgacaggtcgtcaacgtagtggaaaccctgtatccgctgcgctatgcggaatcctgggacgcgcccggcctgatcgtcggtgagcccggtgccgacgtcggactggtcgcattcgccgcggaccccaccatggcggtgatcgacgaggccatcgaacgcggcgccgacctgctgatatgccatcacccgctgctgttccgttccgtgcacgccgtctccggacaggacgtgcacggcgccatcgtcggcaaactgtacagccatcactgcgctctgtgggtgggtcacaccaacgccgattccgcgtggcgcggtgtagggcaggctgcggccgacgcgttcggcctggtcgatcagcggcctctggtgcccatcgacgacccggggtctgcgcacgccgtgggcctgggtcgtgtcggcctgctggaggagccgatgaccttggatcgtttcgcgcatcgcgtggcgcaggcgctgccggccacgaatcttggtgttcaggtcgccggcgacctccagtcgctcgtgcggcgcgtcgcggtgctgccgggatcaggggactcgctgttcgacgaggtgcgggccagcggagccgatgtgtatgtgaccagcgacctgcgccatcatccggcgacggacgccttggaacaggcgcggtacgaggcgtcgctgctctcgcgcggactggccgccccctcggccggaaatacgggaacggcagggagcgccgtcgcgcgtccggcgctgatcaacacgccgcactccgccatcgagtcgctgtggttccgatacgccccggacgacatcgccgcggcggtcgggcgggcgacgggggagaccatacgcaccacccatatcacgatgaacaccgatccgtggacgctgaacatcccctgccggggctagccggctgccgctgcacatcgctgacaacttctttcgaaaaaggaccattcatcatgcctgaccgttcaaccgctgacaccgctggcactgccgaaaccgcgggtaccgccgccgcaagcgacatcacccggcaggtcgacgcgctgctcgaccgctccaccgacggcatcgtcatggacagccgggatcgcagggccgtcgtgctgtcacgacagaccgtgtaccaaggggcggtgttcgacgtggaggacatgcgcatcgcgctgccggccggtggcggggactgcgtcaccgtgcgtcgccaggtgtgccgtcacgcgccatgcgtcgtcatgctcgtccatgacgaggcccgggacctgtacctgctggagcgcgagtaccgcgtaggctccgacctgttcgcctacggtctgccggcgggactgatggacgacggagaggacgtggagcaggcggcgctgcgcgagctcgccgaggagaccggcgtggtgccggtcggagaggacggcgtcatattcgaccatgtgggggcgttctactcgtcggaaggcatgagcgacgagctcgccaacatcatggtcatgcacctgcgacgctgggaaagccgaccgtgccggttcgatcccgacgaacacgtggaatctgcgtgggtgacctggcgccaactcgccggagtgccggtcaccgcgtcgaactccatcatcgccatacagcatgagacgattcagcgaattttgaaaaacaataagtattcatggtaaaacaaacatagttcgctgagaatttttctttatatcggtttgaagttaactatgttcacgttggcgtgcgataatatgaccatgcagcaaatacgacccggctccatgtacccgttgggtgcgaactacgacggttctggcgtgaatttcgccttgttctcgcaggtggcggacaaggtcgagttatgtctgttcgacgaggacgacaaagagacgcgcatcgagatgaccgagcagaactcgtacgtctggcataactatatttccggaatccaacccgggcaacgctacggttaccgcgtgtacggcccgtacgatcccgccaagggcatgcggtgcaacccgaacaagctgctgctcgacccctacgccaaagccatcgaaggcaacatcgacggcgacgaaagcctgttctcctaccgtttcgccgacccggacggcccaatgaacgacctcgactcagccgatcacaccatgaagtccgcagtcgtcaacccctattttgactggggcaacgaccagcatccgaacacgccataccatgattcggtcatctacgaagcccacgtgcgcggcatgaccaacctcaacaaggacgtgccgccacagattcgcggaacctacgccggcctcgcgcacccctcggtgatcgaatacctgaaaaagctcggcatcaccgcactggagctcatgcccatccaccagttcgtcaacgactcgttcctgcaggaaaagggactgagcaactactggggatacaacaccatcgggttcttcgcgccgcacaacgcctacgcatgctcaggccagcgcggcgagcaggtcaacgagttcaaggcgatggtcaaggcataccaccgcgctggcatcgagatcatcctcgacgtggtttacaaccacaccgccgaaggcaacgacatgggcccgaccctgagcttcaggggcatcgacaaccagtcgtactatcgtctggtagatggcgatccgcggcattacttcgacaccaccggcaccggcaactcgctgctcatgcgctctccccacgcgctgcagctcatcaccgactcgctgcgttattgggtcaccgaaatgcacgtcgacggcttccgctttgatctggccgccacgctggcgcgccagttccaggaggtcgacaagctgtccgcattcttcgacatcgtcgaacaggatccggtcatctcacgtgtcaaactcatcgccgaaccgtgggatctcggctccggcggctaccaggtgggcgggttcccgtcgagctggtccgaatggaacggccgttaccgcgactgcgtgcgcgacttctggcgctcgcagccgtccacgcttcccgagttcgccagccgtctgctcggcagctccgacctgtatcaggtcaacggccgcaggccggtcgcttcggtgaacttcatcaccgcgcacgacggcttcaccatgaacgatctggtcacgtacaacaacaagcacaacatggccaacggcgaagacaaccgcgacggcgaaagcaacaatcgttcatggaactgcggcgtggaaggccccacaaccattagcgatgtcaacaacctgcgccagcggcagctgcgcaacctgttctccacgctgctggtcagccagggcatcccgatgatctgcggcggcgacgaggtggaacgcacccagcagggcaacaacaatgcctactgccaggacaacgagatatcgtggcgcagctgggactccacgcccgagcaggaggacctgctgcagttcgtgtccaagctgatccatctgcggctggagcatcccgtgctgcacaggcgccgcttcttctccggacgtgagccgggcgaggacgtctcgacgatcccgcagatcgaatggttcgaccacaccggatcaatcatggacatggatgactggtcgaacacgcacgcgttctcgatgatggtgttcctcaacggctcgcgcatccccgagactgactggtacggttcgccgatgatcgacaacgatttcatcctgatcttcaacgcgcattacgagccgatcatgttcactctgcccagtgagcggtatggcaagaagtggcagctgctcatcgacacatacaaccccaaggggccggagctgagctatgaggcgggattcgccatcaccgcccaggcgcgcagcttcctgctgctcaagagttctgattgcccggcggtacgtcgcgaggacagctgagatctcgtggcaggtgcttcgcacctgcgcactgtgtgcgctacgctaggcaggcgccgaccggtgacttgcgtgttaccggtcgttcgacaggcgggattgcagttccgcgacctgctcgttggtgccggagccgtccgcgtctcgggctggattgccggggccggcaccggtgctgtcaccagtgccggtctgcagcatcatcagctgatcctgcagacgatcggcctcgattgcggcgatttgccttgagaagacgatgaaccatcccagaaacagcagtccggcgagcgcttcgagattggtgagcgtttcctggcccatcagcatcctgatgccgatggcagagcagatcagaatcgccaaggcggaaatcaccgacatcaccttcggtatccgcggggcgagccacggcagggagagcatcaatacgcccatgatgaccgtcagtcccttggcgcacacgttgtgcatgatcgggtgcggcgtatagcggaacgcgccgatgcctatgaacatgagcccggatatggtcagcagcagcgacaggatggcgatacgcaacgtgaaatgcgcgatgtcgcggtcatcggcggcggtgccggtgcttttgttcatctgatggcgtgctcgatgtatgcgttcggtggtgatcagctccgagatggcgaagtagctgacgatgatgatgcacgttccggcgagcatcagcgtcgagttgaacatgcgggccgcgaacgtggtgcggtcgccgagctgcgagaaattgttgtggtaccagtacgggtcgtcggtggtcaggccggcggtgcacacgccggaaatcacgaagaacggcagcagcgaggccaacgtcttcgcgttcatcatctccgcctgcacgaacgtcatataaccgacgacgcccgcgaagccggcgcagatgggggtgaggtatccgctgaacgtcgccgaccccatcatgccgttgattgcgccgagtagggcgaatgacgagaggaacacggtcgccgcgtacacgatcgacaatgcgaggatttcgaacacgcgacgaatcggggcgaaccatccgcgctgcaggttgagcaaatgggagtggctggcgtaaccgacgcagaatgacagggcggcgcaaccggccagaatgcccgcgcacaccatgaaacgtcgttgggtgatctgccagatcgccggggcgaactgcatgtacagcgacatcattatcgcgccgaccatcgcgcagatcaggaatgagatcaggccaagggtctccgctcgctgatgacgtcccatgacacccctttcgccgtccggatatccattgtactcgtgcggtttcgcggctgtgttgcgttggtggccggggggggcggtgcgggacgagattgtgacgcgacggtacggggttatgacggggcggcgtgggacgatgaccggcatgcggcgtggtgcctgttcgtgcgtgggatgtgtcgtccggatttgcgttcctaagtgcgcgccgaaacgacgaccgtgcgcacataggtacgcaaacagggccatttgcgtacctatgttcgcgcactcgtcgtttcggcgcgcacttaggaacgcaatgggaggggcctacattgcgccgattatttggaccatcggcggggtggaagatgcgggtcgagtccaatggccccggattcggttgccaaggtctacggaacccggtgataattgaaaaacgggctcagtctcggcctatggtatactcaacatttgtgctttgccttgggctgggcacatcgggctgtagcgcagtttggtagcgcgcctgctttgggagcaggatgtcgcaggttcaaatcctgtcagcccgaccggagccctactcccgcttggggagtgggagtagagcttgaaatcgtgttgacggacgttgtcgctgcagtggccttcggtgcggtggcggaggccgcctacatcgtctaaggagcatcatgcggatatcggcaccgtgatcacgctcgggtccgggttcgtggcgttgatcgtgcccgcgttcgttcgggtattcaagaagtatattccccagcggatacgtcggatccgtgttcctcgccgcatccatccggttcggcgtcatcgccatcgccgccaccggcggattcgacggtacttatatatggggcatcgtgctcgcgggcgtagtgggcgtcgctcagaccgtgtacgcactcgtcaaccaagcctttgacggaagactgtctaaagcgtagaacagtgccgggtaaggcccgaaatcctgcgcactttgtgatttgagtttcctggaagaggatatggcccgtgccgggtacgattttcagtcgctaacactagaaaaccgcgattggaaagaggcagaggccatgtccaaggaaatcatacagttcgatgacgccatgttcgagacaaagctcgacgccatggtgcgtgacaaggtagaacaaatagtcaacgcgatgcccgacgcttcaggccgacgagatcgccaacgccgcgagatacgaacgaaccggcgaacgcaaggcgtaccgtgccggccactacgaacgcagcctgaccgccaaggccggcaggccggagccgaaggtgcccaagctcaaaggtgccctgttcgagtcggcggtggtcgaacgctgccggcggcgcgagtccggcgtcggggaggcgcggaaaccgcactgcatgaagaacagccgcgcggtgatgctggcatggacggtgagccgatcgatgccggctgcgtcggcgaaccgctcgacttgtccgagcaatagcgaggccacgccctgccgggagcatgaggaatccacgaacagcatgtcgatatacccggctttgtcgacgtcaatgaatccgaccggaacgttctaggtttcggaagattcccgtatggggtcttcgagcggatatttcgcggtttcggcgacccatgtgtgcaccgttatccggcgttcgttccattgcccaggtgtgccggtatgcccggcccatgcgcgaatctgttcgctgttgtaatcccgggaggcgatgccggtcgcgggccgacggaacaccgccatcgtggcctccgcggcatcgggccgatacctgcgaatcatgaaacgcatacctgaaagtgtaagggaaatcaggcatacggcgcggagaacgatgtcgtcgcaatccctcgcagtctgtgagccaactcgtgagccaaccgaccaacacgacattcaggtcacgataattctgatgcgcccggtcgcatctcactgccacatcacattgtcgagatccgcaccgaatcttgtcgcgttggcttcaatcaaccaaccagttctggcgcaaacgcgattcaatggttctcctgcttgccgcgcaggaacacgatcgggatgatgatcagcggcgccgcgcatgcgcccatggccagtgaataaccgctggtgagccactggccggtctgcatgctgacgcccaaatccttggtgatgggcggcagagccgtggtgagcgccgtggccatgacggtggtggcgatgcacgagagcatgatgttgatgaagatcaacgtgcgacggtggttgctaagaggtgctgttcggtggtggttgttgtgacgtgtgtagtggtgtttggcatgattccgtttcgatttttggctctctgcggaggctcaagttccaactaaaggttttgcttatcgagctcttggtagtgctctttgatcacggtgaggatttcggcgaattgttcgcgctgctgagcggtgagcacttcgagcagtttaccggtggctccgttatcggccgcacgtcggcgcatcgcctcggccttgccctcctcggtgagcgcgaccagataggtgcgcccgtcttcgggatggggagtgcgcgcgacccatccgcgcgcctccattttgccgagcaattcgctcagcgatgccgaccgtataccgaggatcgcggcgagccggcgctggctgaccggcccgagaccactgacggtcagcaggcagcgcgactggccgctgccgtatatcagcgaatggtcgcgtcgtgtttcgcgttgatggctgatacgcgccgcatcatagaacagctccgccagcgctttgtcgttcattgtcgtgttcgtccgcctccatcgtttttgcaaggtacctaatgagtaatacaaggtaccttgacaaatgagttcaggttacggcgcattcgggcgaggctattcgtcctcgcctagcgcggcggatggggggtgagcacgctggtataggggatgtcgccggacaggacgccgtcgtagaagcgctgtttggcgtcgatgaagtcgatggaatcccgaatctccgcgagctgctcgaccagccgcgcccgcttgtcggcgagcatctgcttgcgctcggggatgctcggctcgccttcaaagcacagttcagtgtatcggcgcatttcttcgatgctcagaccgcaacggtgtaggcacagcagacctttgatccatgtgatgttgcggtcgtcgaagacgcggcggttgttggcatcccgtttgaggttcggcaccagaccggcgttgcagtagaacttcaacgtctcgtaggcgagaccggtcgcttcgcaggtctgcttcatcgtgtacatggtgcccctccttacgttcttttattatccggcagtgcttaccggtagtttctaccggtgtgtcgtgatttgaccggtagctactaccggaaaatatagtggcagtcataacacggctcccgttagagggaacaccaaccctgacatcaacgaaaggcaatacccatggagatcatcaccctgcgcaatggcgtcgacatgcccaagctcggctacggcgtcttccagatcgccaaggacgacaccgcgtgctgcgtcgccgacgccatcgaaaccggctaccgccacatcgacaccgcacagtcctacttcaacgaatccgaggtgggcgacggcatcaaggccagcggcatcgaccgaaaggagttgttcgtcaccaccaaggtctggctggaacactacggctacgagcagacgctcaaatcggtcgaggtctcgctcaggaagctcaagaccgactacatcgacctgctgctgctccaccagccgttctccgacgtgtacggctcatggcacgcgctcgagaagctctacaaggacggcgtggtgcgcgccatcggcgtgagcaacttcttcccgtaccgtctcgcggacctcatcgcgttcaacgagatcgcgccgatggtcaaccagatcgagaccaatccgttcaaccagcaggttgacgcgcacgcctacatggcagaacacggtgtggtgcaggaggcgtgggcgccgttcggcgaaggcaagtccggcatgttcaccaatccgacgctcgtcgccatcggcgagcggcacggcaagtcacccgcccaggtgattctgcgctggctcatgcagcgcgacatcgtcgcattgccgaagtcgacgcacaaggaacgcatggcgcagaacatcgatatcttcgacttcacgctgacggacgacgacatggcgtcgatcgccgcgctcgacacccgcaccagcctgttcttcgaccacgccacgcccgcggctgtcgaacgaatggccacgctggtcaaagagcgcgccggacgggaatgacctgccggaggcggtgcatatagctcttcgccgacggcctgaaacgtagcgacggacaggcaagcgggcatgatggaagcgatatttcgccgcatcgcggaaacgcaaacaaacaaggaggagccatggctgtcgagaacgccaaggtactgatcatcgtgaacaattggggcatcgaggaaaccgagctgacccgcccgttgcgtgacctcaaggccgcaggagccgcagtgacgctcgccgccgcgacgctcgacccgtgcgaaacagtcagccacgaccggtacgagggcgagacgctcaccccggacgcgctgctgtcagacgtcaacgccggtgattacgacctgctggtggtgcccggcggcacctgcaacgtcgaccgcatccgcgtgaacgaggacgccatcgcaatcgcgcaggaattcgcccacgaaggcaagccgatcgccgcgatctgccacggcgcatggctgctggtcaatgccggactcatcgcagggaagaccgccgccccctgccgctacattcgtgccgatatcgagaacgcgggcggccattacgtggacgagcagctgcacatcgatgacgccaacggctggcgcctcatcacttcccgcaagcccgccgacctcgactacttcgtcgacgccatcaaaaagaccctggcctgactcatccgactcgggacgggcggcggcgaagtcggatgggccatcgttccagccggcctcgccgcgcggccaggcgagcgacagcctaagccgctcaggcgatgaaacgcagatatgtgagatcgtcgaaagtcgcgcgaccctgaaaccccttggtcgaccgataccggtcaatcagatccggatcttcgctgcgaagccgctgcagctcgcgttccgattcgtcgagcgtgggccgcagcagcggatagccatcagacgcgagcaccacctcatcgccgggagagacgggcacagtgcggatggggtacgtcatgtcggtgaacccgtcgaacacgaagtagccgaacggccctcgtttgttcgcgaactgcgattgcaaccgcaggaacggcagtatcatcgcgcgcgacgggtccttcggcgccgcatcggaagccggtgcgccgaacgagccggatatcgggacgtcgggcgtgccgtcctgcatctctcgcagcgcaagcaccgtgaacgcgcgcagatcaccgagcaacacatcgacatccttggtcgtcggcgtctgcacgccattgaccatgatctggcagtccccgaacagccacgcctcatgccgccgggcgctgtataccactgcgttgacctgcagacgttccactggctcatccgcgaacacccgaattccggcctcatgcgagcggtagcgggcctggaaacattcgtcaaccgcccgctgcatctgtcgcatcgatgcatccgcaggcatgccaccgatgacgccgagcatcagatccttcgccacgacgccgccacagatgccgcacgcttttgcttgtcaccccatccacgacggccgcgaagtcatccgtgaccagcatcccgtcctcgttgagcgactggtcgttccgcttgccccggcaataccgctctatgatacgcatcatcaggcccgtgcgcattgggcgaacgcgcggtagaggatgttccgcgtcgcgtcgccgaccgacccgtccaccagtatgatgtggtggttgccgtcgtcgcgctccgtgacatcgcgttcgccggtcgatgccacggcctggcgcaaggcggccatgtccgcatcccattgcggtacgggcgtgccgaacgagcacatgtcgaacacgaatgcgcaaggggtcgggttgaaggatgacgtcgtgcgctcgctgtatcgatatgtgtacgcgctcggtgttccatacggtcggcctacgcgcatgtaatcgtcgatggcgcggttgacgcagaagtcgaattgccggaagcctgacggcaagtacacgttgtagttgttcgccgcacggtcgagtttgtctcgccattggccgtcgaacatctctcggcgactgtcctcatgagcgccggggccgagcgtgtatgatccgagtcgagacaggtattccgcctgcaccgaggcggcgagctcctgcaacgaccctgcgcccaagccgcccgccgtcgtggtgctggtgctactgtcgtccggcatcgtgcgggtcaccgtcgtcgtgccgtccttcagcgtgaccacggtggtggcgatgccggtgtccccgtcgcgcgaactggtgcgggacacgaccttgccgtcggcatcgcgccgcgacggtgaagttgcggatgccgatgcgtcgggcgccgcgccggcaccgccctgatgcgaggtggcggcccatatcgcgatggcgaccgccgcgatgatgatgacggctccgatgacgaattccatgctggttcctttaatggcgccggtggtgattgcggtgctggccgctgttgaccatcctatcgtcgccagtgggccgccgcctgaataattccgaatggaaacgcggtcccgggctgcgctaatcgccgtttgaggtgtgaaatcgggattagtgtgggcgaaattggtggtatctacatttcgaggggttgatctgatggatcaggaacatctatctgcatttcagggggttgcccaaacgcgatatccgaagtattaagcgctttttgctgctgggattgcacggttttgggagcgttcatacttggctggcaccccctcgaaacgtagatagatgtccggcgagaccgaaatcaacccctcgaaacgtagatacggttcaatgacgatgtgattccgggcttttcgcccatgaccggggggagagaagatggcgaatcgcgccggaaaggggtcgtgcccgaaccgtgatgccccgtcatgactgcaacatggtggtgccgccgtccctgacgagcagtgattgacggtcagtgagcgcgcgtaggtcgagctccgtggaataccgttcgacgatgagccgtgccgcctgacccatcgtgggattgcccagatgcggcaccacatggaaatccgtcagaccgagtcctttgtagtcgcgcagacccggggcgcgatccgtgcggtccatgatggagcagtagccgatgtccggcgacatgatgaccgaaccggctgattcgccgatatacgggatcccgtcggctatccgttcggcgagcagcgcatccgcgccggtccgccgcagttcctgcagcagaaagaacgaattgccgccgccgacatatatgcagtcggcgtccgagagggtgctccgcacgtcgggggcagcggccgttgaaacatccagttcagtgacgcggaatcccagttgacgcagttggcggcgggtcagcatcgtatgcgcgaacccccatggctctacagccgcggcggtcgtgatgtacgccagtcgaccgccgtgcagcccgggcagtgcatgcgggatcatccctgtggctccgcgcagcgtcgatgtgagcatcatggtcgccatcctggcctcctttcgtatcgcccagtataggaccgcgttcatgagagcgctgacagatgaaagatcgaatgcgcgcggtggcgtttggcgctcgcctggcccggttgccggaaatgacgacatgggcgcgaacgattccgccgatgcggacggaaaatgccataactcgaacgaagacgatacgattggacgcatgagcgaaacgaacaatgacaacctgtggccggccccgaccgctgacggcccgctgaacgcgaccgtgaccatccccggcagcaaatccctgtcgaatcggtacctgatcctcgccgtgcttggcgcgaagcccgtcacgcttgtcgggctgttgcgctcgcgcgacaccgaactgatgatgggagcgctgtcggcgcttggtgtgcgctgcgacatcgacccggaaaacgacaccacggtcacggtgacgccgccggaatccggccgattcagcggcaatgtgggcgtgtactgcgggctcgccggcacggtgatgcgtttcgtgccggggctggcgctgttcgcggacgccccggtgcggttcgatggagacgatcaggcatacgcgaggccgatgcagccggttctcgacgggctcgaacagcttggcgcccgcgtcgaataccacggcgagcacggccggctgccgttcaccatcacgccaccgcgtcatgatggtgaacaggccgatgacggttccgctgccgccaaggtgagcatcgactcgtccggctcttcacagttcatctccggtctgctgctgatcgggtcgcgcctgcccggtgggctggagttgcggcatacgggggagaagacgccgagcctgccgcatatccgcatgaccgtcgctgatgtgaacggcgcgggcggcaatgcgaccgctgatgaggagtctcgcgtctggcgagtcggccatgccgcgttgcagctgccggaacgcgtggtcgtcgaacctgacctgtcgaatgcggcgccgttcctcggtgcggctttgattgccggaggcacggtgcgcgtgccgcactggcctgttgagaccacccagcccggtggactgctgccgggatatctggaacgcatgggcgcgcgcgtctcgttccccgaagaggacggcgtgcggtattgcgaggtgagtggcgacggccatgtgcatggtcttggtgatttcgacctgaccgcggcaggggagatcgcgccgtcgctcgcggcgatactggcgtttgccgatgctccgacccgtatgctcggcatcggtcatctgcgtggtcatgagacaaaccgtctggaggcgctggtcacggagatcacgcgcatcgggggagaggcccgcgaactggaggatggcatcgagatcactcctgtgccggttgagcgtctgcacggtgaggtgatggaatcctacgctgatcaccgcatggcgacgttcgccgcgatgatcgggctggccgtgccgggcgtccgaatcgtcaatgtggagaccacgcgcaagacactgcccgatttcgtgggcatgtggaccggcatgttggagcggtgaccgcgacgaatatcacggatatacgatgaggggctgattcccagcggaatcagcccctcatttatgttcgtccgtttgcgttagacggactgcggcctgctaacggcagttcgtcacttggtgaacgtgttgccgtaagtgtccgcgccgttctcggcgatttcggcggacttgcgggcgatggccagctcctcgttcgtcgggatgacggcgatgatcacggaggagtccggggtggagatgatgcgcggctccttggagcgcttcgcgttcttctcctcgtccagcttgacgccgaacggggcgagcttgtcgcacaccatcttgcgcacgatgtcgtcattctcgccgacgccggcggtgaaggtgattacgtcgcagccgcccatctggtaggtgtagttgccgatgtagctgacgatgcggtgcacgtacacgtcgagggccagcttggcgtcctcgttgccctcggccaccagacggtgaacctcgcgcaggtcgccgaagccggtcatgcccatcatgccggagcgcttgttgaacagggtgtcgagctcgtccacgttcatgtgggcgttgcggatgaggtggaagaccacggccgggtcgatgtcgccggtgcggccgcccatcatcaggccttcaagcggggtcagacccatggaggtctcgaccggcttgccggaaacctcggcggaggcggaggctccgttgccgatgtgcagcacgatctgcttgaggccttcggccggcttgccgatgacgccggggaccacggaggagatgaactcgtgcgaggtgccgtgggcgccgtaacggcggatgtggtactggtcggcaatctccttgttcagcgcgtaggtgctggccgccttcggcagctggaagaagaaggaggaatcgaacacgaagatctgcggaacgtcgggcagcagtgcgcgcatgacttcggcgcccttggcctccgggccgttgtgcagcggggcgagcacggccaggtccttgacggcgttgatggtcttgtcggtcacgagggccggcttcgggaagagggatccgccctgaaccacacggtggccgacggcgacgatgcctgcttcggacaggtccgggccgtactccttgaagaagccgagcacgcgcttgaggccctgctcgtggtcgtggatcggctcttcgagctcgtgcttctcgccgttgtactcgtgcttgtagtgaccgtcgaccggttcgccgatcttctcgacgagaccggaggccagaccttcgccggactcaagatcgaccagctgatacttgatagagctggaaccggaattgatgacaaggacggttttcgccattgtgggcatcctccatgattgatacgtaccgcgaaacacggctttccatctgatagattactcgctgcttgctacaaatcagcgccgcaggtttcgccgagagccaccaaagagaaaagccccgctgacgggttgagccgtgaagtaaacagcggggctggttataggtgaagagcgaacgacagattgcacgtgcccccgccagcgggggctgtcgcgaagcgactgggggtggtcgtaaagagcggctgtatcgcgcggagaccgctaaaacacccgcgtcactgggcctcgatggcggtcagtgcgatggtgttgatgatgtcctgcaccgtcgccccgcgtgagaggtcgttgacgggcttgttgaggccctgcagcacggggccgatggcgagcgccccggaggaacgctgcacggccttgtagccgatgttgccggagcacaggtcggggaacacgaacacgttgacgtgtccggccacgtcgttgcccttggccttggtggctgccacgtcgggcgaccatgcggcgtcgaactggatggagccgacgacgggcaggtccggagccttctccttgacgattcgcgtggcctcttcgacgatgtccacgtccggccccttgccggagccgagggtggagtaggagagcataccgaccttgggctcgatgccgaacgccttggcggtcacggcggactgcagcgcgatctccgcgagctgttcggcgtccgggttgaggttgatggcgcagtcggagaacacggtcacgtggtccttgaagcacatcaggaaggcgccggagacgagcctctgcccgggcttggtcttgatgacctgcagcgccggacgcacggtgtttgcggtggagttgaccgcgccggacaccagaccatcggcgtaaccgagcacgacgagcatcgtgccgaaatagctcgcgtcggtcagctgcttgcgggcctgctcttcggtcatgcccttcttggcgcgcagctcgcacagcttggcgaccatgggcttgaggatgttctcgtcgtccatggcctggaagcgcgctttgcccagatgggtcagaccgagttccgcgccccgggcgaggatcgcgcccttgtcgcccacgatgatgaggttcgcgatctcgcgctccagcaggtagtcggccgccttgatgatgcggtcctcttcgccttcgggcagcacgatcgttttcttgttcgccttggcgcggccgagcaggctgtactggaaggcgtacgaggtgatcgggaagtcgatctcgacgttgatggcccgcaggacctcttcggtcggcacgttcgcctggaaggcggcgagcgccgcatcggcctgcgacgcctcggtgaacgggatctgggggatcgtccacaccggcagcccgaagtccgcgagcgtgtccttgaccgagacggagtggcgcggctcgcagcccgtcacgaagatgcccagcaccttgttgccggcggcctccatgccttcgatggagagacggacggtgtccttgagctcgtcaggccaacggtcgatggtgcacacggcgaggaagacgccggcctgcaggtcggcggcgatgttcgcgttgaactcgtaggcggttgggtcgttgacgtgcgacttgtcggtgccgacgatgagcgccgcgtccgcgcgggacacgttcatcgcgtcgttgaacgccgcgacgatgtcgccgcgggagccttccttgtctttgcgcacctggtgaatgtccagtccggtggacagcgcgacgccgaggccggcgttggaggcgttcagcaggatgggggtgaagtggtcgtgattggagaccgcggggcggaacacggtggtcttgaatttggtggtcagcgccttgagcacgccgtatgccacgacgttgcgtccgtttgcgccttcaggacttgcgatgtagatgttcgttgttgtcacgtttgtctcctcgtcggggatggtactgctcgtgtgaccgccttgtttcacacttactgacattgtagtacccgatcgttcgctgccgggcgttgacatggcggtaaatgcggccgggacggttcgaccgggcgcgtggtgacgatgtagtcgttgcgcccgtatccgtcgtcggagacgatgtgctcgatgtcgtggggtagcctgcgatggggtagtgcaggtagcaggtgatgccgagctggtcgaggcgccggcgataggcgtccgcgtccggctgccccgcgtgctgggtgagcacgacggagcagccgtggaatccgcgcgagcggaagatgtcgatgagtcgcagcacgtcctcgtcgtacgtgatgccgaggtcgccgcgcatcttggccttctcgatgtggttggcgttgatggcgatgacgatctccacgtcgtcggcgaggcttttgagcatgcggaatttggaatccggctcgaagccgggcagcacgcgtgacgcgtgatagtcatcgaacagcttgccgccgaactccagatagagcttgccgccgaactgcgcgatgcgctttcgaatgttggcggcctgcagctcgatatatttcttgttgtcgaatccctgtcgcatgtgcagtgagagtcccgtccgaacggagcgctgtacctgcagattataccgggttctttacgaggaccaccccctcccagtcgcgaagcggctggtgtcttacaagaatctacgagtgaaattcggcgatgtgtgcggtagcatggcgcgggaagcgaaagcgtacaagggtacgtcgagcttcccgtaacgcagctaacgcacacatcgtcgaagtccaccggtgaattggaataacgtgtgtggcctctaggcgcaccgaaggaagctgtacaaaggtaccgcgactgaggagcaacgacgaggacactccgttattccaaattcgctcccattcgccctctgaaaccgtgacctaaacgattttgtatagaccgtttagctccgattatcaggattacttagattatccaagaattacggtgtatcataattcctgttgtcattttgttgtcacgctgacaaggatattatacttaattacaccacataaatcaagtggttattgccattctgtatctgtcattgttaattcgccctcagcggtcattctgccaatcgtagcgagtgacaaactttcatcttgggtgagtgaatgcttttcggtaattttcgcttgcgtatcataatacaaacagaaacgatgagaaataacatacacaaaatcaaataagtttgcagactcgtcaagcagttcggtaatccactcagataagtgattttctgcataagaggttggaatttcgggcaaaagtatggcaagtcccatcctcttaaaatttgatcggtactgctgaatttttttcgtctttcttcgtatgctttcttgaaaaaagcgtttctctccgtcggtagttccggaggtagatatcgcaaccttttcatctttaagagggacaaagaaatatccgcttgatttgatgatatttttgcgtttttctatatccttaggtttaccctgatttaattcggaaaaggcgcgagatactttcatatcatcttcttttacagcggcggtaacctcaattcccgtactatttgcactgtcttgaagatcgggagcttcgcctgtaatcattgtatcaaactttgaaggatacaagtaacgcaaagtggcaagcaccctatattcctgagaatgtttaagagtgtttggtttaaccgcagaggaatattttttacctttaactaagtctgtatttatcttcataattattcaaccggaggaataggtggcataacaacaaacattgattttaattcatcaatagtgcctgccttaccccactcagacattccatttttccataccaaactatcagcattgaactgacctgaagtagccatttgttgcaatacatttaaatcaaaaaggtccggttgcttgcccgttcaccgcaatgtgatatgcaacaacaggaacgggtggaggtgttgctccgctcggtgtggtttgattaataccagccattgttcataattccggcaatattatgactgacagcaccgccgagagccattcccgccatcatagcggcaggattaagccctgcgctgccgtttcctaaatcaactccacctgcaccgttttcacccatatgtcccagggcctcagcaccggcaataccgacttcagcctgtttttcaacccgaaacgcaccaatattggcagattgagtttgcttatgcatagcatattgtccctcttcacgctgaatacgtaatcttcctacatagtcagcggtttcggccttaactttagttgtgcatttatgtaattctccgtcataaacggtttttctttgttcttttgcaccattttgcgatgcatctaccgcattaccacaactggcgcagaattttgctccctccgcaagttcttgcccgcagttaatgcaaaaagccatattgcacacctccacagaataatttcaaaacgcaaaaactgtcattttttcaaatgagggcattctagacaagcggatttgttttcatcccataagctacatttcttcctgatcctaccacagaatctcagcgatgcgctggtagaggcgttcaaggaccggctgaagaacgactaaatccgagaaaacaaaaagagctatctgacttttctaacagaaatcagatagctctttattcttgaataatctaaaatgttgtcattttgttgtcacggggcaattccgtaacccaaaagtccagccttttcaaggctttttggcctttcgggcattattcccactcgatcgttgccggcggcttggacgtgcagtcgaggacgacgcggttgatctggcggcactcgttggtgatgcgggtggagatggtggcgagcacgtcgtagggcacgcgcgaccagtcggcggtcatggcgtcctccgagctgaccgggcgcaggacgatgggggagccgtaggtgcgctcgtcgccttggacgcccaccgagtgaacgtcggcgagtagcacgaccgggcactgccagatgtcgcggtcgaggccggcgcgggagagctcttcgcgggcgatggcgtcggcctcgcgcagcaggtcgaggcgttccctggtgatttcgccgatgatgcggatgcccaggcccggaccggggaagggctggcgccagacgatctcgtcaggcaggccgagctcggtgccgatggcgcgcacctcgtccttgaagagggtgcgcagcggttcgatgagctggaacttgatgtccttggggagcccgccgacgttgtggtgggacttgatgttggccgcgccgtcgccgccgccggattcgacgacgtcggggtagagggtgccctgcacgaggaacttgacttccttgccgcgggcgccggcttcttcgaggacctgacgctgggctttctcgaaggtgcggatgaacttctcgccgatgatcttgcgcttgcgctcgggctcggagacgcccttgagcgcttcgaggaagtcgtcggcggcgtcgacggtgatcagtcggatgccggtggcggcgacgaagtcgtgcttgacctgctcgacctcgcctttgcgcagcaggccgtggtcgacgaacacgcaggtgagctggtcgccgatggccttgtggacgagggcggcggcgactgcggagtcgacaccgccggacaggccgcagatcacttcggcgtcgccgaccttctcgcggatcttggcgacctggtcctcgatgatggaggaggcgtcccagttgtcgggcaggccggcgcactggtggaggaacgtctcgatgagcttctggccgaagggggtgtgcttgacctcggggtgccactgcacgccgtagagcttgcgggactcgtcttgcatggcggcgacgggcgcgccctcggtgtgggcgagcacttcgaagccggcgggcgcggtcttgacggcgacgccgtggctcatccacgtgtcctgctcggccggggagccggcgagcagcccgtccgtcttgtcgatggtcgtgtcggtcttgccgtattcgccgagcgcggccttgtcgacgtcggcgccgagcgcgtacgccatggcctggaagccgtagcagatgccgagcacgggcacgccggcgtcgaacagcttggggtcgacgcgcggggcgccgggctcgaatacggatgcggggccgccggacaggatgatggcctgcgggtccttggcgagcatctcgtctaccggcatggaatgggggacaagctccgaatacacgttcgcctcgcgtacgcgacgggcgatgagctgcgcgtattgggcgccgaaatcgacgacaagcaccgggccgttagccatgggactcccttcatgcggccgcgcgcgatagcggatacatagatatgggcgatatcgttgattgcggccattggtattgtgtggacttcttacagtatgtcacatcaattgtggcgattcgagccgacattggcgtgtgcgatgggcgggtgtcgtccgggagcgacgcaccgattcacaaaaccgaacaattaacgctgttaatatgaacaacacgccgcatgttctgttgcctgcatgaacacgcggcgtaccggtagatcgctgaaatcgttggaaaataaaagtttctcactggatggcgccgtaatataacctgtgagggcgccggttattcactcataattcatacaattaatctaacattttcgaacacacatgcaaaaaagctgccaaaagtcttgctctcaacgtaccatgatgaacgattgggattgggcaaccgcgaaatcgcaaggcttcgcgagagtccatgaccgaacgataatgatcaattgcacatcactgtgcaggagtacaggagtacacatgacgagtcctgttattggcaccccttggaagaagctgaacgctccggtttccgaggaagctcttgaaggcgtggacaagtactggcgcgttgccaactacctttccatcggccagatctatctgcggagcaacccgctgatgaaggaacccttcacccgtgaagacgtgaagcaccgtctggtggggcactggggcaccacccctggcctgaacttcctcatcggccacatcaaccgcttcatcgctgaccacggccagaacaccgtgttcatcatgggcccgggccacggtggccccgccggtacctcccagtcctacctggacggcacctacaccgagacgtaccccaacattaccaaggatgaggctggcctgcagaagttcttccgccagttctcctacccgggcggcatcccctcccacttcgctccggaaaccccgggctccatccacgagggtggcgagctgggttacgccctgtcccacgcctatggcgcgatcatggacaacccgagcctgttcgttccctgcatcgtcggcgatggtgaggccgagaccggcccgctggccaccggctggcagtccaacaagctcgtgaacccgcgcaccgacggtatcgtgctgccgatcctgcaccttaacggctacaagatcgccaacccgaccatcctgtcgcgcatctccgacgaagagctccacgagttcttccacggcatgggctacgagccctacgagttcgtcgccggcttcgacgatgaggaccacatgtccatccaccgtcgcttcgccgagctgttcgagtccgtgtgggacgagatctgcgacatcaaggccgcggcgaacacggacaacatgcaccgtccgttctacccgatgatcatcttccgcaccccgaagggctggacctgcccgaagtacatcgacggcaagaagaccgagggctcctggcgcgctcaccaggtgccgctggcttccgcccgcgacaccgaggcccacttcgaggtcctcaagaactggctggagtcctacaagccggaagagctgttcgacgccaacggcgccgtcaaggacgacgtcctggccttcatgccgaagggcgagctgcgcatcggcgccaacccgaacgccaacggtggcgtgatccgcaaggatctcgtgctgccggcgctcgaggactacgaggtcaaggaagtcaaggagttcggacacggctggggccagctcgaggccacccgtcgtctgggcgtctacacccgcgacatcatcaagaacaacatgcacgacttccgcatcttcggaccggatgagaccgcttccaaccgtctgcaggcttcctacgaggtcaccaacaagcagtgggacgccggctacatctccgacgaggttgacgagcacatgcacgtctccggccaggtcgtcgagcagctgtccgagcaccagatggaaggcttcctcgaggcctacctgctgaccggccgtcacggcatctggagctcctacgagtcctttgtgcacgtgatcgactccatgctgaaccagcacgccaagtggcttgaggctaccgtccgcgagattccgtggcgcaagccgatcgcctccatgaacctgctggtctcctcgcacgtgtggcgtcaggatcacaacggtttctcgcaccaggacccgggtgtcacctccgtcctgctgaacaagtgcttccacaacgatcacgtcatcggcatctacttcgcgaccgacgcgaacatgctgctggccatcgccgagaagtgctacaagtccaccaacaagatcaacgccatcatcgccggcaagcagccggccgccacctggctgaccctggacgaggctcgtgccgagctcgccaagggtgccgccgcttgggattgggcttccaccgcgaagaccaacgatgaggctcaggtcgtgctcgccgccgccggcgacgtcccgacccaggagatcatggccgcttccgacaagttgaaggccctgggcatcaagttcaaggtcgtcaacgtggctgatctgctctccctgcagtccgccaaggagaacgacgaagcgctgaccgacgaggagttcgccgacatcttcaccgccgacaagccggtgctgttcgcgtaccactcctacgcccacgacgtgcgtggcctgatctacgatcgcccgaaccacgacaacttcaacgtccacggctacgaggaggagggctccaccaccaccccgtacgacatggttcgcgtgaacgagctggatcgctacgagctgaccgccgaagccctgcgcatgatcgacgccgacaagtacgccgacgagatccagaagctggaggacttccgtcaggaagcgttccagttcgcggtcgacaagggctacgaccacccggactacaccgactgggtgtactcgggcgtcaagaccgacaagaagggcgccgtcaccgccaccgccgccaccgctggcgacaacgagtgatgatcgcctgattcttatcaggatctgagctgaaagggcttccggagcaatccggaagcccttttttcgtcaggctccaccaagcgacaatatcgctcgtgagaatggtcatcgcctacaaaccgacaagtcgtcatgacacgacgggtaaatccacactacgtagtcatctccatatataatcaagacgtccgctgaatgcgacccaccgcatgacggtccctcgaagaagaaggtgatgactctcttggatgtatcattctcatatttcatccaacaggtatgttcgaatccggcgctggccatcaccacgttgctgacgctcggcgtcattttcgtgaacggctggaccgacgcccccaacgccatcgccacctgcgtcaccaccagatgcctacgtatccgtccggcggtgatcatggccgcggtgctcaatttcttcggtgtgttcatcatgacgcagctgaacgcctcggtggcgtccaccatcagcaacatggtcgatttcggcggcgacacgaacgccgcgctgatcgcgttgtgcgcggcgctgttctccatcgttgtctacagtgtgggcgcgtcgctgctgggcatccccacgtccgagagccacagcctaatcgccggcctttccggcgccgccatcgccatccaggatggcatcggcggcatcaacatgggggagtgggtcaaagtgctgtatggtctcgcggccagcctcctgctcggatttggcatcggctggatcgtgtgcaagctggtgacgctgatctgcgcggggcttgaccgcaggcgcgccaacgtattcttcacgtatgcgcagatcgtcggggccgcggccatgagtttcatgcacggcgcgcaggatggccagaaattcatcggcgtcctgttcctcggcatggcgttctgcagtgggcagaccggtgtcgcaggcgtgatcatcccagtgtggctgatgatcctgtgcagcacgatcatgggtgtcggcaccagcgtgggaggggagcgcatcatcaaatccgtcgggcaggacatggtccggctggagaaataccaaggcttttccgcggacctgtccagtgcgctgtgcctgctggtgatgaccgtgctcggcatccccgtttccaccacgcacaccaagaccagcgccatcatgggcgtcggagcggtgcgcaggctgtccgcgattaacttcggcgtcgtgcgcgacatgatgctcacctgggtgttcacgttccccggctgcggcatcatcagctacgtcatggcaaaactgttcatgctggtgttctgacaccgctccggcacacggcatcagtcatcgtttcaagaaaggatcagcatatggcgaggaaaaacgattcgttctatttcgacggattcaagcagagcgccgattatgcatgccaggcggcacatctgctgtcggaagtcatgcaccattacgaaccggatcgtctgctggaacgattcgacgagatgcatcgcatcgaacaggcggcggacgaggtccgtcacggcatgatggacgagctggtcaccgcattcatcactccgttcgaccgggacgacatcgcgcggctgagcagcgtgctcgatgacgtcaccgaccgcatcgaaggcgccctgcaccgcatgtattacgacaacgtgctggagatccgacccgatgcgctggacttggtcgacatggtcgagcgctcatgcgggaagatggcggagctgatcggcgagctgccccggttcaagcggtcgaagaccctgcgcgagcaggtgttcttcatcaacaagatcgagcaggacgcggaccgcctgttcgtagaggcgatgcgccgcctgcacaccacctgcaccgacccgctgcaggtgctcgcctggcacgaggtgtacgtgcatctggagctgtgcaccgacgattgcgagcatgtcgccgatgtcgtcgacaacatcgtcatggagaacagctgagagcggttcccccgtcccgtcccggccacggcgttggacgggaatgccgcctaacggtgggtgttgagccacgcgatggcgagctgggtgcggttggtcagagcaagcttgtcgagcatcgcgctgatgcggttgcgcacggtgccctcgctcagatacagtctggcggcgatgtcgcggttgtcgagtccctcggcgacgagcgccgcgatgtcacgctcccgttcgttcagcagctgatcgatgccatcagacgtacgacggccgtgcgggatgccgtcgccggccgtgtccgaggcgtcgtccggccccttgcatccggcaccggccgtcggcccggtgagtttgccgatcacgtcggcgccgagcaccacctgaccggccatcaccgcatgcagggcgggtgcgatcgccgccacatcctgcttgatgagatagccttttgtcccgagccgcatcgcctgctcgatataggcctggtcagagaacgtggtcaggaacaggatacgtgccgccggatccttcgtcaggatctcccgcgcggcgtccagcccgttcatgccgggcatctgtatgtcgatgagcaggatatccggatgattctccggcgactcgaaatacctgcgaatcgccgcgccgccgtcgttggcgctccatagcacgtcggcggtgtcggtggcggtcaggatcgtctccagcgactgacagacgatcgggtcgtcgtccacgatcgcgattctcatagcttccccctgttccctaatgtgccggcagtcgtcttcatgaatgccggctggtctgttttcgcgcaagattccggggatgcatgccaacgttgcttcggcacggacacgaacacgcgccatccgccatcatacgggccgcacagggcggttccgccgattgagcgcacgcgcgattcgatgtcggtgagtcccatgccgcgaggcggctccccgtccgtccggcaccgcccgcgggcatcacgggcgcggatcgcgggccctggatcctggacgaccaactgccacaatgtcggaaaatcacgcagcgtcacgctcgcctcatgggcctcgctatgatgcgcgacgtttgccagcgcctcgcgaatcaccgtcgcgaagcagcgtgacaccggggccggggccgtgtcgacgtcgttcgccaacgacaccgagaagtccggggagataccgtcgaatgaggcgacggcggcttcgatctgcgcggcgaaatcggtgccatcatcctcaaggtcatgtaccgagcggcgcaccatcgtcatcgcatcgtccaaggtctcgcccagcgtggtgaatccacgggccgcgacctcgtcatcggtcgcctcggccacggccctgccggcctgcgcctgcatgatcgcacgagtcagcaggtgccccacattgtcgtggatctcgcgggcgatacgcgtgcgttcgccgagcgtcgccatgcggaccgactgcgcgcgctcctcatcgatatcggcgatgcgcgagcggacggaacgggaggcttcacgggccatatcctgagcgtgcaacagcgcacgtcgattcccatccgaagcctcgcgggaccgtcccgcgacgaatccgagcaacgcggtcaacgtaagagccagcgcctgcatatggctgttggcatctgcggcttcggccgcgacaccggcatgtgacacgcggacgaaccacagcgccgcaaacggcaacacccatagccagcgcacggccgttaccagccgcgaagggcgccctgcggcagccagacgcgccatatcgtaggcgacaagcggcatgaacgagcaccatgcgggcactgccgcggcgacgatcagatacgccacgcaaggcaaccacggccatcgttcatcggcatgcagccattcgaccagtccggtgacggagacggccagcagaagccccgcgatgaacacggcatcggtgcggatcccggtcatcacggcgagcacggtgcccaacgcgagcagaacaccctcctcggccaacacgcgcatggcacctcccggatcgtcattcgtttcaataccagtctagcggtggaaggaactccacgaacatgccgatcgtggcggataatccgcgtggcggctccctgacgatgggtctgttctccaaccgaaccatcaacatcggcatcgtgaccgagatcgtgctgctcgtgctcatcaccgaagtgccggtattgcagaccgtgttccacaccgcgcccctgggctgggacgactgcgtatacctgtgctgcatcccgttcgtgatcctcggcatcgaggaactgcgcaaactcatctggcggcattctttcccaaccgagcgggtatagcgtgctccgccccccccgctggcgggggcaagtggcgccgcgagatgatgacaaatgtcacgggtgcgcggccaagtcgtgacgtttgcaggtggcgatcgccgacactctcttgggatgatgtaatcatcaaagaaaggagcggctatggcaaccgacaacacagcccccggacgcgatgtggcacccggcgcagtgccggccgtgcatgtcagtcaactggtcaaacgctacggtgacatggtggcgctcgactatttcgacctcgacgtgacgcaaggcgagatcttcggcctgctcgggccgaacggctccggcaagaccacggcgatcaactgcatcctcgcgctgctcacctacgattcgggcacgatccgcgtactcggccagccgatgacgccgacctcatacgcgctgaaacggcgcatcggcatcgtgccgcagaatgtggccgtgttcaacgaactgaccgtcaccgaaaacatcgactacttctgctcgctgtacgtgccgaagaaaactgaccgcgcgccgctggtcgaggagtccatcgaattcgtcggactccaggacttccgcaagttccggcccggcaaactgtccggcggtctgctgcgacgcctgaacatcgcctgcggcatcgcgcacaagcctgacctgatcttcttcgacgaacccacggtcgctgtcgacccgcaaagccgcaattcgattctggaaggcatccagcggctcaaccaggccggcgccacggtgatctacaccagccactacatggaggaggtcgagcagatctgcgaccgcatcctcatcatggatcacggccgtcatctggcgctcggcaccgccgacgagctcaagaacatgatcgacacgggcgagcgcatcaccatcgaaacgctcgatctggcggattcggcgatggccgaggtccgtgcgctgccgtgcgtgatcgaagccacctacgacggcaaggaactcgacgtgcgatgccggcgcggcgaacacaacctgaccgacgtgctcgacgcggtgaaacgctccggcgccaacatcggccacctgaccagtcgtccgcccaccctcaacgacgtgttcctcgaactcaccggcaaggcactgagggactgaccatcttgcccctgctggcggggctcccgcgaagcgagtgggggtggccttgcaacaaccaccctcagtcggcttcgccgacagctcccgccagcgggagcaggtaaggagacatcatgtggaccacatttttggtcgcattgaaagcgaacctgcgcaatcgtcaggcactgttctggatgattgtgtttccgatcgtgctggcaaccatgttcaacgggttcttcggcggactgtccgagggatacgagctcaaaccgataccaatggccgtcgtcgaagatagccgctggcagcaggcggacggagcgcgtacgtttgtggatgccttgtctggagagacggcctcatcgtcggagtctttggacggcacggcatacgccgatatcaatcagcaattgctgaccatcaccgcagccgacaccgtgcggaaagccgaacagctgctcgccgatggcacagtccgcggctacctggctgctgacggcaacgggcgtttggcgataaccatcagtcgggaaacggtgaccgcggccaatgacaccacaggaagcgtcggactggatatcagcctatcggcattgcgcagcgccatcgacctgtacaaccgcaccgacgccgtcacccgacaaaccatcgccgacaatccacaggctgcgctcagccgcaacttctggaatagcatcgggcaaagcgtcgatgtgactcacgaaacaacgctcacgcatttccagcccaatgccatcgccagatactattacgcgttgctggccatgtcctgcatgattgccatggggtactcaatcagcacggtctccacagcacaagccaacctgtccgcattgggcattcgccgcaccgtggcgccattgagccatgccagacagcttattgccggtttccttgcctgctggttgtgcgcatcggtcgcattgcttatcgcattggcctatattcgcttcatctgcgacatttcgtttggagggcgagaaccggtgacggtggtcgcggtaatcatcgccgcattcatgaccagttcagccggtactttgctcggcgcggtaccgaagctttcctacgacacgaaatacggtttgtcgagcggaatcgcctgcacattgtcgctgttcaccggactgtacggcggcttcgccatgcagatcagtgactggatagcacgcaacgcgcccatcctcggcaccatcaaccccgcgcaacaggtgacgaacctgttttacgacattttgtactacgacagctaccagccgttcatcaccacttgtgccattttgctggcgatgagcgcggtattcctcttggccggcatcgcaatgctgaggaggcaacgctatgaacacctgtaaagccacattgcgtgtactgttctcgcacagggcctacctgttgatttacctcgtgttcgtgggcatcatgatgctgtctatcagctggtcgatgctgtctggcacatccgattccgcagccgcggcattcgagccggccaaaatgcgtgtcgccgtcatcgatcgagactcggacaggggcggcatcgcgtcatcgatgcgcacatacctgtcggattccagcgaactggtgaacgttgacgatgctagtgaaactctgcaacaagccgtcgcctcgaactgggtggatctgatcgtcatcatccccgatggtttcgccgacgatttcattgatgccgcggcgacaggcgagaatccaccaagagtggacacggtcaccagctatacgtccggcgcaggctcgatggcccggatgaacgtcagcgggttcctttcactcacgcgtacggcactgattggctcgcatacgacggtcgatagtgcggcgctcgcagctatggccggtatcgacattggagacactgcgggtgattcgtctgaagatggcatgggcgggtttggtgaattctcgaatcaggacatgcttgatatgctgccggccggtcagattgagaaacccagcgtcggcgatctgttcgaggcatcgaaagcggctgccgcatcggcgagtgacatggacgcgaaccataaggtcgctgtgatcgacacggcaagcgcggacgcggaaagtgcttcggacatggcggccagcagatttggcaacaccatgaaaaccgcgctgtatccgctgtttttggcgatgaccgtctgcgggtcaatgattctgggcatattcaccaccggggaagttcgccgtcgtctcaccgcatccccacaacgcatgtcgtcgatgggactccagcggttgctgacgttgggcggattcgcgctcgtcgtatgcgtcggttatctggtgctggcggtcggtctgatggtcgcggcaggacttgatccgttgacattgagcgccgaaggagtgctgatgacgttctgcgcaacctgcgtatatgcgctgatgaccgtcgcctgtggattcatgctcagcgaattcgggttttcggaggcggctgccaacggattcgccaatatcttcggcctgctcatcatgttcacgtcgggcgtcgcattgccggttgacatgatgcccggcgtgatggtgaccatagccaagttcctgcccggctggtggtattgcaccgcgatcgacaacgcgctcggctccggcacggcggaggaaaccggcataagcgtcgccggctgggccggctcgctgggattggtcgcactgttcggcgtgatgttcatctgcatcggcctggccgccggccgcttccgccgatcccgtcccaccctggccgcgcccgccaccacgcagctggccgagtgagaaaatcagcctttcaaccgataccgctgtaccgagtcgtcggcgaacttgactcgggcgacccgcccttccttcatcagctcgcgcataccggatgtggcggccagcggcgtcaactgcagttcgcgcatgatctccttgacgctcatcgccgaatgccgctccagtacggtcataatcgccttgaccacgtcgcccggcgaactgttcgccatcgtgcgttgcttggtgatggtcatcgtgaacgtgttgatgtcgttgcgcgtggtcgccggctcgatgccggcctctcgcaacgcggcggcgatgcgctggtagccgtcgccgccttctgggttcacaaacccgccgcccggatacggcgtggactccagcagcgtgaacaggaactggtttcgggtggagacgaacggcgcgcccgtcaccggatgcggactcgccagcacatcatgtgtcaccatgccgtacaggccacccggattggtgatctcgatgcgatcggtgaacacgctgatatgcacctgcgtgccgcgcgcatcgggcgaataatcacggtgggtgagcgcgttcgcaatcgcctcgcgcaacacgagtggcggataatcgggcttcttcgcgccaatccaacgcatcaacgagtcgaccgcatcgtcgatcatcaccggaatcgaaccgaccaccgacttcgaggcgaccaatcgttcgtcgccccggaacacatcgtcccggctcgtccccggaaacacggctatcgaaatgccgagccgcggatagaacttctgcggatagcggcccaacgccagcagtccggccaaggtgggacgcagtattccgccgacctccgactcgtcggaatcatcatggcgcaacacctgcagatccagcagcacatcgatgccgtcccggtcggcgaacacgcgcggatgctgttcgcgcacgcgtgccaacaatccggcaacaagctgcgggtcgaggtcatcggtcgtggcgccgggcacgatatccagatcgtatgtgggctgcagatgctcctcgatgagccggtcgacctcataggaggtcatgcgccggtcgccgtcgccggtgcggatgaacgagccgccgtgcggtccgagcgcggtggtgaagcagggcttgtcgcgcggcagcatttcgtcgatgcgcgcgaacaccagattcgcgccttcgaacgggcaggtgacgatcacgggccgcaccaccggcgtcatcttctcgcacgcctggctcagcgcctcctgcatggcgcgcgcgtcgaatccctcgaccggcgtgaacccgttcttttcggacaggccaaggatgatccagccgccggagccgttggagaacgcggacagcgtatcggtgatggtcgaggagatcttgcgcttgcattccttgacctcgcactgctgcgtatcgttgccgatcatgcgcatcagctcgatcagctcggtcatcttcgcggtgtagtcgtcaaccatggcggtcctccttgacaccattgtcccgcggccggctgtctgccgaagcctcccgcgcccacgtcctccgtcaattcattgaaaattcacgcggttggggtgcgcataagactgttgttttcattggtgcagtacgaggtcccgttgtctatttgtaagtgcaacgccttcgtcagagttgtaagtctggcagctcgtcggcaaacgcctcggcgggtgtgcggtagccgagcgctcgcatgggccggttgtcggtctcgtcgacgatctcctggagctccctcgccatgcccggttcgatgatcgtgcgtttgggcaggtaacggcggatcatgccgttgcggttctcgttgccgccccgctgccagctggaataggggtcggcgaagcacgtggccatgcccggctcgtcgcgcagccgcgcgtggcgggcgaacccggtgccgttgccgtgcgtgacgctgagcctggcggccgccggcagcggggcgaacatcgccagccgcgccccgacgctccgctcggcggtcttgtcggggataacacgggccatgaggaagcgggtcctcctttcgacctcggtgtgcaggtcgcatcccatgccgatgacgctgtcggcctcccaatggccgaacccgctgcgagcgtccgcctccggcggacgaccggcgatggagacccttccggggataagggaacctcgacacccgacggcccgcatgcttgcgccgccgccggtggccgcgcggcaggcatcgggcccggcgttcgcggcgcggcttgctggaatagatccatcggtagacggtctccgggcacacgcgcatggcatcgtcgccggggaacaggacgcgcagcctgccgctgacgggcggcggcgaccagccgcagcccagcttctccgccacccacgcccacagccggtcatgcgacaggcgatgcggcttgcgcgctttggcgcacctccgggcggccttgcgccgggccggcccggcgatgtaataacggctcatccaaggcccggtcttgagccgcctgggccgatagggacggcaggattcgctctcgtcggacgggaaccacgtgttgcgtttgatctcacggctgacggtggacgggctgcgcccgatcatcgcgccgatcgcccgtatgccggtcccgttgccgatctcgatctggatgacctggcgttcctcttccgacaggtgcgaatacacttcccccataggtgcaacatcccttccggactggttttctagacaatctccaatctaacggggtgttgcactttcaattagacaacggggcgtttgtcaagcaaccggtagggggagatacaattatcttgtagcgttgatcgattccaaggagggaattatgagctatatgaaaaagattgcttcaacgctcgcggcggcagtcgcgtccgttgcttttgcccttgttcccagcgttgcactggccaacggcaccgatagcgttccctatgaggcgaacgccaccgttgtcgttgcccccaacgctcctgaagggtcagagttgatctttgaccttgagacgaagacgttcactgacattgttctcccgaacggacgcacgcttaagccaagccgtggttgcaccaacaatacttccgcttgctgggcaggcggcggagcgctcggcgacatggagtttacgggtactggcgcggttaatggcaattggcccagccggagcagcttctactccaataacaagtcagcggacatcggtttcacctggaaaggagaacgggtgtacgtaagccagattgctgcaaaccgcaaattcacgccaaacggttctgtcgacggcttctacgtcacccgttactaaaacctatgggagagcacatcctttccctacaacacctttagacggagggccggtgtcttcgggcaccggccctccgcgttcctagcggctgtgccggtgatgtggctgcggaatcggttcgtgtgttgtctttgctttttcgatgttctcagccagtctttgtttgattcgttcgttgaagcggctgcggttgagtctgcgcacgcgatcctcgtagggtttacgcatgtggtcgagcgtggccttggatgcgttggtgcggaaggcgttggcctcggcgtaggtagccgggatggtcgtgttctcaagccacggcgccgtttgcttcagaagctgggattgctcggcggcggtcctctcggccgcgtgtcggagccatccgcgcgtgaacgggttcgcgtgctcggccttttcgctggcctcgcgcgccacgtcgatgatccgttgcacgtccctgacttcccgtggaggctcggtcttccaccattcggtgaggtcggcgagctcacgcctggcctcgtccagttcgtccaccggttccggctcgggacgccgcggttcgcgtccgatctcccgcggcacgggatcaggcttggattccaagctcctgccggacgtgctcctgggggggcgtgggcgcttcgaccagttgccggccacgcgacgctatgggctggcgatcgaacacagtgattcccggaaccggctcatcgccgtgtcgagttccttcctggcctgctccttgaattgtccgagcaggccggtcgggtcgcccatctgtttgcggatggccgtcaggtaccggttggccgtggcgatgcgccggttgatcgcattgaggatgctgtgcccacctcgtttggtgatctcgcggctggcgtggccctcgtggatggtggggatacgttcgatgccctgcgcctcaaggctgcggtggtcgatgcgcacgccctcgggcagcatgaggttgcactgtttggcccagtcggcgcgcagccgttcgaggaattccgtggagtccaaggggttgttcgacacgtccacgcgcttccagaccttacggttcttggccccggtcttctgctcgccggtggcggggtctatgaccggtatccgctcgccgttctggtgatatgaactgatttttgttccgcatttcctctaactcgatgggggatgatggaaccatggcaaagggcactcgatatacgccggagttcaaggcgaaggcggtcaggctgctggcggaatcgcgttcctcgtattcgtcggagacgaacgcgatctccgcggtggcgaaggatctggggatagcgccggaatcactgcggcgttggcgcaaccagtcggacgcgacggtcgcggaggagacgaggcagtcggccgaggacgcgatggcggagctgaagaagctgcgggccgagaacgcgcaattgcgtcgggcgaacgagatcttgacgacggcgtcggcttttttcgcggccaggctcgacccgacacggcgttgatggccgcgtacatcgacgagcacagaagccgtttcagggtcgggccgatctgcagggtcctttccgaatcgttggactgcgggtttctcacgccgcgcggctgccgcatgttcagaacacgtcccgtcagccgcatgcgggcggggcgtgaggcgctggcccgcgccgtcctccagatccgctcggatttcttcatggccgtgtacggctgcgggaagatgcacgcgcagctggtcgcccagggctgggatccggccggggtcggccgcgaccgggtgatgaacatcatgcgcgggcttggcatccggggcgtgcgccgcggcagaaccccggtgacgacgaaacccgccaagggcacgggcggcaggccggatctggtggacgggaggttcgaggcttgtgcgccgaaccgcctgcacgtggccggcatcacctacgtgcgcatggccaacggctcgttcggctgcacggcgttcgccgacggcgtgtacgcccgtcggatcgtgggatgggcgtgcgccatgaccatgaacacgcaggagctgccgttgcaggcgttggggcaggcgatctcatgggccgcgtcccgcggcggcgcggatggtcttatccgccacggcgaccatggcacgcagtgcaccggcacggtgtacgccaccggggttatggaatatggggtgctgccgtcgaccggcaccgtcggcgactcgtgtgacaacgccatggccgaaagcgccgacggcgcgtacaggaccgagctggtatggcggcgcagacccttcgcggatctgaaggacctggaattggcgacgttccggtgggtctcgtggtggaactcgaagcgcctgcaccagtccctgggctacaggacacccgaagcggtggaaaccgagtatcatcaacatcaagcggcacaagccgccccactataaggacggaacaaaaatcaggccacttcacattgcatgccttgagggtaatggggacttccgctcacccgagtgcgtggagttgctggacgaagcggacatcgtggtcactaacccaccgtttagcctcttccgtgagtacattgctcaactcatggagcatgataagaagttcgtcgtcatcggcaatcagaacgctgttacctataaggaagtgttcccactcatcaaagagaaccgaatctggcttggctgctactcggggaacatggagtttcgggtgccgggcgattatgaggctcacagcgagaatgacaagtgattctggacggacgaatcggggcagaactggcgaagcatcggcgctgcctcgtggttcacgaatctggacatcagaaaacgtcacgacgaacttatcctcgtgaaacgctataagcccgaggattaccccaagtacgacaattacgacgcaatcaacgtgatctgcctgatggaggaatcacggcggctgcgggaagcccgttcgtattccagcaagtctgtcaggcggattctgcgatgacgtgatgggcgggaaaaaggaatgagtcctttatctaacattctgaccagcgtctgtcgcgatactcccagtgtgcgcggcttgttccgtcgtgagttcctgttccgtggcgctgatcgtcacgctcttcccctcggagagcatatggccgtctgttgaaccgcatcgcgaagttgcttcggcagcgccaatgagtagcgttcttccagcttggcttgatacattgcgtacgtgaccataaggccacaacggccaaatgaatcgggaacatcatgagtgattacaacgaacacataccggacggcgccggcgacaacggcgacgccgacgagctggtgtaccaatccgagggctgcggcaaggccgcgcattgcccactgaaacgactcggcaagggcgacaccgcggtcaacatcatcggtgtggccgtctcggccgtcatcgtcgcggcgagcatctacgcgcaatacgcgctgaccaaatgggccgtcaaatccgcgctcaaggaaacacgaccgcacgattgatccggtgataccactacaccgacttgccgttgacatgcgccccatcgtgtggcctccctttcataccgggaggccacacgacgaaagctcagcgagcctccgccaatatgatgccggcatcggccatctgtttgcgggccgcgacacccaactcctcgctgaccggaacggtcagatcctcgaacacggtgacatcaaagccgagacgtttcgcgtcaagcgcggtgtccttgacgcaatgcgattcggcgatgcccaccacatccacctgcgtgacgcctgcggccttcagcgcattggccagcgtcttgccggcggactgttcggccgtgacctcctcgcgcgtctggatacggtcggtattgtcttcgatgccttcaaaaccggagtatgccgccgaatactggcccttcttgaaatgatgggcgatgcccagaaccgcgatggccggatgaagctcggcgttcggcgtgcccgccgcgccatgcttgggccacgtatccacgaaatccggattgcccgaccagtgtgcgcccggctcgatatgccaatcctgcgtggtggcggtatacgcatactcgccgcgatgcgcgttcacatagtcggcgatcctcccggcgaccgcgttgccgccttcgacccccagctcgccgccttcgcagaatgtcggctgcacatccaccacaatcagcgccttggccatgtcatgctcccatcatcgttcgattcgactgacgtttcccatcataagcgaccgatgccaaccgcataagcccctataaacggcgcgcccgacagccggatcgggactcaccggggcagctcattgtcatcgtatcggggcacggcgtttctggtttccgcctccgccttcgccttgctcttggcgtacatcagctgacatgcccagacgacggcgagcacaacggaaaatgcgagtcccgataccacgtcaccgtatttgacagcggtgaatatcggcatggcgacggccgcgacgatgcagaagggcaacgcgatccatgtcctgcgcagtttggcccggtaactcgaatcccagtagccgaacggacggctgcccctgttttccataagcgttcctccggtcatcacgaatctgcgattgcgtcgatgcctacgatgatacggcacccggcgaatcgttatctttccaccgtcgctgccgaagtcggctgatcattccatcgctaagctgtaatgatgggattcaatcggtaataggccgatatggaatctttgctgatgattgcattgcacggggcagtattgggcataccatttcgagcgttgagccacggtgattcactgtgggtacgcgcactaagccggttcccggtttgccctcccagagccgtacatacatcattgatgatgctccgctctgcgtcatccaacgcgatatattgattcttcccctgtagaacgattgaatgatgcgcttcgccgatatgacgatgtggaacggcgcatcgaggatatttcagcaaagtcgggttatggaagcgatctcatatatgacaatgccgtgccggtgtatgcccggaatgctgaacagcttgagatgacttattatccgtacttgtcctacatggcggattgcgatgttggcggcttggtggcgtctgggctaagctgtgagaccatgtgcggaatcgtcggatatgcaggtaatgtttcggccacgtgcggcaagccccctcaggtgtgtcttcagggattgcaacgcctggaataccgcgggtacgactctgcgggagtggcgctcgtcgcttcgggcatggggcatgcagtggtgcacaagaaggccggaaggctcgccaatctcgtcgaaagcgtggaacgtaacccgatgccgcccgcgacggccgccatcggacacacccgctgggccacgaacggggcgccctccgacgtgaacgcccatccccaccccctgcgtacgctggtcgtggcgatatcgcagtccggagagactatggacacgctgatggccctgcgccacgtgcgcgagcagggatccatggtgctgtcgatctgcaacacgcaggtggcgtcgataccgcgcgaatccgatgccatcagatcatcgactcgctcaagggcatgccggccaagatccaatgggtgctcgacacgcaggcaggcacggtccgatagcgctggtcgatgagggagagctggtggtgttcatcatgccgcccgagcgcggccgtgacgtgctgcacgccaaggtgcggtccggcatcgaggaggtcaagagcagaggcgcgttcatcatcgccgtcgccgaacagggcgccgggatgatgaacgttatgtggatgtcgtgttccggcgtcccgaatgcccgacgttgatgagcccgctcgtcgacgtggtcccattgcagctgttcgacatggatatggccgagatcaaggggtatgacgtggacaagccgcgcaatctcgccaaatccgtcacgattgagtgacgcgatggcgaaggacgagagatggcgaaggacgagagatgacgaacaacaaagacaagtggctgcgcgcattgcaggccaaagggatccgcacgccgcaggatgaggtcgggcgggccggcaggcaccgtcatgacgacccggaggcaaacccgccgaaagatcgggccggttttcgcccggtgaggggaagatccgccaaaccgttcaaggcgaccggtcacaagggcggaatcagccggcagggtgcatgacgcggattatttcggcgaggtcgtgatttgattgccaatgaccatctccagtcgcttcgcgactggagatggcagatgctctgcagcttagattttttagtcctcgttcttggcgggggcggagaggaatcgttcttcgccgggcagcacagcgttgaggatcacggccaccacgaaagccacggcgatgcagttcgaggcaaagatctggcggaacagggccgggaactgcgcgaagatgtcgctcacctgcgtgaagccgatgccgatggtcaggctcaacgcggcgatggtgatgttgcgctgggtgaagccggcttcggcgatcatctggaatccggaaagaatgatgttgccgaacatcatgatcgtgcagccgccgagcaccgcttgcggcagcgagttgaacgcctccgccacggcaggcacgaagctcgccagaatcaggatcagtccgccggacaggatcaccttgcggttgacgaccttcgtcatcgccaccagtccgatgttctgggcgaaactggtcagcggcaggcatccgaacagtccggagaccgaggagatcaggccgtcgccggcgatcgctccggccgtctcacgctcggtcggcgtacggttcagacccaccttggtcagtgcggcggtgtctcccagaacctcgacggacgagaccacgtacagcagtccgatggagatgatcgcgccccaatcgaactcgggcttgaacggcatgaactgcggcagcgaaacgacggaaagctcctggaacccggaaaaatcgaccttgcccatgcaaatcgccaccacatagccgaccaccaggccgaacagcacggacagctgtttggcggtgcccttcatcagcaattggaacgccagacaggcgaccagcgaaatgagacccagcgtcaggttctgccaggatccgaagtccgcggcggacgcgtcaccgccgccgaaactcgtggcgcccacggtcagcagcgagaagccgatggacgtcaccactatggcggagacgatcggaggcacgaaacggcgccagtaccgggcggtcaggcccagcaccagctcaagcagaccgccgacgatcaccgcgccgactacggctccgtaacccttgtcggcgcagatcgcggccgcggcggccacataggtgaacgagatgcccgtcaccatcggcagccgcgagccgatcagccacgcgccatacaactgcaggcaggtgccgagacccgccaccagcagacccgactgaatcacggccgccgattgcgcggacgtcatcttcgccgcgttggcgacgatgaatatcggggctagattggcgacgaacatcgccatcacatgctgcaggccgaacggaatgcccttccagaacgacacgggcgcgtccagcgaggacagcgcctcgaacgatacggaattcttcgttttcttctgcgacatggtttccttttctctcctctgatctaccgttgctctctgctgttccggactcagtccctgaacgtgatctcgccggtctcgggattcatggactcgacgatggccagcgaatccacgtcatagccctgcgcgcgcagttcgtcaccgccgccctggaaccccttctcgaccgcgatgccgattccctcgacactcgcccccgccgcatggcacagctcgatgagcccgtgcaacgccttgccgttcgccaggaaatcatcgatgagcagcacgtggtcgtcggcgtccaaatatttcttggacacgatgacgggaaactccttgcgcttggtgaacgagtacaccgtggtggtgtactggtcgccgtcgaggttgatggactgggccttcttggcgaacaccaccggaacatcgccgaagtggcgtgcggcgcaacaggcgatgccaatgcccgacgcctcgatggtcaggatcttggtgatggtcttgccggcgaaatgccgggcccactcctgccccatatggtcgaacagacgcacgtcgcactgatggttcaagaacgcgtccaccttgagcacgtcaccggtcttgaccgttccatcacgccgaatgcgctcttccagctccttcataagtcccctttgcctgtaccgtcaatgaataggacagagggacagcatacgccatgcagatgaccgcggcgacctgtatgaatccgccacgagtccttgacgaacactctgtgattccaaaatgttttttttggggagggggatgctctagcataacctcgacggaacgggaagtcgtgtaaggagtatcagcatgcgcaatgaccgctatgggagcctggacggtatcaagggattcgccctgatcggcatcatctggtatcacctgtcgcaacgctcgctgcccggcggtttcattggcgtggacgtgttcttcaccgtatccggcttcctgctcgccctgagcgtccttcgtgagatcgaccgtaccggcagactgcgtcttggcaatttctatctgcgcaggttgtctcgactgtggccggcgatggcgttcatgatcgccggctcggtgtcgctcggcctgttcgtcaaccatgacattctggtgggtgtgccgggcaaaagcgtctccgcgctgacattcacgtcgaattggggggagatcttctccggagacagctatttcgcggcgacgtcgccgcaattgctgcggcacttatggttcgtggcgctgctggcccaagcgacgctggtgctgccgcttttgacggccatgctgcacagaatcggctccacgttcgtgcaggcgttggtgccggtgctgctcgccgcgctgtccgcgtgtggcatgtgggtgctgtacaacccgtccgccgaccccacacgcgtgtatttcggcacggacacgcactgttttggcatgctgttgggagtcgcgctggcgttcgtcgtgcggcacagcgaggagtctgacgccgagccgcgccgcctgttcaccatggttatgccctggctggccactggcgcactggtcgtgttgatcatgatgatgccgcgcgtcggacaggatgcgtcagcgttccgcggcggtctgattctggcctctgtgctcaccgtagtgctgatcggcggcagcatttccaaggattcatggatgatcggcctgttcggctggcgtccgctcgcgctgctgggcaaatactcgtatggcatgtacctgtggcattggccgttgtacctgctgctgcagctcatgcttcccggttaccgtggcagcggattgtgggtggtccaggcgctcacgttgctgctgagcctcgtgatgaccgcggtgtcatggtggatggtggagaatccggtcgcggaatggatcaagtccaagcgcgacaagtcggctccccgccgcccggtggcgcaacgttcggctccgcgacgggtcggcagcgcgcgggcacgtggcgtgtatgggacgcacctcaacaacgtcgagttcactcagccgtactctcaggctgcgcccctgccctcgccgcaagacgcgccggtcgtcgcatcccgcagctcccgtaccgcggaggcgatgcgcatggtcgtcaccgtgtcggttgtggtactgatcgtcatcgggttcttcatgggtgtggcccaggccccggcgaagacgcagacacagatcatgctggagaagaaccagagcgcgctcgccaagaaggaacgtcagcgcaagatggacgccaaggccgcggccgaggcgaagaaacgcgccgaggaggagcgcaagcgccgcgaggaggccaaggcagccatcgagaagaccctgaacggcgaggacgtctccgtgatcggcgactccgtcaccgtgggcgcgtcggcggcattgcagaagtcactgcccggcatcgccgtggacgcccaggtgtcgcggtccatcctgaccgcgcccggtatcgtcgcgcagatgaaggcggaaggccgtctgcgcaagtacgtggtgatctcgctgaacacgaacagcgcgaccacggtcggcgaatacgagcggattgcggccgcggcgggtgatgggcatgtgctggtcatcatcaatgcgtatggcgaccgcgagtggattcccgtggccaatcaggcggcctccgactacgtgcgcaagcatcccaccgattcgattctgatcgactggaacagtgctatcgcggcacacaccgattggctcggaccggacggcatccacccgcaggccggacaaggcgaagacctgtatgcctccggtctgaggaacgcgttggcggaatgggaggtcgcccatatcgagtgacactgaccgaaccatgtggtaaacaggaaagccgaatcatcgtcaaccgtcagggggagcagcgtgcagcaggatccggatctcatcgcaagaagcgccgaggaactcgtcggcgacctcaacccgcagcaagccgaggcggtgcagtaccgggggcccgcactgctgatcggcgccggcgcaggatccggcaagacacgcgtgctcacccggcgcatcgcgtggatcctcacgcaattcggagcatggccgagccagatcctcgccatcaccttcaccaacaaggcggccgctgaaatgcgcgaacgcctcgaaggtctgatcggaccggtcgcccagcgcatgtgggtgtcgacgttccattccgcatgcgtgcgcatcctcaggcgtgacggccagtcgatagggctggcgtcgggcttctccatctatgacaccgccgactgcgagcgcctcgtcaagctggtcggcgccgatctcaacatcgatctcaagcgctacacgccgcgcgcgatcctctcgcgcatctccgactacaagaactcactgatcggctggcaggagcagctcaagcgctacgcgcccgactaccggcccggccagcgcggttatcagatcggcaatttcggcgacatcgaggtgctgtattccgtcatctacgccgaataccagcatcgtctggccatggcgaacgccgtcgacttcgacgatctgatcggccggacggtcgaactgctgcgcacccaaccgcagatagccgactattaccgtcataagttccgttatatcctcgtcgacgaataccaggacacgaaccatgcccaatacgagctgatccgcgagctggcgggcgtggacgcggccgggcaggtcgtgcaggacgccccctcggcggggcgggccggcccggcatggatcaccgtcgtcggcgactccgaccagtcgatctatgcgttccgcggcgcggacatccgcaacatccaggatttcgagcaggatttccccaacgcgaagaccatcatgctcgaacagaactaccgttccacgcagaccatcctcgacgcggccaacgcggtcatcgccaacaaccagggtcgcaagcccaagaagctgtggaccgcattgggcagcggggacccgatcgtcggctatgccgcggacaacgccgagcaggaggccgcgtggatagcgggggagatcgctcgcgtccgcgccgaggagggcacgccgtattcggacatggccatcatgtaccgtgccaacgcgcagtcgcgtgcgcttgaaggcgcgctcgtgcatgccggactgccgtatcagctggtcggcggcacgcggttctacgagcggcgggaggtcaaggacgccatcgcgtatctgcaggccatcgtcaatccggccgacaacgtcaacatgcggcgcatcctcaacgtgcccaagcgcggtctcggacctcgcgccgaatcgatcatcgtctcatatgccgatgctcatgcgaccacgttctgggacggcattgaccatcttgaccagatcgacggcgtgcccacccgtaccggcaagcagctcgccgcattcagggatctgatgcgctccctgagcgcgttcgcggccgaacatgacggcaagccgtccgaagtggtgggggaggtactctcgcagtccggtctgctcgaagaactgcagcggtccgaggatccacaggatgcctcccgcgtggagaacctgtcccagttgcagtccgtcgccgccgaattcgagcagaacacgccggacgccacactcgcgggattcctggagaccacggcgctggtggcggactccgaccagctgccctccgagggcgaggactccggcaaggtcacgttgatgactctgcacaccgccaagggcctggaataccccgtcgtgttcctcaccggcatggagcagggcacgttcccgcactcgcgggcgatggaggacgccgacgagctttccgaggagcgtcgtctggcatatgtcggcatcacgcgtgccaagcgtcgtttgtacgtcacccgtgccgccgtgcgcgcgcagtgggggcaggccaacgagatgatgcccagccagttcctcgatgagatccccgaccgactcatcgactggaaacggcgcgaaaccggcatggagggcatgcgctccggctggtcacgccgcggcttcgacgacgagttcggcggatgggacgatgacgacttcggcggcaccacatacggcggatcgtcctcgtacggtggttcctcgtcatacggttctcgtggacgttcctcgtacggtggttcctcgtcgttcggctccggttcgcgcggtggatcgggctcgtcatatggcggggccaggggattcggctcatcttcgcgccacggcggttccggccgtcagggctccggacagcagtacgggtcgggcagccggttcggctcatccacgggattgtcgcgtggcggcaaggtcacgacgcgccgcaccgctcccaagtcatctctctcgtcggccaaaccggcctcgtcgctcagcaaggacaataacctcaacatcgccgacttccatgccggtgacaaggtcacgcatgaccagtacgggctgggcaccgtcgtcgacacgcaggacaagggccgcaactccgtaatcacggtcgatttcggctcgtcgggcgtcaagcggctgatgctgcgcgtggcgccgctggagaagctctgaggtaaccacccaccggcggcttcgcgccacctcccgccagcgggaggatggtggcgggaccttaccggcggatgaccggcgcatatatgaaaagcgttgaaaagtcaaggcttgtgtttcccggaaacggttgacataatcgtcgatgtccatcttcaaccgagaggagacaacaatgttccgtagactattcgcatcgctgccggccatcgtgttcggcgtgcttatcgccgtcgccccgcaggcattcgctcatgtgtgcgaggtcaaggataatatgcccatggcgtgccattacaccgcgcaagcggagcttggcatcggcgtggtcatcgccctgcttggtatcatcgctttgttctgcagcccgaagatacgtacaggtctcaatatcgccgtcgctttgaacgcactgctgtcgctggccgtgccgacggtgctgatcggcgtgtgcaagggcgccatgatgcattgccatatggtcaccaggccgacgctcatcgtgatcggcattctggcactgctgttcgccgtcgtcgccatctaccttgactccaagcccgtcaagcgatgatcacacgaatcactctcaaacgactgccactggagaacctgaagcgcaagccgtttcgcacggctgcgctcgtcatcgtcgtcatgatgctgacgctcgcgttcttcggcggctcgctgctgtccatgaacctgcgcaacggattgcgcagcatgcaggaacgcatgggagccgacctcatggtggtgccgcaggataccggcgccaaagccgaggccctgctcaccaacggcggatccaacacgttctatttcaccaacgacatcgagaacctggtctccaaggctgatggcatctcccgagtcacggcccagacgtacatatcatcgctcgcggccgcatgctgcgacgagaaggtgcagatcataggcttcaaccccgcgaccgacttcgtcatcaccccctggatcacatcgcagttcgacgggacgctgaaagacggagaagtcgtagccggctcgaacatcagcgtatccggcaacaacacgatcaagctgtacgggcatgagttcccggtcgccgcccagctcggctcgaccggcaccagcctggacaattcggtgttcgtcaatatgtccaccatcccctcgatcgtctcgtactcgtcgtcggtgggacacacggccatccccgccgaatacgccgacaaggcggtctccgcgatcctcatcaaggtcaaggacgggtatgacgccaagcaggtctcgctcaacatcaccaaggaatccggtctcgaagggctcggattcgtgtatccgggcggcgtgacagccaccaccaagaccaacctcgacgcgctggtcgggtacgtcacgctgttcgtcgcagtgttctggatcatgggcctcatcgtgctgctggcagtgttcgcatccgcgatgaacgagcggaagaaggaattcgcggcctaccgcatcatgggcgccacgcgcggcacactgattgcgctcatcgtcaaggaatcggcgctgatcggactggtcggtggcgtcatcggcatcgcgggcgcgtctctggcggtgttcccgttcaacacgctgatcagcaggcagctgcagctgccatacctgcagaccgacgcgctcaaggtcgtcgcgctcgtcgccataagcctcgtgttcgccgtcgcgaccggactgctggcgtcaatcgtcaccgcggtcaagctgtccgcgcccgaaacctatctcacgttgcgcgagggggagtgattcatcatggcgatgcttgaaatcaatgatctgacccgtgaattcacccggcgcagcgcgcgtttcgccgccgtcgaccacgtgagcttctccatggaccagggcgaactggtcgccatcatcggacgttccggcaacggcaaaagcacgctgctcaatctgatcgctggcctgctcaagccgacgtccggcaccgtcgagatcgacggccgaaacgtctccaagctgtcggacaaggagctctcgcagctgcgcaacgcgacgctcgggttcgtcacgcagggacagacgctgctcggcaacctcaccgtgctcgacaacgtcattcttccggccgtgctgtttggcccggcgaagaaaacggtggtgccggatgatgttgcggcgcccggcgaagccgatgccgccggcgcggccgattccgcacgtgagcaggacgatgccgacatgcccgacgtcatcgacgatgatctcacggcggagcacgagcccgacgccctggagcgacgggcgacgatgctgctggatcgactcggcgtggctgacctgtccgacagctatcccaaggagctgtcgggtggcgagatgcgccgcgtctccatcgcccgggcgctcatgaacgggccgaagctgctgatcctcgacgagccgaccggcgatctcgacgcgacgagcaccacgatggtcatgcgtctgctgcgcaacgtcgccgatgagacggcggcggtgcttatcgtgacccatgacggcgacacgttgccatacgccgaccgcgtgtatgccatggacgcggggcggctcaccccggccggcggagcctgacacgcagggtcgtccatagggtatgcgattataaacgattgtgtctgccataaggcggatgctatctggagtcttagcccatcagtgggtcggcggcggttttccgccgttcgtgcacgtcacgacgaagcactggggaggccgactcagcgcggggacagcctcgcgttccgttcagataacgacagaataaaggaacaagaatgaccaacgttcagcgttctcgccgtcaggtgcgcctttcccgcgccctcggcatcgcactgacccccaaggctcagcgcatcttcgaaaagcgcccgtacgctcccggtgagcacggccgcacccgtcgtcgcaccgaatccgattacgcggttcgtctgcgcgagaagcagcgtctgcgcgcccagtacggcgtctccgagaagcagcttcgctccgcttacgagaaggcgacccgcaccgccggccagaccggtaacgcgatgctcaccgatctcgaagtccgtcttgacaacctcgtgctgcgtgccggcatcgcccgtaccactgctcaggcccgtcagttcgtggtgcaccgtcacatcctcgtcgacggcaacatcgtggatcgtccgtcctaccgtgtcaagcccggccagaccatccaggtgagggccaagagccagaccatggttccgttccagatcgccgccgaaggcgtgcaccgcgatgtgctgccgcccgtccccggctacctcgacgtgaacctggcttccctgaaggccaccctgacccgcaagcctgaagtcgaggagatcccggttcaggtcaacatccagtacgtcgtcgagttctacgctcgctgatctggatccaccacctgtaatttacagcgtaaggacatacatacacacgaacgccccgtggcattgcgcccggggcgttcgtgtattccggtcctgttctcacgggttcgaccggccatcggccgcgttcatcgtcactggccgcacaccgcctgccgcagcatcgtcgcatacgcataagcgccggtcatgttgggatggatgccgtcgtcgtacaggtattcgccgtggccctcgctgtacttgtaccagtcgatgatgcccacattgccgttgtggctggctgcggcacgcatcatcgagttgttgttcttctcctggttcggatagggcatacggatcgtcacgaaatacaccggcttgccgcccgcaaggtcgatcagctgctggaccacctgttcgttgcggatgatgccgttcgttccgagcccgtaaatgatgacgctgccgctgtgcccggcagtggtcgcctgttggaacacgctgacggcctgaggcatctgacggttcggcttgccattgatgtatccgttcggaaacgccgcctggatcgcatccttcgtgccggaggtgacggaatcgccgatcatcatgatgtcggcgttgcagcttcctgtattggggtcatagtggtatttcgaagcatccaggttgtcgggcaccttctccgcaatgggcgcgacagatggagacgccggctttgcgctgtctccgttccgctcggagccgtcgtcattcgtctgattcgtcgtggcattgttactcgtcgtaccgtcgtccgagggcttttcgatgctcttcggcttgggcagggcgagaggcttcgccggctcggcgagttcgggccggagttggatcatgcggtcgtgggcgatctgctcccaattcaccggcgcccaagtgagcgcggccacggtgacgatgccgagagccgccatcacccatgaccccggcctcagccgtccgctcggcaccaccgatgccctcgcatgcctgctgcgcggcgtcggctcgtacatgcgagaggcctcgaccagctggtagaacgcctccgtcgccgtccatatcacggccgcctcaatcagccatccccaccacggcagtgcttcggtgcgggtggcgggattcatgaactgcagcagcgggtaatgcatgagatacagcgaatacgagcgtgaccctaggtaacgcagcggagcgcagccgagcacacgcggcaggctcactcctctgatggcgccggcgagggccaaggcgcccaatatggcggcgacaaggtacccgccgtgatacatcgtgtcgtcatagccgttcatgaaccagaaaccggcgcatagggccagcaacgacagccagccgaacacgtccaggatgatagcggacgcgccgcgaccgtcgtctctctgtttgcgatcgtcagcggtccggtcggcacgctgcatcagcatcgccagcatcgcccccatcgccagctccgcgagcctcgtatccgtaccgtaatacacgcgcgacgtgtcgtcgggatcgaacagcagccacatcgccgcgctcgacgcaagcacgattatcaccatcacgacggtccgagcccatttggcgcgaacgagacggccgatcgccatgatcagcagcggccatacgagatagaactgcatgaccagcgcaaggaaccacaggtgcgtcagaggggaggggagtccggccgccgcgaaatagggaagtttgcggaagatgttcacccagttgctggcgaacagcgcgcctggaagcgcgtcggtgcgcaccttgtcgagaaggctcggggcgaacagccatgcgaacggagcggtcagggcgattgtggccagtgttgccggccacagcctcttgatccggcgccccagataccttccatactggaacgtgccatggctgtccactgcgcgaatcaccgaacgagtcgctaggaagccggtgatcacgaagaacatggtgacaccgatgaaaccaccctcaagcagcgatgggcgggtgtggaatgcgaccacgccgagtatcgccacggcacgcaggccgtcgatgccgtcgaaacggatttgccgctggctgtcaggcagccccttctgttcttgctctctcatgtggcctagtctacttcaccgcgggtttcatggctatagttgtgacctgaacccgcgttcgcgttcattggtgttcttgcgcttgtgtttacctgtgttcatatgtgttcatccggcgaaagtcccgtttgcgcgtcacctgatgggactttcgcgggaaaggcgtggggatgattccccgccgaccgtcatccggctatcgcctgtaccacaccatgcgttttttgacggttttggggctggtgtggccaagggcggttccgggcccattcaccggtcattggaaaatggcggtttccgcgacccgtgctttgccacaccacgtgatgtgaaggctcacatcgcatggtgtggccttctgctgtgccacaccatgcgattttggggtgtttttcgcctggtgtggcacacgggatgggagcgaatcagccggacggatgggtagggactgagtgcgggctgttccattgagctgagaaccacccccagtcatgccgcgcatgccagcccccccgccagcgggggcgttagcagactggaggggtctgtggcgatgggcgcggcgggttttgtggcatgcgggaagcgtggaataatcgtcggtatgattctccatctgcatcttgtccgccacggacagaccacgttcaacaggtataaccgacttcagggatggtgcaatgcgccgctgaccgaagcggggttggcggacgccgacaaggcggcggaaaaactcaagtacgtgcggtttgctgccgcgtactgctccgatacgtcgcgtgcgcagatcaccgcgaagcgcatcctcgacgtgaacgaggaggtcggcaacgcccggccggtgctcgtgtcggacatgcatttccgcgagcagtgctacggctatttcgaaggtcaggacatgtcgctcgcctggacggccgcgggagggccccacggcgcgaaggactacaacgacatcgtcgccaagtacggcctcgccgcgacccgcgacttcctcaaggaggccgacccgttccacgacgcggaatccgacgccgaatactgggcccgcgtgcacggggcgttttccctgatcgcgtccaacccggatctcaaggacggcgacgacgtgctgcagatatcccatggcaatacgctgctcagcctcatgcaccgcttcgcgccggaagggtatgacctgagcgagaggccggccaacgggtcggttacgtgccttgatttcgatacgaccaagccgttcgaagtggctctcaccgtcgtgtcatacaatcagtgagacgcgcgaccgggccggccgacccgcatgccgccggcagcgtcggtctcgggtgacggctagtgtgttgcgggtattgtgtgcacgggcgtatgcctgtgggacggaaaagaggtacacatgggtgttggccagatcgccggccttatcgcggcaatagcgttcgccgtgcttgcgggcttcatgatctatccgttgattcgcctcggcaagctgttcgaccagattgcggacaccgtgcgtgagtcgggggagcacgccatcccggccctcgatgagggcgtcaccaccgtcaagcaggtcaacaaatcgcttgaggatgtcaacaggatctccgcggccgcgtcgtccactgccaacaacgtaggcgccctgaccgatctttacggttcgttcctcggcaagcccgtcatcaagatcgcgtcgttcttctatgcgctgaaatccaccgcgcagtcgttcgtcgccaagaagagcaccggccgtgactccgtcgaaggctccggacagcaggaaagcaaggctcagtgatgttcaaacgattgttctggatcggtgtcggcgtgaccgtcggcgccctagccgtcatcaaagcccaggcctacgtcaaggccaacacccctgacgccgcacgagcgttcgtgttcggtccggatcaggaccatgtgggcatgaggacgctggaaggcctggtcaacgagttcaacgccacccgccgagcccgcgaggctgagctcaaccaacattacatcgaccgcgccgcgcggtagcgaatccggggcatgcccccactttcacacgcataacagctgtttaaatttttatctatcattttgcatgcgggccagcacggccccaacccacaagggagctcaccaactcatgcgcacttcagaaatcgcgaagcgctatctggattacttctccaagcacgaccatctggtcatgccttcggcgtcactgatctcgccgaacccgaccacgctgttcaccatcgccggcatggtgccgttcatcccgtacctgctcggcgagcagacccctccccacaagcgcatggcctccaaccaaaagtgcgtgcgcacgctcgacatcgacgaggtcggcaagaccacccgtcacggcaccttcttccagatgctcggcaacttctccttcggcgactacttcaaggaggaggcgatccactacgcctgggagctgctgaccacgccgcagtccgaaggtggttacggcttcgatcccgagaagctgtgggtcaccacgtacaccgatgatgaggaagcccgctcgatctggaagaacgagggcttcgaccccgagcacatgcagatcttcggcatggaagacaacttctggaccaccggcggccccggccccggcggcccctgctccgagatctacgtggaccgcggacccgaatacggcaaggacggcggccccgcggccgacgagacccgtttcatcgagatctgggatctcgtgttcgagaactacgaggtcgacaacgtcaagtccaagaccgacctgcacatcgtcggcgagctcaaccagaagaacatcgataccggcgccggtctggagcgtctggcctacctgatgcagggcaagcagaacatctacgagaccgacgaggtctacccggtcatcgaggcggctgagcagctttccggccgcaagtacggcgaggacgcggccgcggacgtcaagttccgcgtcgtggccgaccacgtgcgttccgcgctgatgatcatgtccgacggcgtgcgcccgtccaacgtcggccgcggctacgtgctgcgccgactgctgcgtcgcaccatccaggccatgcgcgtgctgggcgtcaccgagccggtgatcccgcacctgcttcccgtctccaaggacgcgatggtcgccagctacccggagctcgaaaagacgttccatgacgtctccgaatccgcctacggcgaggaggacgcgttccgccgcacgctcgacaacggcatcgaaatcctcgacgtcgccgtcaacaaggcgaagaagacctccgacccggtcgtctccggcgacgacgcgttcacgctgcacgacacctacggcttcccgatcgagctgacgctggagatggcggccgaccagggcgtcaaggtcgacgaggccaagttccgcgagctgatgagcgagcagaagtcccgcgcccgtgccgatgcgctgaagaagcgccacaacgttgacctgagcgtgtacgacgacttcaagaagacgctcgtgcagcccatcgacttcctcggctacaccgacatgtccgctcgcggccgcgtcctcggcatcatgcaggagggcaagggttcggttccggccgtcagcgcccccgcgaacgtcgaggtcatcctcgaccgtacgccgttctacgccgaggccggcggccagctcgccgatcagggcgagatcctgtccgacgatggcgcggtgctcgaagtcgacgacgtgcagaagccgatcaaggatctcatcgtccaccagtgccgtctgaccgaaggcacgctggtcgtcggcaccgaggtgagcgcgagcatcgatctcgcccgccgcggcgccatcgcccgctcgcacaccgccacgcacatggtccacaaggccctgcgcgaggagctcggcccccaggctacgcagcgtggatccgaggacgcgccgaaccgcctgcgcttcgacttccagtggtcgtcggcaccgagcaaggacgtgatgaacaccgtcgaggcgcgagtcaacgaccgtctgcgtgacaacctgatcgtcaccaccaccgaaatgaagttcgacgacgcgatcgcgctcggcgcgatgcacctgttcggtgagaagtacggcgacatcgtgcgcgtggtctccatcggcgaggacggctggagccgcgagctgtgtggcggcacccacgtcgaccacgtcggcaagatcggctcgatcaacatcatgtccgaagcctcgatcggctccggcgtgcgccgtgtggatgccgtcgtcggccagggcgcctacgagttcaacgcccgcgagcacgccctggtctcccagctgtccgacaagctcaacgcacgtccggacgagctggcggagcgcgtcaacacgctgctggccaagctcaaggaatccgaccgccgtctggccgccatgtacgaaggccagctggccgcgtccgtgccccagctcgtcgcggccgcgaagacgtccgcggcgcgtgtcaaggtcgctgcgaagaacgtcggccacttcggctcgttcgacgcgctgcgcaagaccgtgatggacgtccgcgcccagctcggcgaggacgcgtcggtcgtcgtagcgcttgccggcgtctccgaggacgacaagccgatggtcgccgtggccacgaacgaggccgcccgcaagaacggcatcaaggccggcgacctggttcgcggggcatccaagatgctcggcggcggtggcggcggcaagccggacttcgcccagggcggcggctccgacgcgagctgcatcgacgaggcgctgaaggcacttgaggccgaggcgctgaagggctgaaccatcaggtggtatggctaggcgttgatttgggtgacgccagggtcgggctcgcattgtccgaccctgagctcacctttgcccatccctatggcaacatccaggcatacggcgattcgttccgtgcgctggatgacgtcattactgtcatcgaggacgaagcggtggaccacattgtggtgggactgccgcttcaacttgacggcaccgaaggaaaaagcgcgaagaaggctcgccgttggagcgcgaacctggaaaagcgcatgcgcaacttgatggatgaacacgatttcgcgttgtaccacattcctcaggtaacattattggatgaacggctgaccacggtcagcgcgcatcggcaattgctggaagcgcaactcgggtcccgccgtcatcgtccggtggtcgatcagcaatccgctgtcgtgatattgcagaccgcgctggacggcgccatgaaagtgtgaggagagagctagtgtcagatgacctcgccgattttttcgaggagaacacccattgggtcgactccaaaggcaacaccacgtcggtaaagccccccagaccgccgaaatcacggcgggaaatgcgccgtcggcgcaatgtccgccgccgcaagaccatcatcgtgctgaccatggtcgtcgcggtgctcgtcgtggtcatagccggcgggttcttcggagtcagggcgttgcgcgccatcagggaccgcaacgacggcgacacctactccgtgcaggactacagcggtcagggatacgggtccgtggagttcaccgtctcgcagggcgagagcccgtccagcatcgccaagcgtctcgtcgaggccgaagtggtcaagtccgcggacgcgttcaccggtgtctcatcgggtatgacgctgtatccgggcacctatcagctgcgcaagcacatgcccgcgtcgtccgtggcggcgatcctgtccgatcagagcaaggcggagggcttcctcgacgtcaacgcgggggagcgggtgtccgacgtcatcaagaaggccgcggcgctcagcgagatcgacgaatccgaattccagaagatcatcgacgccaaaggcgagggaatactgcccgcggaagccggcggcaacttcgagggatggctggaacccggcaagtacgacgtcaagggactcggctccgcgcagaagatcctgaagaccatcgtcgacaagcgcgtctccaagctcaacgagatgcacgtgcccaccggcagcgagcggcagcggctgctgatcatcgcctccatcgcggaggccgaggtcaattcgcccgattactacggcaaggtgacccgcgtcatcctcaaccgtctcgaccgcgacatgacgctgggcatggattcgaccaccgcgtacggtctgggcatcaacggcacgcagctgaccaacgcgcagctcaacgactcgtcgaacaaatacaacacgcgcgtcaacaagggactcacccccacgcccatcagcaatccgggagacagcgccatccaggcggcgatgaacccggagcagggcgactggctgtatttcgtcaccgtgaacctgagtaccggcgagacgaaattcaccaccggctccgtcgaggagcagaacgcgcagttcgagcagtacgtcaaggaatacaaggacaacaacaagaacgcgaactaaagcagcgtcgtcgcgatgaccgcgaccaccgccgcgcagacgatcgcgggtgcgaacgggaccttgcccgcatggtcggatcggcgctggggatcgaaccttagccacagcgccatccatgccaatcccagcagacccatggccagccaccagaccaccacggcggtcagcccggccatccccacggccaggcccatggccagcgtgcaggtcacgtcgccgaaccccatcgatccgggcttggccatcgccagcccggcctgcagcacggcactgagcgcggcgaatagaggggcctgtaccagcaggaacatcgtgttcgccatgacggcgacgatgatgaccgccaccagctgtgccaggcacccgatggcgatccacaggcgcggcacacgccggcgccgaatgtcctcgacactcacggcgataccacatatcaagctgggaaggtatgcaaggtaggtcatgacataagatatagcgaagttaccgattgaatcaaaggagcatggcatgttgcgctggcagacggcgggggaatcacacggcgaggcgctggtcgcgatgatcgaggggctgcctgcgggcgttcgggtcaccagcgatgacgtcgtcgatgcattggcgagacggcgcctgggatacgggcgcggcgcgcgcatgaagttcgagcaggataaggtgcgtctgctcaccggcgtgcgtttcggcgagaccctgggatcaccggtggccatcgagatcgcgaacaccgaatggccgaaatggaccgaggtgatgagcgcggatccactcgaccacgatctgccgcgtgaggggcgcaacgccccgctgagcaggccgcggccgggacacgccgacctcaccggcatgcgcaaatacgggttcgacgacgcgagacccgtgctggagcgctccagcgcgcgcgagaccgcgtcccgcgtggcgctgggcgcggtcgccgcgcggttccttgagcaggcgttcggcattcgcaccgtgtcgcatgtgatctccatcggaggggcgggcgttgaggacgccgatgacgcagcgttgccgacccccgacgacgtcgaagcgctggacgcatccccggtgcgtacgctggacaaggcggccgaggagaggatgatcgcgcgcatcgacgagatcaagtccaccgccgataccgtcggcggcgtgatcgaagtgctcgcatacggcgtgcccgccggcatcggcacctacgtcgaatcggatcgccggctcgacgctgccttggcctcggcggtcatgggcatccaggccatcaagggcgtggagatcggcgacgggttcctggaggccgtgcgccccggatcgcaggcgcatgacgagatggtccccggcgcagatgggcgcatcacgcgactgaccaaccgtgcgggcggcatcgaaggcggcatgtcgaacggccagccgattcgcgtacgggccgcgatgaagccgatcccctcgattccgcgcgcccttcgcacggtcgacgtcaccgacggcgaggccgcatccgccatcaaccagcgttccgacaccacggccgtgcctgcggcctccgtcgtggccgaggccatggtccggctcatcttggcgcgatacgcccttgacaagttcggcggagacagcgtagcggagacgcgccgcaacttcgagcagtacgtcgcctcctggccggagcacatgcgctgacggcgcggtaacgtcatccgcaacgaaccgtacgtcctgaaccaagggagagaaaccatgcccgctcgaccagtcgccgtcatcatcggtatgatgggcgccgggaagacccgtgtcggcaaggaggtcgcgcagctgatgtcgatgccgttcgcggatgccgacgtcgaaatcgagcacgaggtcggcatgcgcatccccgaatatttcgagcgtcacggcgaacccgcgttccgcgaggtcgaatccgaggtcatcgccgggatgctgcacgggttcggaggcgtcttcgccctgggcggcggcgccccgatgacgcccgcagtgcaggacgatctcaaggaatacatcgaggacggcggcaaggtcgtgtatctcatggccgacccgcgcgaggccatggaacgggcccatcgcggtggcggccggccgatgctgcagggggacgccgatgcccgctggaagaagctgtaccgccagcgcgacccggtgtactaccgggtggcgaacgtccatgtcgaaacatacgggcagacgccgctcgccgcggcgaggaagatgatggatatgattaccgaacgaacggttcatgtgaccggcgcgaccatcgaggattatgacgtgagcatcggggaaggggcgatgaaccacctctccgaggtgctggggccgaagccggtccggatagccctgatccacacgcagccggtgcagcgtcattccgaccgtgcccgcacgctgctgcgacaaggcggctaccaggtgtcggacatcgtgatccccgacgccgaagcgggcaagacgatcgaggtcgccaacggcatctggcagcggctcggcgacgagggcttcacacgctccgacgccgtggtgggcgtcggcggaggcgccgccacggatctggccggtttcgtggccgccacatggatgcgcggcgtgcggtacgtcaattgccccacgtcgctgctcgccatggtggacgcctccacgggcggcaagaccggcatcaacacgccgcagggcaagaacctcgtcgggtcgttctacacgcctgccggcgtgctcgccgacctcaagacactcgtctcgctgcccaacgacatcttcatcgaagggctgggcgaggtcgccaaatcgggattcatcaaggaccccgagatcctgcacatccttgaagagcatgcggccgaacttcgcgcattcgacggggctacgttccttgacagcggtctggagaacgtggtcgccgaactgatcgagcgcacggtccgggtcaaggcgtaccacgtctccgcggacctcaaggaagcgggcctgcgtgaattcctcaactacggccatacactcgcccacgccatcgaaaaacttgagcatttccgctggcgccacggcaacgcggtcgcggtcggatgcgtgtatgcggcggaattgggtcatctgctgggctatatcgaccaggatctggtcgattatcaccgctctctgcttggctcgctcggtctgccgacctcatggaacggcggcacgttcgacgaagtgctggcgcttatgcaccgcgacaagaaggctcgtggcaacaagctgcggttcgtcgtgctcgattcgatcggccatccggtgcatctggacgatccgccggcggacgcggtcgaggaggcattcagacgtatccaggcgtgacgactcggaccggtctccacatgaccggtccgagtcgcgttttcgcccaccccagcaatatcaatcatcagccaaaggaagtgcatcatgaccaaggtgatagtcgtcaacggaccgaatctgggccgcctcggagtgcgtcagccggacgtctacggcaggcaggatcttgagacgctgcgcacgcaatgctcccagtggggcgccgcgctcgggctgaaggtcgaggtgcgccagaccgacgacgaggccgagatggtgcgctggatgcatcaggccgtcgacgagcagaccccggtggtgatgaacccggccgcattcacgcattactcgtacgcgctggccgacgccgcgcacatggtgggcgatgccggactgccgctgatagaggtgcacatctccaatccctccgcccgtgatgagttccgcaagcgttcggtcatcagcccggtcgccaccggcaccatcacgggaatgggattctacgggtacaagctcgcgctggacgccatcgcgcatcttatcggctgatccgcagtcgcagaaccgtttcaacgggtggtcatcattgctggtgcgcttgcgcgtcgggcttgctgcgcctagtgtggtgtccatgaacgatgaagcgaatcaggggtacccgcaaggtccggccaatggcggttatccgaacggtgcatcgctttacggggttcagggcgatgcacacaacggcaacaacgattatccgcagtatggagctgcttcgcagcccggggagcatcagcccggttacgcgcagcccggttacccgcaacatgactcctggcagggtcagggcggctacgccggcggccagcgtccgccggcaggcgggcagcccgtctatcctccggtgggagcaggccaacggcagcagccatacgccggcggctatccgcagcagggtgcgtatcagcgtactccgtaccagccgtacggtcagcctccgaagaagaacaacacgggcaagatcatcgccatcgtcgtctccatcgtcgtcgcgttggccctgatcggcgtgctggtttgggcgttgacgtccaagggaggcgacggcaaggacggcaagggcaccgaaacgtcgcagacgacgaacggcggttcgaacaacaagaacaaagatggctacatcgaggttccgcgcggcgactcgaacggaaactccgacgacgactcctacgactccatcaacaaggactaccagcagaagaagcaggagctggacaaaaagaagcaggagctgcagcaggaactcgacaactacaagaagaagtacggcggctcaagctcgtatgacaaccagaattcgtacgattcgtatggcgactcctatgattcgtacggtgattcctacgattcgacgggctactgatccgcgtcgaacgaggtgtcggccggctcgacgcggctgaccgcgttcgaccggtagattgtgtgacgcgggcatcatccctgacggcgcatgccgtcttcggtatgatgcccggtccatttgagcaccgcctggacgcggttttcggcgttgagcttctgcatggatgactgcgcgtgcttgcgcacggtggccgctttaatgccgagtcgtttcgctatcgataggtcggtcagcccacgcgacataagatcgagcacctgcacttcgcggttggagaccaggtcagcccgtttcggcgtctcatgcgcgagctggtcgaatgaggcacgggcgtcaacgaacccgaaatcaccgtaaacgcctccgccaagtaccgtcgccaagccttcgagtatttcctgctcgtcgttcttgctgaccagtccttgggcgccggcctgcgccacgtcgaatccgaacgtctccttggcgaacgaggtcatggacagaagcttcaccatgctgtcgcgtcggcggatacgacggcataccatgacgcccgacatggattccatcgacaggtcgaccaggaccagatctggtctcgtccgggcgtccagcgtcaggctcacggcgcgcggcccgtcgatgaccgaccaggctatgcgcaatccaggtgtcatttcgagaacgagacgctccagcgaatccaatgaccgcctgtcatcatcaaccatgccgattgtcccagtcaggtcatcgaaaatccccatacaatcacatacctcatcatatgctttcaggtttttccccatagtaacccccttatatacccccgtcaaaatcaacgggtgttgcatccgtgccccccatgtttgatgccaggatatgagggtgcattgttgctgtaagcctcatcctgccaaagtcccatttgatggtgtcgggatggggctttggcgggatgatgcagaggccgttgttcgtgtggcatggcgggatatgaggctattggtacgattccgtaacagcctttgaagttccgtgccgattgcgtgtgtgaacgtcacgaggggaatcgtcgttgccgggatcgtcggcatgaagcccatatatcgggatcgatcgtcttgcggtgcatcctgcggttccggggcctccgacgggcagactggtgtcgtgtagcaggccggcaccgagccgcagcgtctctgcgtcagagctctggcggatgggcaagtcagtcgatatggtcggaatcagtatcctgccgatgaccgtgcccgaatctccggagccgttctgttgctcggcatccggttgcccgagatcgtattgtcctgaatcaatgagcctccggttgtatgcctgtgcttcgtcaaccgtcattccggtttcgttcgtcatgccggtttcgtttcgaggcgacgattgcatggaggacgcggttctccatgccgtgtcgccgacgacatcgaatccggtcactgtaccgccggcatgcctgacatcgtcatatcggccggtgcgcgtcaccgtgaacgcatgacccgcaagcgtgagattctccccggcgcgaagcgtgatgccgctcgtcgctgcatgcgcgggctccgagcgcaacgcgctgacggacatgacctgcggcaacatggccaacgccgccatgaccgcgaccaccgcagcccgcagtccgagacggccggcgagccgttgcgcgggcggcggcccaatcatgccgcacaggaatccgtcataggcagatgatacagtgaaattccatggttagaagacaacatggcaattctcaagaacacatcaccaagcacattttcgttaccggtggcgtggtctcatccctcggaaaaggcctgaccgcctcctcactcggtcgtctgctgcgcagccgcggcatccatgtgctgcagcagaagctcgacccgtacatcaacgtcgacccgggcaccatgaacccgttccagcacggcgaggtctatgtgaccgaagacggtgccgagaccgatctcgacatcggccactacgagcgcttcctcgacgtgttcctctcccagaaggccaacgtcaccaccgggcagatttatcaggaggtgctgcgcaaggaacgcgcgggggagtacctcggccagtgcgtgcaggtcatcccgcacatcaccaacgagatcaagtcccgcatgcgcgcccaggcgagcgatgatgtcgacgtgatcatcaccgaaatcggcggcacggtcggcgacatcgaatcccagccgttcctggaggcggcccgtgaggtgcgtcgcgacctcggcgccgagaactgcatgttcgtgcacgtctccctggtgccctacatctccgccgcgcacgagctcaagaccaagccgacccagcactccgtgatgatgctgcgccagctcggcatttccccggatgcgctggtgctgcgttccgaccgcccgctcaacaagtccatcaaggacaagatctccctgatgtgcgacgtggatgaggagggcgtggtcaactgcgtggacgcgccgagcatctacgacgtgccgcgcatcctgttcgacgagggccttgacgcctacgtggtgcgcgagctggggctgccgttccacgacgtcgactgggacgagtgggctgacctgctggagcgcgtgcaccaccccaagcacgaggtcaacgtggcgatcgtcggcaagtacatcgacctgccggacgcctacctgtccgtcaccgaggccatcaaggccggcggcttcgccaactgggccaaggtcaacgtcaagtgggtcgccgccgacaagtgcgagaccgaggagggcgcggccgccgcgcttgaccaggtcgacggcatcgtcatccccggcggtttcggcatccgcggcatcgacggcaagatcggcgcgctcaagtacgcgcgcgaaaacaagctgcctgctctcggcctgtgcctcggcctgcagtccatggtcatcgaatactctcgccacgtgctgggcatcgaggacgcgaactcctccgagttcgagcccgactgctccaacccggtcatcgccacgatggaggagcagaaggacatcgtcgccggccacggcgacatgggccacaccatgcgtctgggcagctacccggccgagctggaggaggactccctcgctgcgcagctgtacggcaccacgcatgtcaccgagcgtcaccgccaccgctatgaggtgaacgtggcctacaaggatctcctgcgcgaggggggcctgcgcatttccggtcagagcccggacggcgagctcaccgagttcgtcgagctgccgcaggatgtgcacccgttctatgtcggcacccaggctcacccggagttcaagtcccgcccgaccaagccccaccccctgttcgcggggctcgtcaaggccgcgctggatcatcaggaagcccgtcaggcctgagcgtgtggctttaagagtagactgatacgcgacgatggggatgcccgaaagggcatccccatcgttgtttagtgccggtccggcgatcattgcggagaagtcgcaatataagcaagctcacgttttgcgctaagccaacatgcgggtctgctgtggagttcgccgtgaggttctgctaacttaacgtaggaactatgtgatgaataggaggcagcgtcaaggtgagcgacacccagcaggcgcccaacgccgcgtccgacgtggagatgagccagtatgtggccgatcgccagcgtgtggacgaagagaaactcaaaaaggatgacgagatcatccagcaattcggtgattacacctacggctggcatgattccgacgcggccggcgaggccgcgaagcgcggcatcgatgaacaggtcgtgcgtgacatcagcgcggacaagggcgagccgcagtggatgctcgacatgcgtctgcgcggattcaaggcgttccttgagaagccgatgcccgattggggcgtggacctgagcggattcaacgccgacgacttcaagtactacgtcaagccgatcgacaagcaggccaagacgtgggaggagctgccggacgacatccgctccacctacgaccgactgggcatccccgaggccgagaaaagccgtctggtctccggcgtggccgcgcagtacgagtccgaagtgatttacaactccatccagaaggacctcgccgaccagggcgtgatcttcgtggacaccgacaccgccgtgcgcgaataccccgacctggtgaagaagtacttcggcaccgtcgtgagccccgaagacaacaagttcggcgccctcaacactgccgcatggtccggtggctcgttcgtgtacgtgccgaagggcgtgcacgtggacatcccgctacaggcctacttccgcatcaacacgccggccatgggccagttcgagcgtacgctgatcatcgccgacgaaggctcctacgtgcactacgtcgagggatgcaccgccccgatctggtccgaggactcgctgcacgccgccatcgtcgagatcatcgtcgagaagcatgcgcgcgtgcgctacaccaccgtgcagaactggtcgaacaacgtctacaacctcgtcacccagcgcgcctacgtgcgcgagggcggcacgatggaatgggttgacggcaacatcggctccaaggccacgatgaagtacccggcgtgcattctcgccgagccgtacgccaaggccgagaccatgtccctcggcttcgccggcaagggccagtatcaggacaccggcgcgaagatgattcatctcgctccgcacaccagctccacgatcgtcgccaagtcgatctcgcgcggcggtggccgctccgcgtaccgcggactggtcaagatcgtcgacggagccgaaggctcgtcgaactccaccgtgtgcgacgccctgctggtggacgacttcagccgttccgacacgtacccgcatgtggacgtgcgtgaggacgacgtgacgatggcccacgaggccacggtctccaaggtctccgaggatcagctgttctatctgatgagccgcggccttgaggagaaggaggccatgggcatgatcgtgcgtggcttcgtcgagccgatcagccgcgagctgccgatggagtacgcgctcgaactgaaccgtttggtcgaactgcagatggaaggatcggtgggctgattcccatggcatcgaacaatactgaaatcaccattcccgtcgcggatccgaacgacccgtacgcggtgccggcggccatgccgtcgagcgccgacagggagccgcgctcgttcgacgtgaacgatttcgccgtgccggagcgcaagcaggacgattggcgctacacgccgctcgaccgcatcggagagttcttcgacgtgttcaagccgagcggggagacgaccatcgcgatcagttacgccgatggcaccgcggtcgacgaaaagcacgtggccgtcagccagtgcgccctcggcgaaggagtctccggcacggtctccaagcccagcgatcgggcggccgccgtcgagtggaattccgggcgtaccgcaacggtgatcgagctgtcgggcgagatcgcccagccggtgctggtcaacgtgatcggcagcggcgacgacctcgatgccctgcatctggtcatctcgacggccgatgaggcccacgccgacgtcatcgtcgagcaccacggtctggcccgtctcgccgaaggcgtggaaatcgtcaccggcaagaactcccacgtctccaccaccttcgtgcaggagtgggagaagggctccaagcacgtcggcaaccagcgcatccacgtcggcgagggcgcatccctgcgccactccgtcgtcacactcggcggcgacgtggtccgtatccgcatggatcaggacttcggcggcgagcagggcgacctcaacatgctcggcatctacttcgtcgaccccggcgagcacatcgaacaccgcacgatggtggtgcacaaccatcccgagtgcaagtcccgtgtggtctacaagggcgcgctcgacggcaaggacgcgcactccacctgggtgggcaatgcgctgatcgcgccgaccgcgccgggcaccgactcgtatgagctcaaccgcaacctcgtgctcaccccgggcgcgatcgccgattcggagccgaacctcgaaatcgagaacggcaacatcatcggcgccggacacgcgagctccgtgggccgtttcgacgacgaggaactgttctatctgcagtcgcgaggtatccccgaaacggaggcccgcaagctcgtcgtacgcgggttcttcggagaactcgtcgaagagatcggcgtgccattcatcgccgaacacctgatgaacgtaatcgaccgccgcctcgcccgcggcgaaagcgacgccatgaaagccgtattggaggataagtaacgatggccgaacagcacactctcgaaatcaaggacctctacgcatccgtggagaccaaggagggtcgcaagcagattctcaaaggcgtgaacctcaccgtgcattccggcgagacacacgcgatcatgggccccaacggctccggcaagtccacgctcgcctacacgctggccggccaccccaagtacgaggtcgactcgggcgaggcgctgctcgacggcgtcgacatcctcaagcagacccccgacctgcgcgccaaggaagggctcttcctcgccatgcagtacccggtcgaggttcctggcgtgtcgatgaccaacttcctgcgcaccgccaagaccgaggtcgacggcaaggcccccgccatccgcacctggaccaaagagctcggcgccgcgatgaagaagctgcgcatggacccgaagttcgcgtcgcgttccgtcaacgaaggtttctccggcggcgagaagaagcgcgccgaagtgctccagctcgaactgctcaagccgaagttcgccatcatggacgagaccgattccggcctcgacgtggacgccctgcgcatcgtgtccgaaggcgtgaaccgcgccaaggagagcaccggactgggcatcctgatggtcacgcactacacgcgcatcctcaagtacatcaagcccgacatcgtgcatgtgttcgcagacggccacttcgtcaagaccggcggtcccgagcttgccgacgaactcgaagagaccggctacgacaagtacctgcccgaaggctccgactccgaatcggctctggcctgatttcttcgtttcgttgcgtttgaggtgtggtcgcattgcctgggggtgtactattcccgaccgtaaacttggcccgagcggcctgaagcgatcccgggaacaggacatccctgcaccccgcggccaccgccggaagcatgatccaccgctggaagcggcgagcgaataagcggataactgaaaaacgacatatcggcaggacattgaatctaagggaaacaatggttgattttacggcgattcgggcgcagttcccgattctggatcagcagatccacgggcatccgctcgtctatctggattccgcggccacctcgcagaagccgcagtgcgtgatcgatgcggagagcgagttctaccgcacgatcaacgccggcgtgcaccgcggggcgcatgagctggcggccctcagcaccatggcgttcgaggacgcccgcgcgaaggtcgcccgcctggtcggagccaacgccgaggagggcaacgaggagatcgtcgtcaccgccggggccaccgcgggactgaatcttcttgccaccgcgttcggcaacgcgagtctgggccgtgggggagaggcggcgaaacggttcgctctcaagcccggcgacgagatcgtcgtatccaaggccgagcaccattccgtgctgctgccgttccaggagctggcataccgcaccggtgccacgctcaaatggttcgatctgaccgaagacggccgcatccgctcggataccgccgatgaggtgatcacggaacacaccaaggtcgtcgccatcacgcacgtgggcaacaccacgggtgccatcaccgacatcgcgcccatcatccgccgtgcccatgaggtcggcgcgatcttcatccttgatgcatgccagtcggtgcctcacctcaaggtcgacttccacgcgcttgacgtcgatttcgccgcgtggagcgcccacaagatgtacggtcccaccggggtgggattcctgtacgggcgccgtgagctgttggaggccctgccgccggcgaacttcggtggttccatggtcgagcttgcgtggatggaccagcccgcgcagtacatggtgcctccggcccgtttcgaggccggtacgcagccggtcgcccaggtggtcgcagccggtgtggccgccgaatggctgatgaacgtggggcttgagaacatcgaggcgcatgagcgcacgatcgccgccgaactgctcaagatgggcgacatcgacggcgtgcggattctcgggccgcgcgagaacgtgaaccgcatcggcacggtggcgttcgacgttgcgggcgtacacccgcatgacgtcgggcagttcatcgacgcgcaaggcatcgccatccgcgtcggccatcactgcgcccagccggtgcaccgccacttcggtctgtatgcgtcaaaccgcgcatcctccggcgtgtacaacagcgtcgacgacgctcacgccctggtcgaggccgtggcgaaggtccgtccgttcttcggactgtgatacgtgtcgcgtttacgccgttcgcgtatgactcccacgggatactgtcacggcatgtggcataatatccacggaatctcacgcggacggcgtttcgcgtgttcgtgaatgatatcgagcgctatcgagcgctatgcatgggaagggattgaccgatgggtgatttcggcatgagcggcgacgatcttgagcagatgtatcaggaagtgattcttgaggccgcgcgtgacccgcatggtcgtgagcatttcgcggcggacgtgtccaaggaacagggctccgcgccggccgacacgaccgtgcgcgccagccacgaatactgcacgccgggcgaatcccaccagttcaaccccacttgcggtgacgaggcgacggttcacgccgaggtctccgacagcgagccgcacaccatcgagcgtctggtgtgggacggccacggctgctcgatctcgcaggcgagcctgtccgtcatggttgacctgtgcgccggcaagaccgtcgacgaggcgatggagctgttccgcgacttccatgagctcatggagtcgcgcggcgctggattgcaggacgaggccaaggaagagaagctggaggacgccgtggtgttccagggcgtgtccaagtacccgatgcgcatcaagtgcgcgctgcttggctgggagggcatgcgcgactccgtcgccaaggcgctggcggcgaaataaacggtcaccgcactgccatgagagcggtccgagttggtactcttgatttaacggtttcgcgattaacgactggagagatatgagcgacaatctggttcctgagccgcaggcttccgtgttcgattcggtgagcaaggttctgggcgacgaggaggcggcgcgccgcgtgatggcgaacccgcagcttgcggctgggttccccaacggccatcctgcccccaaaagcgatggcggcgtcgagatgtgcgcgtgcggccgccatccgaagagcgagtgcgaggatggcgagcacagcagcgaggatgacattccgctcaaggccatcgacgatatcggccgtgccaccgccgaggatgtgaaggaggccctgcatcaggtcatcgacccggagctgggcatcgacgtcatcgacctcggtctggtctacggcatcgagatcgatgagcttggacgcgcgatcatcacgatgacgctgacgacgcccgcatgcccgctgaccgacctcatcgaggacgagtgcgcgagcacgctggcgggtcttgtggaggagttccgcatcgactggacgtggcagcctcgctggacgatggacaagatcacgcccgaggggcgcgagcagctggccgcgctcggtttcaatttcgacaacatgccgaagtactgacctcatccgtgtctgcggcttctctgtacagccgaagacacgtgaacgaagacacgtgaatatagttgagggggtttgccgcgaatccggcaaaccccctcaaaacgtatatccgagccgatcagtcgtccacgatggtgcccttcggcacgacggtgatgccttccggcgtcacggtgaagccgcgggcgaggtccttctcggtgtcgatgccgaccgtggagttctcggtcagcacaacgttcttgtcgagaatcgccttgtacacgcgggcgcgacggttgacgatgacgccgtcgaacagcacggagtcgaccacctgggcccacgaatggatgcgcacgttcggcgacagcacggaatgatgcacctcaccgcccgagacgatgacgccgggggagacgatggagtcggtcgcgtggccgagacgatcgcggccggcatgcacgaacttcgcggggggcagcgtgcccgagttcgtgtagatgggccatgcctggttgtagaggttgaactccggcacgtaggcgatcaggtccatgtgagcgtcatagaactgcttgatcgtacccacgtcgcgccagtaggcgtggtcggtcggcgtggagccgggaatgacgttggagttgaagtcgtacacgccggcctcgccgcgcgaggcgaagtacggcgcgatgtcgccgcccatgtcgtgcttggtgtccgcggccttctcgtctttggcgagcgcatcgaacagcgcgtccgtgttggcgacgtagttgcccatcgaagcgaggaacgaattcgggtcgtcgggcaggccttcggtcgtcgccggcttctcctggaattcgcggatcatgttggggtggttcgggtcaacgttgatcacgccgaactggttggactcctcaagcggctggcggatgcctgccacggtgaactccgcacccgattcgatgtgctgctcgaccatctggccgaagtccatgcggtagacgtggtcggcgccgacgatgaccacgatgtcgggctggacgtcctcgatgatgttgatggtctgatagatcgcgtcggccgacccgagataccagtgcttgcccagacgctgctgtgcgggcacaggggagacatagttgccgagcaacgacgagaaacgccacatctgcgagatgtgacggtcaagggaatgcgacttgtactgggtcagcacaatgatatggcggtaatccgaattcaccaggttgctcaaggggaagtcgatcagtctgaatacgccgccgaacggtacggccggcttcgcacggtcacgtgtcagcggcatgaggcgcgttccttcgccacctgccaggacgatggagagaatcttctgcttgttcttcgccatctgagtgctcctctcgttgttcacagcgtctgatgacaccgtctgcctgtccgcccctgcttcgttgccggagcctacagaaacaataattgcacatttccccgtgagcgcaaggaaatggcgttgcgcgtcatgaaaaagtcatgaaaaatatccgatctgttcttattgttccgcgcgcttcggggatgtcgcgtagaaggcgacggcgctggacgcggcgacgttgaggctgtcgacgccgtgggacatcgggattttcacggtcaggtctgcgcccgcgatggtgtgacgtgacaggccgtcgccttccgtgccgaagatcagcgccagtttgtcgatgtggtccgcggattcgggactgttgttcagccggcgtgtcagctcgtccagcgatatcgagtcgtcgctcagcgccatcgccaccgtggtgaatcccagcgagcgcagttcctccagtcctcggcgcggccagaaatgcttgtcgtcgcctccgatgcgcgtccacggtatctggaagacggtgcccatggacacgcgcgcggcgcgccggtacagcgggtcgccgcacgacggggtgaccagcaccgcgtcgacatccaacgcggccgccgagcgcatcagtgcgcccacgttggtgtggtcgacgatgttctccatgaccgccacgcggcgagcgtcgcggcatgtctcctcgacgctcggcagcggccagcgccgcatcgccgaaagcgcccctcggtggaggcggtatccggtgagctggcgcagttgttcgggggaggccacgtatacggggatgtccgttccccaccgtttgtcgacgacgtcgaaggtctgtgacatgccctcgatccacggctcttcgaccagcagcgagatcggttcgcggcccgcggcgagcgcgcggtcgatgaccttgggcgattcggcgatgaacaggccacgctcgggttcgagccggttgcgcagctggatttcggtgaggttcgtgtatgcggcaacccgctcgtcgtcgatggagtcgatggtgatgaattgcatgggcgtgcctcgggttctcatgtcgtcgtaccgtcgtcggcccgattgcgcgcggccgtctgcgcatacggtatgtatatatggaaagaccccttgtttccaaggggtcttcgctggtgtccgggatgggacttgaacccacacgcctgtataaaataggcacaagcacctcaagcttgcgcgtctaccattccgccacccggacaggtgtcgttttcagacaacgaatagatactatatcggtattttcggatgatgccaaatcatggcgtgtcgcctgtgtttgcggggatgttgtagccttgtatccatgactgatcctgtattccttttcgaccctgacaccgatgatgtgccggtgaacggcgatggtctcaacgcggggtggacgatcacgctgccggcctcggtgaagcgccatgccttgggggccatgcgcctcgccgagggcgacgggctgtcgctgaccgacggtcgggggctgtgcgtcaagaccacgctcgtcgacgcgcaggccggtctcgtcagcgtcgagcgcgtcgggcggcagccgcagccggtcacgcggctcgtgctcatccaggcgctggcgaagaccggtcacgacgaggcggccatcgacatggcgacccagatcggcgtcgacgaggtaatcccctggcaggccaatcgttccatcgccaagtggaaggcgggccgtactgatcgcaaatggcggcaggtcctcgacgcggcgaccgagcagtcgcgccgcgtgtggtcgccggaactggcgcagtgcgtctcaagcaagcaggtagttgctatctgcaggcgtgcgtgcgtgcatggcgatctggtgatcgtgctgcaccaggacgccaccatgtcatggtcgtccgtggaggacgaggtctcgcggctcgccgaccgttgtctcgccgacgggcggccgcgcagcatcaatgtcgtcgtggggcctgagggcggcatcagcgagcaggaggtgtccgatttcgtcggggccggcgcccagagcgtggtgctcggctcgaacatcctgcgcgcatcgacggcgggcccggtggcgctgtcgctgctgtcgagggcgttggggcgtttcgcgtgaagccgagaatatcctcaatacgcaatagcatggaagcagatttccatcacggccagcaaggagcggcgagcatatgagcaagtccgaggactgcctgttctgcaagatcatcgacgggcgtattcccagcgagaaggtatatgaggacgacaccacatacgcgttcaaggacatcaatcccaaggcgaaggtgcatgtgctgatcgtgcccaaggaccactacgcgaacgtcgccgagctggccgccgccgatcccgcggaactggcccatatcgtcgggctcgctcagggcatcgccgacaaggagttctcgggcgcgtaccgtctggtgttcaacactggcctcgacgccgggcagaccgtgttccacgtgcacgcgcatgtgctcaccggcgagaagctcgacgagtagggcgattcgtgacaacgacgacccgtaccatcaccatcccgtcgcagcttgacccggtggccgtcttcggcccggtcgacgaggtcatccggcaggtcgagcacgcgttccctgacctgaccatcatcgtacgcggcgacagggtggccatcgtctcccattcgaagtccaccgaatcgcaggcctctcgcgccgaagacgtcatccatacgattatccaggccgcgtacagcgccccgatggacgccgacaccgtgcgcaggctgctcgaccaggacgtgctgcccaacaaggtccgcgccgaacaccccggatacggcaggtccgccgagcggggccgtgcgtcgctcggtgcagcgcgttcaggggatgcgcgcaagcctcgcatacccggcgtcatcactttcgcggccgggcagcccgtgcgtgccaagacggcggggcagatcgcctacgtcaacgccgtggacgcccacaccatcaccttcgcgatcggcccggccggcacgggcaagacctacctcgccgtggccaaggcggtgcgcgcgttccaggacaggcgtattcgccgcatcatcctgacgcgcccggcggtcgaggcgggggagagcctcggtttcctccccggcacgctcaacgacaaagtcgacccttatctgcgcccgctgtatgacgcgctgtccgacatgctcggccccgaccagctgcaccgctatctcgacgacggcaccatcgaggtcgcgccgctcgcgtacatgcgcggacgcacgctcaacgacgcctacgtgattctcgacgaggcgcagaacacgacggaacagcagatgaagatgttcctcacccgtctcggattcaacacgacgatgatcatcaccggagacgtcacgcaggtcgacctcgccgtgccacgatccggtctggccaccatcgagggcattctgggcggcatcgacgacatagcattcgcccatctcgacgccggggacgtggtccgccatgagctggtcgggcgcatcgtcgaggcatacgaccgtcatgacgccacccgtgtcaggcgcaaccgaggcaaggaatcgcgggaggacgcacgatgagcgtggaagtgaccaacgagaccatctgggacatcgacgcaaaggcgttctccgacctgggcctgtgggtgatggaccagatgcgcgtgagtacccagtccgatctgaccatcctgttcgtggatcccgatcccatagccgagctgcatgagcggtggatgtcgctggaaggcccgaccgacgtgatgagcttcccgatggacgagctgaggcccggcgacggcaagaccacgatggagggcgtgctcggcgacctcgtcatatgcccctgggtcgcggcccagcaggcggccgcggcaggtcacagcaccatgcaggagatgatgctgctcaccattcacggcatcctccacctgctcggctacgaccatgtcacgccggagcaggaaaggcagatgttcggtctgcagcggcagctgctgctcacgttcctggccgtgcgccgcatcaccatcgaaccggccacattgccgaagggcgcggccgacgcgcttgccgaatacgacgcgtcgcacggcggcggacggcagataacggaatgacgcgtcttttccccgtcgccgttcggcggcaatgccgtcaccggcgctgaacacatgaactcaaacgaaggattcctatgccgttgaccgatacgtccacgattatcctggttgtcgcgttggtcgtcgtcgccgcactgctggtctggctgtcgttgagcatggccgccgcggaaagtgcggtcgggcgcgtcacacgggcaggactgaacaacaagatcctcgaagtgcagaccgacaccgagacgagccagttcatccggatgaagaagatcggcaaaatccataccgtgcagcggctcatcgccaaccggtatgccacctcgggcagctgcgcgttcttccgcatcacatgcaacgtgttcgacggcgtgctggtggcgtgcgtggcgtcgctgcttgatgcgccgatctggctgcagctgctgtgcggcttcctgttcgcgctgatcgtcggcatcgtctcggtgctggtccgcccgcggtccgcgggagccagcaagccgatcgacatcatgctcaatttggcgggactggtcaggttcgccaccgcgatcacgccgtttgcgaaggcgggcgagcagaagggtcagaagcgtcgctccaaggaatcggacctgtccgacgacgaggagctggagaagattcagctcgaacaggggcgtgccaccatcgaccgcttggtggaggccaatgatttcgatccggaagtctccgagatgctgcgcaacgtgctgacgttgtcggagacgctgacccgcgagatcatggtgcctcgcaccgacatgatctgcatggaccgcacggccacacttgccgacatgctgcgtctgtgctcccggtccggtttctcccgcgtgccggtgatcggcgacgacgtcgacgatctgatcggcgtggcgtatctcaaggacgccgtgcgcgccacggcgttcaatcccgccgcctcgcagcgcgatgtcgcctccattgtcaggcagccgatgctggttcccgagtcgaagccggtggatgacctgttccacgccatgcagcagacccggcagcatgtggcgatcgtcgtcgacgaatacggcggcatcgccggactggtcaccatcgaggacaccatcgagcagatcgtcggcgaacttgaggacgagcacgaccgcacgcagcattccgagcccgagaagatcggcgaacgcaagtggaagatgccggcgaggactcccatcgccacccttgaggagatgttcgagatcgacatcgacgaggacgacgtcgacaccgtatatggcctgctcaccaagctgctgggccgcgtcccgatcgtcggctccagcgcggtgacgcgcggcctgcgcctcaccgccgtcgacacggcaggccgacgcaagagggtgtcgatgatcgtcgtggagccggcggccgggtcgcagggtcccgcagccgacgacgatgagccccgcagcgacgaacaggacggcgagtccgcctccccgcaaggcaaatgacggagccgtccgcccaatgacaaggtgaaccgctaccgtagagaaacaatgaccaaaccgaacgcgaagaaaaggcatgacacgaatatgaccaatactgacgagcaggaatcccagccggcgtaccgttccggattcatagcggttgtcggcagaccgaacgtcggcaagtcgacgctgatcaacgcgctgatcggcaagcaggtggccatcgcctcatcgcgcccggagaccacgcgaaaggcgattcgcggcatcctcaccaccgaccatgcgcagctcgtgctggttgatacgcccggcatccaccgccctcgcacgctgctcggccagcgtctcaacgacatcgtcgaggaatcgctgtcggatatcgacgccatcgcgttcctgctgcccgccgaccaggagatcggccccggcgacaagcgcatcctaagccgtctgcgcaccgatttcgccaccaagggcgaggacgggacgttcgcgtggaaggttccgctgatcgccatcgtcaccaagatcgaccagctgggccgccagcagctcatcgacaagctgatcgagatcaatgagttcgctgacttctccgacatcgtgcccgtcagcgccctgggacacgacaatctcgacgaggtccgccaggtgctgatcgacaacacccctgaggggccgcagatgtacccggacgaccaggtcagtgaggagcgtccggaagacaccatcgccgagctgatccgcggcgcgttcctcgaagagcttgatgacgagctgccccattcgctggccgtcgtcgtggactccatcgaacggcccgaagacaacgagagcgggcagtcatacgaaggcaagatccaggtcatggtctccgtgtacgtggagcgcgactcgcagaagccgatcatcatcggacgcggcgccgagcatctggtgcgcgtcaagaagaagctgcgcaccccggtcaaccgcatcgtcggaggcaaggccaagctcgatctgcatgtcaaggtcgccaagggctggcagtccgaccccaagcagctggagaggctcggcttctgattgcgcgccgcgcgggcgttggcaccgataaaacggcgtgaggcgggtggttcaacaatcgtgttgaaccacccgcctcacgcgtgaaggatgtcgagcgtcacttcttcttggtgtacatctgcgtgttcagcagtgtggcgtaacgccggatgaccttgggtcggatcaccttcatcgatgcggtcagcaggccgttcgcctggctgaactcctcgggcaggatgatgaacttacgcaccgattcggcgcgggacacaccctcgttcgcctgatccacccacttctgcacttcggcgcgcaccgcggcgttggaggcggcctcctccatcgtcatatcgcggttgaggcccttggattccagccaggggcgcagcgactcctcgtcaagcgtcaccagcgcggagatgaacgggcgcttgtcgccgagcaccagcacctgcgagacgaactcgcagcgctggatgacctcttcgatcgggccgggagcgacgttcttgccgccggcggtgatgatcagatccttcttgcggccggtgatgtacaggaagccgtcgttgtcgagcctgcccaggtcgccggtgcggtaccatccgtcatcggtgaacgagccttcggtcgcctcctcgttcttgtggtacttcgggaacaccgcggtgcccttgacctgaatctcctcgtcctcggcgacacgcagctcgaacccggggaaggcgatgccgacggaaccctgatggtacggcacgccgagtgggttgaacgcgcacggcgcggtcgtctccgtcagtccgtagccctcgtacacgggcacgttcgcgccgcggaagaacgcgagcagttcggggtccagcggggcgccgccggcgacgatccactgggcgcggccgccgagcacgtcgcgcagcgtcttgtagacgatcgggttgaaggcggcgcggcgggtcttggccagcacaccgaccttgcccttggcacccagctccttcatgtagttctgcgcggcgaccaccgcggcggcgaacgccacgcccttcggcccgtggccggctttctgggacgccgcgttgtacaccttctccagcacgcgcggcacgacgatcatcacggacggccgggcgacctgaaggtcggcgatcagcgtcttgataccctgggcgatgtagatcctgatgttgctcgccacgcagatgtagttgatcgcgcgggcgaacgagtgcgcctgcggcaggaacagcagcacggagttcttcttgttgtgcagcaggtccggcatgtagacgggcaggttcagcgcggtcgtgcagtagtgctcgtgcgtcatctccacgcccttgggtgccgccgtggaacccgacgtgtacacgatggagcacaggtcggtcttcttgatcgagtcgatgcgctcgtcgagctcctcgtcgctcaccgcggtcccgtacgccttgatctcctctaggccgccggtctcgatgcacaggatggtctccagcgacgggcattcctcgatcgcgccctctgccttgtcgcgcatgtcggcggtcccgacgatcagcagccgcgcgtccgaattgttgacgatgttgcggatctgctcggcggagtcggtgtcgtagatggtggcgagcacgccgccgcaggccatgaccgcagcgtccgtgacatcccacgcgtaggaggtgcggcacatgaacgccacgccgtcgcccttcttcagcccgtagtgcagcaggcccttggcgacgctgcggatgtcggcgagcgtctcgttcgctgtgctggtgacccacttgccggagtcgtccttgtaggtgtacagcggctcgtcgcccatgcgttcggcgcggtccgcatagatgtcgtagatggacatgccctcgtcaagtggcgggttgccctcggtcttcgtggtgagcaggcccgtcgtgctgtcgatcagcgtcgtggtcgggtatcctggcccccattcggcggtgttcgggaggctgacctcgccgttcgcggcaagagcgtcgttctccgcgtaatccgggccgttggaggaatcgtcgccgatcgggtgcgcgaagtcacctcccaaacgaagtgccttctgcgtgatattcgcagcttgctgtcttactgaggtgaacaatgacacgtgacgctccttggaggcctgataatgcttaacacataaatattacccgtaaaaacgcctcttttcaccttacggtagcgtaggaaacagcgtcgtgcgggtcgcccgctcgcccgcggccattcgtcaggtgaaacggaacgcgccaaaagtcgattccttcggtacacttgcaacggtaagcaaagaacgcttgagttcgacgaagaaagggctctcatggctgaaacccagaaagccaccgtggtgttcggtgtcctcaacgagacatcgcaggacgaaacccgcgtcgcattgacgccggatatcgtcacacggttgaagaaagcaggtgtgtcctgcctggtgcagagcggcgccggaatcgccgcacaatataccgacaatgattacgccaaggcgggggccgaggtcgtcgccgcggacgatgtgatcgcgcgcgccgacgtgctcggattcgtggaccgtccgtctgccgagacggtcgcgcggctcaaggccggcacgtgggtgatcggcatgctcggctcgttcaccgatgccgcgtatgtggacgccctccaggcggccggtcttgtcggtgtcgcgatggagaagctgcctcgccagctcagctccgcgcagtccatggacgagatgacgtcccagaattcggtcatggggtacaaggccgcgctggtggcggcgaacgcctatggctcgttcttcccgatgatgacgaccgccgccggcacgatccgcccggccaaggtgctgatcctgggcgcgggcatcgccggcctgcaggccatcggcaccgcccgtcgtctgggcgccgtggttaccgcgtacgacgtgcgtcccgcttcgcgcggcgaagtggagtcgctgggcgcgaagttcctcgatctcggtctcgacttctccaaggggcagggcgagggcggatacgcccgccagctcagcgccgaggagcaggccgcccagcagacggccgtcgaccagaaggcagccgggttcgacatcatcatcaccacggccaaggttcccggtcgtaagcctccgatgctgctgaccaaggccggcgtggacggcctcaagcgcggtgccgtcatcgtcgactgtgcggccagcgacctgggcggcaatgtcgagggatcccgcgtcggcacgcaggtgaccgatgggggagtgaccatcatcggtgccccgtatctcgccagcgaggtttccaacaccgcctcgaacctgctcgcccgcaacgtgggcgacgtgctcgcccacttcgtgcatgacggtcgtctgagcatcgacctgaacgaggaacttgacgacgccctcatcgtagccggacgtcccgccgcagaaagcaaggaataatccatggacatcatcgttgccatcacactgttcatactcgcgctgctcatcggcgtcgaggtcatcggcaaggtgcccgccaccctgcatacgccgctgatgtcgggcgccaactccatccacggcatcgtcatcgtcggtgtcgtcatcgtcgccgcgcacgccacctcgctcctggcctgggtgttcatcttcctcgccgccgtgctcggcacgatgaacgtcgtcggcggttacgtggtcaccgaccgcatgctggagatgttcaagtctgacaaatcgaagaagtccgccgacaagaatgaggaggccaagtaatgggtacccttgctgaagtgctgagcaacccgcttggcgtcgttgaatggttcgtgtatctgctggccgccgtgttgttcgtcgtcggcctgcacatgatgaactcgccgaagaccgcgcgcaagggcaacctgatctccgcggccggcatggtcatggcggtggttatggcgttcatcgtgctgttcgtcaccgagatcggcaacggcttcgagcatctcgtcgccgtcgtgctgctgatcgtcggcatcctcatcggcacgatcgtcggcgtgtggagcgcgaagaaggtcaagatgaccgacatgccgcagctcgtctccgtgttcaacacggtcggcggcggcgcggcggccctcgtcgcgctcaacgacatcctcacctccgaggagctgccgacgctggtcgtgctgatcaccgccggacttggcatcatgatcggttccgtcacgttcaccggctcgctgatcgccgccggcaagctgcagggcgtcaagttcctgcgcaagctcaccctccccgcgaagggcgtgtggaacatcggcttcattgtgctcaccgtcgtctcgttcgtcatgctgtgcgtgcagcccgagcagcgtctgctgtggtgtgtgctgaccacggtgttcgcgctgtgctacggtctggtgttcgtcatcccgatcggcggcgctgacatgcccgtcgtcatctcggtgcttaacgcctgcactggcaccgccgtcgccatgagcggtctggcgatcaacaacatcgcgctgatcgtcgccggcgcactcgtcggcgcggccggagtcacgctctccctggcgatgtccaaggccatgaaccgtccgctgatgagcgtgctcgccggcggcttcggcggtggcacctcggccggcggcgacgccgacggccccgagggcacgatgaaggagaccagcgccgatgacgtcgccgtgcagctggtgtacgccgacaaggtcatcttcgtgccgggcttcggtctggcgcaggcccaggcgcagcgcgagctggccgatctgggcgacctgctcaagggtcatggcgtcgaggtgtcgtacgcgatccacccggtcgcgggacgtatgcccggtcacatgaacgtgctgctcgccgaggccaacgtgccgtacgaggagctgatcgacctcgacgatatcaacccgcagttcccgtccgccaacgtggccctggtcgtcggcgccaacgacgtgaccaacccggccgcgcgtcgccccggcaccccggtctccggcatgccgattctcgacgtcgacaaggcgcagaacgtggtcgtcatgaagcgcggtcgcggcaagggctatgccggcatcgagaacgagctgtacttcgagcccaacacgcagatgctgttcggcgacgccaaggccggtctgcagtccgtcatcgccgccgtgaaggagctcatctcgtaaccgtcaccgcactcggcccgccgggccgaacggagcgaaacgatacgggagtggcccgctggatggatttccagcgggccactcccaattcatattcagctcggcggagtgcatggcggcttcggccgggaagctgccatcagagtccgaacacgcgggtgacgaaattcgtcaccgtcttccagtacaccaccggtgccgtgctggcgctcatggaatgacctgccgagggaatcagcagtttctgccggtcgatgctcgcacaggcgtcgaagttctcgtccaaagccctggacggcacgaaatcgtccgcgccgccgtggatgaacagcatcggaatcgtggcatgcttcagctgttccacgcacgaggcttcctggaaaccgtacccggcacgccgccgcgcgatcgcccccatcgtcgtcacgatcggcttggcgaggaacttcggcaggtgaaacatcgaccgcgcgcagtcgatgaactgctggccgaccgacgcatagccgcaatcctcgaccgccgccacgacgtttctgggcaggtccggctcgccgacggtcatcatgaccgcggccgcgcccatggacttgccctgcagcaggatgcgggcgtccgcgtcgctgccgatgatcagcgatatccaccgcatcaggtcacggcggtccagccatcccatgcccgcatagcggccttcgctgagcccgtggccgcgcagcgccggaaccagcacggtgaacccgagacgggcgaaacgatgcgcgtacttcgccatatcctgcggttgccccgaatacccgtggcagcatatcgcatacaggtggggcttcgcaccggcgcaatcgggatcgaacagccagccatgaagctggatgccgtcctccgccgagatgaccaccggctgcttggactggtcgaaccaatccgccgcctcgacctcttcggccgcgtcgaggcggggtcccttgtccgcgactttgccgtcatccccgccggatctgagcatcgagtgcttcgcctgtgcatccagcgcatacgagaacatgagattcgccagcccgtaagtggcgccggctaccacggaggctgcgattccgcctccaactactatccgtgatgtgttacgcgccattgcaaacctcccagctgattcggtgcatgtcccattgcgtccattgtagggcctcgccggggttgatgacggcatgacgacgaaacagccgggcggatcgggcgttcgattcgtttgccgggatagacgttccatcgaatgtcccgcgcggccgtataattgtttctcgttgctttggcgagggcattccgattcgcgagaacgggtctgccgtaatcgactcggcgttgaataccacccctccttggggagttctgcggcgcgtcgtggcgtcaaatagacagaacgacaagtaacactcaaggagaaccattatggcaaacaccatcaagatcgccggtgacatccgtgacgaattcggcaagggcgctgcgcgccgcatgcgcgtggccaagctcatccccgccaccttgtacgcgggcggcgaccagccgacgttcgtgaagctcccgatgaaggagaccacgctggccctgcgccacacgaacgcgctgttctcgatctccttcggcggccagaccaagctggccgtcgtcaaggatgtgcagcgcaaccccgtcaagcgcatcgttgaacacatcgacttctacgaggtcaaggccggcgagaagatcgacgtcgaggtgccggtgttcgtcgaaggcacgccgaagggtgccgccgtcgcgttcgtcgacctgcaggagctcaaggttcgcgccgatgtcaccaacctgcccgagcgcatcgtggtcaacgttgacggcctgaccgacggcaccaaggtgctgctcaaggacgtcgtgctgccggaaggcgccgagctcgacatggacgatccggagacctccgtcgtcagcgtcgaggtgcctgaggacaccaccgagtccgctgctgccgctccggccgctgacgccgacgccgctgctgccgctccggccgccgatgcggacgccaagtgatccgtctcgcatagcacatcggattcccgcgtgacacacgggagtgacgcttgagaaaagcccaccacaagcgtgggcttttttcataatgtgaacgagctcacgccgaatgcgtcatcggtgtgagaaagtatccctcagagccggtgccagaagcgccgactgccccatctggccgccgtgacgcaaacggcgacgttatcaaagaagtggttatgacagaaaacaatcatcacgattccgccgcgctggacaagctcaccgagccgttcaccgtgctgccgaacgacaatcccgcatccgacgcgaagcgccaggagctcatcgacaagccggcattcggccaggtcttctccgacaacatggcccacatgagctggaccaagggcgagggctggggcgaccgtcgcatcgagccgtacgcgccgctgaagctggatccgggcgcatccgtgctgcactacgcccaggaggtcttcgaaggtctgaaggcataccgccacgccgacggctccacctggctgttccgcccggacgcgaacgccgagcgtttccagaactccgccaagcgcctgtacctgcccgagctgtccgtggacgacttcctcggctccgtggcggccctcgtcaagcgcgacgtcaactgggtgcccacccgccgcgagtacacgctgtacatgcgtccgttcatgttcgcctccgagccgttcctcggcgtgcgtgccccgcacgaggtcgactactgcgtgatcgcctccccgtccggcccgtacttcccgggcggcgtcaagccggtgagcatctgggtggaagacaagtggttccgcaccggccccggcggcaccggcttcgccaagtgcggcggcaactacgccgcctcgctgctcggcgaatacaccggcatcgacaacggctgcgagcaggtgtgcttcgtggacgccgccaccaagacctaccttgaggagctcggcggcatgaacatgatggtcgtgcacaaggacggccacgtggagaccccgtccctgaccggcaacatcctgccgggcgtgacccgccgttccctgatccagctcatgcaggatcgcggcatcgacgtggtcgagacgatgatcaagctcaccgacctgctcgacgacatcaagtccggcgaggtcaccgaggtgttcgcctgcggtaccgccgccatcatcaccccgatcggccgcttcaagtccaaggagttcgacgtgaccgtggccaacggcgaatccggcaagctcacggtcgacctgcgcgaccagctgctcggcatccagctcggcgaggtcgaagacccgcacaactggatgtggaaggtctgctgagcgcagtccagttctacgtgaagccccgcccatcggctcgatcgagcccggcggggcttttcgtatagaacccgctcccgctggcgggagctgtcgagcgtagcgagactgagggtggtgtttatatgcccataaggattgcctgcggcagctgcgttgccgtcatctgcacgcggccatcggcaaccatgatgactggtggatggacaacaagccggcgctgaacctgttcgagagcatcgaaccgaacggcaccgttgaactggaaggacttggaacggtcaacctgtcgcacttcccatatcgcgaagacctcgcgtacggatggcccgatgacgcggtccgattccacgatcaggcgctgccgttcgacggacgcaagctgctgtacggtcacacgcatcagctgtctcccgcgggtgcacggccggaatcgctcgacgccggctgggatgtggtctccgacgcgcagcatgcgaacccggagtatgcgaatgagctggcgcggctcgccacacggcacggggcaatctggctgacggaggatttcgacgtgcccctggacgagctgctgcgccgcaacgaggcccggccgcgcgccgaccatgtgccggaggagtacatccgctcgtcgtggaagcggttccaccacgtgatgttccgcccgctcaatcccgaagacccgaacggcaacctgcttaaacgcatgatcgccgacccctacgtccgggtcactccggtgcgcggcgagagcgacgtattcgcctgcaatttcactcgagaggcgttcctcgaaggacgttggaacacgcgcacgatcaacgcccgcgggctctgaagtatgacacggtggtcgcgcacggcgacacatccccgggatcgttccccgtgcgcgaggagcgcaaggagaacggcatcgacctgacctatgagcgacagacgttcaaggaacgcgacatcggatcaaggtcggcgagatcctgacccggatcggagccgattctagtttcgggtagccggcttgcggtaggctcatgtacggccggatggttgtgatgttggcgaggagtggcgcgtggagggactggcactggaaagcaatgcctttttcatgggcatcgaatatcttgcggtgttctgcagcgggctgatgggcggtctatgcgcggttcgcaagaactatgacctgttcgccatgctgatcaccgcgtggctgaccgcgttgggcggcggcatcatccgtgacgtgatgctcggctccctgccgccggtgggcatctccgaccgcgggttcgtgctgaccgcactggtgtcgggcctggctatcgccgtgatccatcctgaagtggacaagctcagatggtcgatgctgaccatcgacgccttggcggtcggcttgttcgcggtgaacggcacctcgaaggcgctcgatttgggaacctccggcatgacggcggtattcatgggcatgttcaccgcgctgggcggcggtctggtccgggacatgctcctgaacgacgtgccgatgatcatccgtgacaagcacctgtacgcggttccttccgcggtcggatgcgtgctcaccgtgttcgtgtgcaggggagtgcaatggaagatgctggatttcacggccgaggtggtgctcgactgcgcgatcgtcgtgctggtcgtggtcatgcgtctgctgtcggtcaagttcagcatcatgcttcccggtgcggtcaagcggcacaacacgtatcttcccagcgagtcgcggtatctgaaacgcccggtcatccatcctgatgcccacgatggcggcgatgacgacaaagaccagtctcgggcttgacgctttcggaccacccccacccgcttcgcgggagcccccgctggcgggtgggggtggccggctaacacgaaagaacccccgggaaccttgcggttccgcgggggtcttatgctgtgacgaccgtcagacggtcatgctcacatgttgttgatggcgactgccatgcccgacttgcggttggcggcctggttcttgtgaatcacgccagcgccagcggccttgtcgagcttctgggaagcgaccttgtaggcggcttcggcagcggccttatcgccggcggcgatggcctcacgggttgcgcggatggcggtcttcaggctggacttgacggccacgttacgcttgtgcgccttctcattggtgagcacgcgcttcttctgcgacttaatgtttgccacgttttctccaaacgacgtttgctataaggacatacagggagtcatgctaccacgatgttcggataaaaccgaccccgtgttccgtgtgtcgtcgggaaattgccgacggtgaccggtaaacttggtgacttgcggcacatggcgtcacatttacgatgccaaaggcccgcgacgaacgagcaccacggacgaaaggaaccggatcagggtgattgagccgaagaacaagccagggtttaccgatcagtcgctaatccggaatttctgcatcatcgcacacatcgaccacggcaagtccacggtggccgaccgcatcctgcaactgagcggcatcgttcctgagcgcgagatgcgtgaccgcttcctcgaccgcatggacatcgagcaggagcgcggcatcaccatcaaatcgcaggccgtgcgcgtgccgtggaccttcgagggcaccgagtacacgctcggcatgatcgacacccccggccacgtggatttcacgtatgaggtgtcgcgcgcgctggccgcatgcgagggcgcggtgctgctcgtcgacgcgacgcagggcatcgaggcgcagacgctgtccaacctgtacatggccatcgaccatgatctggccatcatccccgtgctcaacaagatcgacctgcccagtgccgagccggacaagcacgcggaggagatcgcgggactgatcggatgcaagccgagtgacgtgctgcgcgtgtcgggcaagaccggcgaaggcgtcgccgatctgctcgaccatatcgtcatggaggttcccgctccgcacggcgacccgaaggcgccggcgcgtgcgctgatcttcgactcggtgtacgactcgtaccgcggcatcgtcacctatatccgtatggaggacggtgagctcaagtcgcgtgagaaggtgcacatgatgggcatcggcatgacgcacgagcccatcgagattggcgtcatcagccccgacatgacccccaccaaggcgctcggcgccggcgaggtcggctacatcatcaccggcgcgaaggacgtcagccagtccaaggtcggcgacaccgtgacctccgccgtccgccctgcagccgaggcgctgcccggctatcgcgacccccagcccatggtgtacgcgggtctcttcccgatcgacaacgcccagttccccgaactgcgcgacgcgctcgacaagctcaagctcaacgacgccgcgctcatctacgagcccgagacgtcggtggcgctgggcttcggcttccgatgcgggttcctcggcttgctgcacatggagatcgtctcggagcgtctggaacgcgagttcggtctcgacctgatctccaccgcgccgaacgttccgtatgaggtgaccgccgaggacaacaccgtgcaccgggtgaccaacccgagtgaattcccggacggcaagatcaagaagatcgtcgagccgatggtcgctgccgacatcatcacgccgaaggatttcattggttcggtgatggacctgtgtcaggaccaccgcggcatcatgggcacgatggaatacatctccaccgaccgcgtggagatgcactaccgcatcccgctcgccgagattgtgttcgacttcttcgaccagctcaagtcccgcaccaagggctacgcgtcactcgactaccatgaggacggcgagcaggccgcggacctcgtcaaggtcgacatcctcatccagggcgagaaggtcgacgcgttcagcgccatcgtgcatcgcgacaaggcatacagctacggcgtgatgatgaccaagaagctgcgcgagctgattccccgccagcagttcgagatcccgattcaggcggcgatcggatcgcgcatcatcgcacgcgagaacatccgtgcactgcgcaaggacgtgctcgccaaatgctacggcggcgacatcacccgtaagcgcaagctgctcgaaaagcagaaggccggcaagaagcgcatgaagatgctcggccacgtcgaggtgccgcaggaggcgttcatcgcggccctgtccaccggcgaggccggcaacgaccgcgacaccaaggataagatccgcgccgcgcagaagacggaaggctgatggaggtctttgatatgcccccgctggcgggggctgacagccgaaggctggctgggggtggtccagcgaatgaccgccttcagccggctacgccgacaacccccgccaacgcgggcgatgcggcaggctacgaaatctacatccatgtgccgttctgcatgcggcgttgcggctactgcgatttcaacacatacacggccacggacatgggcgcgggcgcgtcccgcggcaattacgcgaacatggtggtgcgtgagatgcgtctcgtgcgcgattggcagctcgtgcacggcatcgaggagccgcccgtctccacggtgttcttcggcggcggcacgcccactattctgccggcgcgcgatctggtcatgatgctggacgcggtccgcggcctgtggggcatcgaaccggaggcggagatcaccaccgaggcgaatcccgacacggtcgacgagcgctatatcggcgcgcttgcggaaggagggttcacccgcgtgtcattcggcatgcagtcagccgtgccgcatgtgttgaaaaccctcgaccgcacgcatacgcccgccaatgtggaggccggtgtcagggcggccgacagggccggcctgcgctccagcgtggatctgatctacggggcgccgggggagagccttgacgattggcgagactcggtgcgcactgcagtcgatcttggcgtgaaccatgtctccgcctatgcacttaccgtggaaccgaccacgaagatgggtcgacagatcgcggcgggcacattgcccaagcccgacgatgacgacgaggcagcgaaatacgagatcgccgatgacctgttcgccgcggcgggcctagaatggtacgagatctcgaactggtcgcgcccgggctatgagagccggcacaatctcgggtattggcgcaacgccgactgggccggcctgggccctggagcgcacagccattacaacacggttatgggcagctccacagacggtgacgccgcgaacagcgacgccgctggagacgtttcggcttccgtaacctccacatcgctgcgcggctgggacatcgcgcatccgcgtatgtgggggatggccatcaacgacgggcgcgtgccgtggtcgggcgatgagaccatatcgcccgcggagaaccttgaagagctcatcatgcttggccttcgcatccgggaaggactcgacatcgaccgcgtcaatcggcatatcgaagcggtgaaccgtgcgcaagatgcggcgcagggaacgctgcgcatcatcgacgacgcgtgcctcacgccactggtcggggatggcctcatcaccctcgacccgacgacgggccatgccgtcgccacgaggagaggccggttgctcaacgacgccgtcatcgagcgcatgttcggcgcggtcggcctgtagtggctccggcagtgaaacgtcgaagcagaccttgaccgtgccgaacttcaccttgctcacgatggagaatgcgtcacccaggctatgctggagatcggcgaggttccgaggtcgcttttcgtgatgagtgcgatgccgaaggattcgatggcgattcccgccagaaagcatatcagccgcttgatggaatacggcatgaatcatgactcctttcgtgtgttctgcccgatgtagtgctggaaggcaggtcgacgggatgcctgttgcgtcaggcttgaagattctcgattaccttgcgcagagagcttcgcagtctctcgcgttccgccgcggtctcgtaccgtgcagcttcgctgccgtgctagcaccttttggtttgtaagcaaactaaatatgtccatcggagaaaagttcaatacagataaaattgaactcaggttgttttgctgacaaagccgtgatattcttttgaaccagaatttgaactttgaaccaacgtgaattgaggaagtcattggagagcttcgcgacgcggctgagaaccgccatgaacgcccgtcacctcagacaggtcgacatcgtgcgtgccgcccaggcgtcaggtgtcaaactcggcaaaagccacatcagccaatatgtcagcggcaagacgacgccccgcgcggatacgctcaggttcctcgccgatacactgcaggtcgacgggcaatggctgctcggccatgatcgcggacggcccgacatgccggcgcagccgaaacgggtgccggacaatcccggcggccgggccgacgcgccacgcacgccatcatcccaagcgcccgcaccccagacaacgtcaccatcacacgaaccggaaggaacacccatgcgctacttcaacaaatccaccaaacttgacaacgtgctgtacgacgtgcgcggaccggtcgtcgacgaggccgcccgcatggagcagtccggcatgcacgtgctcaagctcaacatcggcaaccccgcgccgttcggcttccgcacaccggacgaggtcgtatacgacatgtcccggcagctcagcgacacggaaggctactccgcgtccaagggcctgttctcggcgcgcaaggcgatcatgcagtacgcgcagctcaagaacctgcccaatgtcggcatcgaagacatctacaccggcaacggcgtcagcgagctgatcaacctgtcgttgtccgccctgctcgacaacggcgacgaggttctggtgcccagccccgactacccgctgtggaccgcctgcgtcaacctggccggcggcaccgccgtgcactacgtgtgcgacgaggaatccgaatggtacccggacatcgatgacatgcgcagcaagatcaccgaccgcacggtggcgatcgtcctgatcaacccgaacaacccgaccggcgccctctacccgaaggaggtgctgcagcagatcgtcgatctggcccgcgaacaccagctgatgatcttctccgacgagatctacgaccgtctggtgatggacggactccagcacgtctcgatagcgtccatggccccggacctgttctgtgtcacgttctccggcctgtcgaagtcgcacatgatcgcgggctaccgcatcggatggatggtgctcagcggcaacaagtccatcgcgaaggactatgtcgagggcatcaacatgctcaccaacatgcgcatctgctcgaatgtgcccgcccagtcgatcgtgcagaccgctctcggcggccaccagagcgtcaacgactacatcgtgcccggcggccgtctgtacgagcagcgcgaatacatctacaacgcgttgaactcgattcccggcgtcaccgcggtcaagccgaaggccgcgttctacatcttccccaagctcgacgtgaagaagttcaacatcactgatgatgagcagttcgcgcttgacctgctgcatgacaagcgcatcctcatcacgcgcggcggcgggttcaactggcatgagccggaccacttccgcatcgtctacctgccgcgcatcgaagtgctcaaggacgcgacggaaaagctcaccgacttcctcagctgctaccggcagtagtcggcgggcatcacaatacgggtcgaaaaagccgttatccgtgattccccgtgtgaaatcgccgttttgaggctccgaaacggcgatttcacacacccaattgcggataacggctttttcgacccgtaattcgcaaaccggagaggggctcgaggctccccgccgtcacgtcctcgccgccgataggatggacgctatgaaaaagcacatcgtcgcgggcattctggctcatgtggacgcgggcaagaccacgctgtccgaagcgctgctctaccgttctgggcagattcgcaggctcggccgcgtcgatcacggcgatgcgttcctcgacaccgacgcgatggagcgggcgcgaggcatcacgatattcgccgagcccgccatcatccgatccggcgatctgacgatcaccctcatcgatacgccggggcacgtcgatttctccgccgagaccgagcgcgtgctggcggtgctggattacgccatactggtggtgtccggggctgacggcatccaggggcataccgagacgctgtggcgcctgttgcggcgatacaacgtgccgaccttcatattcgtcaacaagatggacgcgcccggtgccgaccgggccgcactgctcgcccagctgcgtgacaggttctccgacggctgcgtggacttcgagaacggcgctccgacccggtcgatggaagacatcgcgatgctcgacgaatcggccatgaacgagttcctggactccggcgccgtcgcggacgagcggctgaaagccatgatatccgcgcgctcgctgttccccgtgttcttcgggtccgctctcgccatggagggcatcgatggcttcctcgccggctttgaacggtataccaaggagatcgaaccgggtgctcgtttcggggcacgtgtatataaggtgtcgcatgacgagcatggcaaccgtctgacgtggctgcgcgtcaccgggggagagatcaaggcgaagatggtgcttgacggcgacgagaaggccgatcaggtgcgcctgtattccggcgcgaaattcaccacggtcgatgcgctgcccgccggctcggtctgcgccgtcaccggcctgacgcacagccgccccggtcaggggctgggcgaccagtgcgacgccgacgccccggtgctgcagccggtgctcacctacacgctgttgccgcagggggaggatcctcaccgttgcctgaccgcgctgcgagaactggatgatgaggaccctctgctgcatgtggtatggcaggagaggctgcaggagatccatgtgcagctcatgggcgcggttcaattggagatcatccagcagatcatgcgggaccgtttcaacttgaacgtcggcttcggccccggatccatcctctacaaggagacgatcgcccatgcggtggagggcatcggccacttcgagccgctgcgacactacgccgaggcgcacgtgctgctggagccgggcgagccgggcagcggactgaccttcgccacatcctgttccgaagacgtgctggcccgcaactggcagaggctcatcctgacgcatttcgccgagaaggagcatctgggcgtgctcattggcgtccccatcaccgacatgaagctcacgctgctcaccggccgcgcgcacgagaagcatacggagggtggtgatttccgccaagccacctaccgggccatccgacaggggctgatgaccgccctggtcgagggagacttctcccggcacgacctgttcgacgaggacgccgcggaggacgtcgccgaagacgcggccgcagccgatgccaaaacagcccggacggacgaatcggagccgtcggacggcagcgccttcgcctccgcggccgcccgcgatcccggctggtgccgggtgctcgaaccgtggtaccgcttccggctcgacatcccgcaggacatgctcggccgggccatgtccgacatacaacgcatgtcgggcacgttcgacccacccgagatggacggccagtacgccgtgctggcgggagtctgcccggtatccgagatgcgcgactacgccatggacgtgaacgtctacacccacggcacgggccatctggggtgcgtgttcgacggctaccggccatgccacaatgcggccgaggtcatcgaacaagcgggatacgatccgggagacgatctcgaaaacatccctgattcggtgttctgcgcgcatggcgccggttacacggtcaaatggtaccgggtgccggatttcatgcatctggatcgcgcatacgacgccgggcagtgacgtcttcgccgggcaaaggggcccggcggcagtgacagtgatattcgtcacacttaacacgccattcacataagagacatctcattgacatgcgaaacgggtgccgcagattttccgaatcgcttgagaaacattgaaattgggtattgacaaacacctcgactcggtatatggacagcgaaacgtgtttgacatagccgagcggtactctttcctacgcattaacaaaagaaccgcaggttgtcaagatcctgccaaaacgatatgaaggtggtttcggtgactttccacgccccgctcgatttgagcatacataaatcacaaggtctgtacgacccaagctcagaacatgacgcttgcggcgtaggtatggtcaccacactcaacaagcggccggaacgtaagatcatcgacgacgccatcgaagtgctcgtcaatctcaaccaccgtggcgccgtgggcgccgaggagaacaccggtgacggtgcgggcatcctgatgagcatgcccgacgagttcatgcgggccaccacgggcgtcgaactgcccgaggccggccattacgcggcgggcgtcgcgttcctcgaccgcgacatcgccacgtccggccagcaggagcaggccatcgcgagcatcgtgcgcgaagagggtctggaagtactcgcctggcgagtggtgccgaccaacccggacgggctcggcctgcaggcgctcgcctcgatgcccagcttcaagacgctggtcatcgccgatgccgaaggcaagctggcgggcatcgagctcgaccgcaagaccttccgcatccgcaagcgcgtcgagcatgaggtcggcatctacttcgcgtcgctgtcggcccgcaccatcacctacaagggcatgctcaccacgatgcagctcaccccgttcttccccgacctgtcggattcgcgcatgaaggcgaagatcgcgattgtgcactcgcgcttctccacgaacacgttcccgagctggccgctcgcgcagccgttccgcctgctcgcccacaacggcgagatcaacacgatccagggcaaccgcaactggctgtcagcccgcgaaggccgcctgagctccgaactgctcggcgagttcgagccgttgctgccgatcaccacgcccggctattcggattccggcacgttcgacgaatgcctcgaactgctgcacctcgccggccgctccctgccgcacgccatctcgatgatgctgccgccggcatgggagaacaacgaccagctcgaccccgacgtgcgcgcgttctacgagtacaacaacacgctgatcgaaccgtgggacggcccggccgacatcatcttcaccgacggcacgcaggtgggcgccctgctcgaccgcaacggcttccgccccggccgctggcagctcaccgatgacggctaccttgtgctcgcctccgaagccggcgtgctgccggagatcgacgacaagcatatcgtctccaagggccgtctggagcccggaaagatgttccttgtcgacaccgacgagggccgcatcatccccgacgaggagatcaagaggaaccttgcctcgcagcacccgtaccgtaagtgggtcgaaggcaactccgtggagatgagcgacctgccgcagcgcgagcacgtgagccattccggccagtccgtgcagcgtcgtcagcgcgcgttcggctacaccgaggaagacctcaagatgctgctcacgccgatggccaacaccggcaaagagccgctgggctcgatgggcaacgacaacccgctgccggtgctctccaagcgcagccgcatgctgttcgactacttccaccagaagttcgcgcaggtcaccaacccgccgctggactgggagcgcgaggagatcgtcacctcgctcgaatccgccatcggccccgagccgaacctgctggaggattccgagctgcacgccaagaagatcctgatcccgctgcccgtcatcaactccgacgagatggcgcagctcaagcggctcgacaaggccaaggtgctcggcggatactaccgtccgttcgtcgtcaagggcctgtatcaggttgccggcggcggcaaggcgctgggcgagcgccttgaggagatctttgccgaagtcgacgaggccatcgcgggcggcagcaacttcatcgtgctgtccgaccgtgattccaaccacacgtggggcccgatcccgtcactgctgctcaccagcgccgtgcagcaccacctgctgcgcaagcacacccgcacgcagatctcgatggccgtcgaggccggcgatgtgcgtgagatccatcatgtcgcgctgctgatcgcatacggtgccgcatgcgtcaacccgtatctggcgttcgaatccgtcgaggacctggcccgcaccggctacctgaaggtcgacgagcacacagccgtgaagaacctgaccaaggcgctgtccatcggcgtgctgaagatcatgtcgaagatgggcgtctccaccatcatgagctaccgcggagcgcagctgttcgaggcggtcggcctgagcaaggacatcgtcgacaagtacttcaccggcacggtctcgcaggtcggcggcatcgggctcgacgagctggccgaggaggtggcgattcgccaccgcgtggcctacccgaaccagtggaccgccaccccgcacatgaacctcgaaaccggcggcgaatacaagtggcgccgcaccggcgaggatcatctgaacgaccccgaggcgattttcctgctgcagcagtcaaccgctcgcggcgactaccagatgtttaagaagtactcgcaccacatcaacgacacgtcgaaccgcattatgacgctgcgcggactcatgaagttcaagtacgaccgcaagccgatcgacatctccgaggtcgagccggcctccgagatcgtcaagcggttctccaccggcgcaatgagctacggctccatctcacaagaggcgcacgagacgctcgccatcgccatgaacacgatcgacgcgcgttccaactccggcgagggcggcgaatccgacgaccgcatcgaggatccgctgcgttacagccgcatcaagcagatcgcatccgcccgcttcggcgtcaccagcgattacctggtgcacgccaccgacctgcagatcaagctcgcccagggcgccaagcccggcgagggcggccacctgcccggtgccaaggtcccgccgtggatcgccaaggtccgtcacgcgacccccggcgtggagctcatctccccgccgcctcaccacgacatctactccatcgaggatctcaagcagctgatcaacgatgcgaagatggccaacccgaaggcacgcatccacgtcaagctcgtctcggagttcggcgtcggcaccatcgcggccggtgtggccaagtgccatgccgacgtggtgctgatctccggctatgacggcggcaccggtgcggcgccgctcaacgcgattcgccacgcgggcaccccgtgggagatcggcctgtccgaaacccagcagacgctgattctgaacggtctgcgctcccgcatcgtcgttcagtgcgacggcgagctcaagaccggccgcgacgtgatcatcgccgcgctgctcggtgccgaggaattcggcttcgccaccacggcgcttatggtcgagggctgcgtcatgatgcgcgcgtgccagaagaacacctgcccgcagggcatcgccacccaggatcccgagctgcgcgcccggttcaagggcaagccggaagcggtcatcaacttcttcatgtacatcgccgaggaagtgcgcgaactgcttgccgagctcggtttccgtacgctggaggaggccgtcggccatgtcgaatgcctggaccagaacgaggcgatcaagcgctggaagtccgacggcatcgacctgagcaacgtgctcatgcagcccggcccggttcccggaacgattctgcaccagaccatcgagcagaaccacgaactggagaaggcgctcgacaacaagctcatcgagatggccgaacccgcgctggagcgcaaggagccggtacgcatcgagatgccgatccgcaacgtcaaccgtacgctcggcacgatggtcggctacgagatcacccgccgctacggtgccgaaggactgccggacgacaccatcgacatgacgttccacggtgccggcggccagtcgatcggcgcgttcatcccgcgtggcgagaccatccgcgtctacggcgaggtcaacgactacgccggcaagggcctgtcgggcggacgcctgatcgtacgccccgaggacggcgtcaccttcgacccgcacgagaatgtcatcgcgggcaacgtgaccggtttcggcgcgacctccggagagctgttcgtggccggccgtgcaggcgagcgtttcggcgtgcgcaactccggcgccacgttcgtggtcgagggcgtgggcgaccacggctgcgagtacatgaccggaggcaccgtcgtggtgctcggctccatgggccgcaacttcggcgccggcttctccggcggcaacgtgtacgtgctcgatctggacatgaaccaggtcaatccgaccgcggcgaaggacggctcgctgctgttcctaccgctggacgacgaagcacaggcactggtccacgatctggtgaagcgtcacgtcgaagagaccggttccgcattcgccgccggactcctcaaggattggaagcacaccgtcgcccggttcacgcacgtggtgccggaacactatctggccatgaccgccgccatggcgaaggccgaggaagacaatatcgatttcaacacgcccggcgcctgggaacaggtgtacgagcaggtgatggaaggagcgcactgacatgggagatcccagaggattcctgaaggtccgtacccgtcgcgaactggcggaacgccccgtcgaggagcgcatcaaggactggcttgacgtccatgctgagtccggcttgcagccgtggaccaccgaacaggccgcccgctgcatggattgcggcactcctttctgcatgaccggatgcccgctcggcaacatcatccccgagttcaacgatctggttcatcaggagaagtgggaggacgcctacaatcgtctgtccaccaccaacaacttccccgaagtgaccggacgcatctgcccggcactgtgcgagaaggcgtgcgtgctcggcatccaccagccgccgacgatgatcaagctcgacgagcagacgatcatcgaccaggcatggggtctggatatcgtcaagcccatgcctccgcagcgtctgaccgaccagaccgtggcggtcgtcggatccggccccgccggtctggcatgcgcccagcagctcacccgagccggccacacggtcgtcgtctatgagcgcgatgacgccatcggcggtctgatgcgctacggcatcccgaacttcaagctcgacaagcgactgatcgaccgtcgtatcaagcagatggaggccgaaggcacccgcttccgcacgggcgtggagatcggcaaggacatcagctgggacgatttgcgcgaccgctatgacgccgtggtcgtcgctatcggctccaccgtgccgcgtgacatgaagattcccggccgcgagctcaagggcattcacttcgcgatggagttcctgcccgacgcgacccgacgcgtgtacggtgtaaagcccgtgcacgacatcaccgccaaggacaagcacgtcatcatcatcggtggtggcgacaccggttccgactgcctcggcacctccatccgtcaaggcgcgaaggacgtgaccgtgctgcagatcatgccgaaggagccggacgagcgcccggacaaccagccgtggccgacgttcgcgcgtctctaccagaagacctcctcgatggaggagggcggcacttacgtgtacagcaccgattctgtcaacttcgtcggctccgacgaggaacaggcccgtgtgcacattgaggattccaccgcgtccgaaggattcgtggccgacgagaacggccacgtcaccggtctgaaggtcgtggatgtggcaccgggggagaacgggccgttcacccgccagcccggtaccgaacgcgtgctgcccgcggatctggtgctcatctcggtcggcttcctgcacccggacacctccacgctgctcgaccagctgcctgtcgaattggacaagcgcggcaacgtggcccgcaacgacaagttcgccacctctcaggatggcgtgttcgttgccggcgacgcgggccgcggccagagcctggtcgtgtgggccatttcggagggccgctcctgcgcggccgccgttgatgagtacctcaccggcgtcaccgagctgcccgcgccgatcaccgcatcccagcgtccgatgatgctgccgcgatgattcgacagtccggcggttcgccgtaccgacatctactgggggcaggaagtctcttcaagggacttccggcccccagtcgcatatcgggcgctccctatttctggcgaaagtcccgtcccgttgtgtgccggtgggttctcgccggaggaatggcccgctcatgtgtgggtgagccgcagaaaggaggccggctatgtgcggggtggtacgtgtcgcggccacggctcggacgtcgtgattgccaacgattgcggatctgtctcgtcgtgcgagtcgaaccgccgctacggcacggcttggagtacagtacataggagtgttatccacaaacgagcaggagaagtaacgatgcctaaccgtgccgaacgccgcaaagcagcaaaagatcagcgtcggggagtcccgtcgcagtacgaccagacccgtggccgtgcccgatccggcatgctcgacgagtacgcgcttcaggagaagtcccgccgtattcaggagggcgtggatgacagcggcgtgtggaagcccagcgctcgcaccgaggtcgatgaggaagtggagtcggtgttcgaggccaacccgaactatcaggatcccaaggcgttcaaggcaccgcactccgtgcggcagtggttccgtgtcggcagctggacgctgatcgcgctgtcggtcatcgcgttcttcgtggtgatgtggctgcccacgcatccgctgtggctgatcctgaccgtgtccgtcgtgttcgtcgtcggcgtgctcagcctgttcttcacggccggcaactaccgcaacaacccgaacctggacgccaacggcaccgcggtgtgagagtctggtatccggtagttatctggtattatggcgtgatttttcgccaacacgaacatgggcattgtgcgttttttcgacgtgcaatgccctaaagttatatatggcagtagccgcaaacaaggttaccgacgaaggaggccttaatcgtgaaagttgatatcctcacccgcgaatacccgccgtatgtctatggtggcgcaggcgtgcacgcggaagagctctcgaaggtgctggccgagcgggtcgacgtgaccgtccgtgcgttcgacggaccgcgcaccgaagccgatgcacccgccatccccggagatggctcggcgaagggcagcctgaaagtcgtgggctacggaacgccctctgagctggccgacgcgaatccggcgctgaagaccttcggcgttgatctgcagatagccaacgacgtcgacgccgacatcgcccacgcgcacacctggtatgcgtgcctggccggatacctcgccaagatgctgcacggtacgccgctggtcatcaccgcacattcgctggagccgttccgcccgtggaagcgcgagcagctcggcggcggttataatctgagctcctgggccgaaaaggacgcctacgagcacgccgaccgcgtcatcgccgtctccggcggcatgcgcgaggacatcctcgccgcgtacccgaacctcgaccccgacaaggtcgtcgtggtgcataacggcatcaccatgagcgacttcgccacgccggccgacgacgacccgggctgggccgtgttcgaccgttaccacatcgaccgcagcaagcctacgctgctgttcgtcggccgcatcacccgtcagaagggcctgccatacctgctcaaggcgctgcacctgatctccaaggacattcaggtggtgctgtgcgccggcgccccggacaccccggagatcgccgaggaggtcaagaccgcgttcgccaagctcgacgaggaacgcggcaacatcatctggatcgaggagatgctgcctcgtccggagttcaacgcgctggagcatggctgtgacgcgttcatctgcccgagcatctatgagccgctgggcatcgtgaatctggaagccatggcctgtggcctgcccgtagtcgcctccgccaccggcggcattcccgaggtcgtcgtcgacggcgagaccggctatctggtgccgatcgaccagctgcgcgacggtaccggcacgcccaccgatcccgacaagttcgtgcatgacatggccgccgccatcgacaagatcatggccgaccccgaactcgccaggaagatgggccaggcgggctacgagcgcgcccgcgaccatttcagctgggagtccatcgccgacaagaccgtggccgtctaccagtccgtcctcgacgagcagaacaagtaacggcgatccgacgcaggcgggggcaaggaatgatgcccccgcctgcggggccgtaatgcgcggcatggccggatggcatggcttcgcgaattaccgcaaccattccaaacccgcactgccggcaaacctccccacgacaaggaaccacaacatgcccacgaccgacaccgccgacaacgaagtcctcaagctcgacaacgtcgaattccgccgcaaccggcgcgtcatcatcacagacgtgaacctcatcatccacgcgggggagcgatgggtgctgttcgggccgaacggcatcggcaaatccaccgcggtcggcatgctcgccacgcgcacgttcccctcggacggtcgcgtattcatcctcggccatcagctcggcaaatacgacgtattcaaactgcgtacgcgcatcggtctggcttcggccgacctcggccggcagtttcccgaattcgaggatccgctggacgccgtcgtcacgggcctgagcgccgtgaccggacggtggcgcgacacctatactgacgaggagtatgcgcgggcgcgacagctgctgcgcgacttccgtgtctcctatctcgaaggcaaggagatgtggcggctctccgagggcgagcgcacccgcgtgctcatcgcccgcgcgttgatgggcgaccccgaactgctcatcatggatgagccgaccactggccttgacctgggcggccgcgagcaggtgatgcgcaccctgagccgtatcggcgaagaggattcgcggcgtgccgtggtgctggtcacccatcgacttgaggagattcccgcgggcttcgaccacatcgccatcatgggacgcaagccggtctccgccgaggacgccaccaacgacggcattgacgcgatgggcaacccgtccgccggcaccatcgtctacaccggtccactgaaggccggcctgaccgacgagcgactgtcggagctgttcggcatgccgatcgaggtgcaacacacgcacgggcgctggtcggcgttcgcggtgtgagaccgaggcgtatcggtcgctggcgggattcatgaggaaccatgcccgcgcatctgatataacggtagccatgaatggcacgcaagagctgaaggtcgccgtagctcagttcacggttcgccgggagccggaatggaaccttgacattatcgacggatatgcctggcaggccgcggatgccggtgctcgcttgctggtgcttccggaagggctgatcgcgcgtgacggcgatgatgacatgttcgcggccgcacacgcgcaaccactggacgggccgttcgtcaccggcctgagacggatcagcgaagagcgtcatattacgttgatgggcacggttcatgctgtgctcggcgcggctgatgcggtgccggacaagccggcgtcttgcgcaacggattcccgggtctccaacgttttcgtcgtcatccgtgacggggctcttatcgtgacctatcggaagctgcatctctatgatgcattcgccgcgcgggagtccgatacggttcgtcccggtaccgagctgctgccaatcgtcgagattgacggctggcatgtcggcgtcatgacctgctatgacgtgagatttcccgaagtcgcgcggtcgctggccgtgcgcggcgccgatgtgatcatcgtcagtgcggcatgggcgcgcgggcgtttgaaggagcgacattggaagctgatgaccgccgcgcgtgcgctggaaaacacgtgctacgtactggcatgcagcgaggtgagcgcgcgcaacatcggctgcagccgtgtcattgacccgctgggcgaggtcatcgcgcaggcgggtgacggacagggcgaggcgggcggacaggctggaatgctgattgcccggctgcaccgagaagttctcgaatccgcgcgacgcacgctgccggttctggagaaccgacgcttcgcagacccgcaattgcgggattgacacaaatttcccgtatgacgcgcatgcggcccgggaatcggccacacgcgtcgcacgacacgcccggattgcgctgcacgaatgtcaaagtgcaccgttgtacttcagtgatcccctgacgattgtgctgagcaatccgggcgtgtcgcgcttgtcggaagcgcagatcgcgcgaatcagcccggtcggcatcggtcatgcgaacgaggcggaagcgggcgtgccgtactacgacgatatcttcgatgaggacgacgaatgcaccacggccgacatcagcgatccggacgggtcgattgctctgggcctcggcggcatgtactacgaggagggcatgcactataccgccgcatcggaacggcggaagcgggtcgactgtttcagagccgccgggatcctttaccggcacgcggccggccgcggcaatgcgatcggatggctgtgcctggggtacgtgtacgcgtacgaccgctgcgagggtaggtacttccgctcgtattacaacaatttcggcgaagttccacccaaaccggatacggacgttttggcatacgagtgcttttgtcatgcggccgaagcggggatcgcggagggctgctacaagctgggagacatgctggccgagggcagaggctgtgcggctgatcatgcgaaggcgctcgacatgttcctgcgggcgtacatgtgtgacggattgcggcaggcacattttacacgaaatacatgattgaggaggacgatactatggatgaggtagtcaaagcagattcttccgcgggcaaaacttaagattttcccagcaagtgacgcttaccatgaacacgcaagcaagaaaatcacggcaaatcatggaaaggagtccatatgtgcactggtgttcgtttctccgacgatgagggaaacatgtatttcggccgtaatctcgactggagcttctcctacggcgagaccattctggtcactccgcgaggctaccagtacgactatgtgtatggggccgaaggtaaaagcgaaccgaatgcggtgatcggcgtgggcgtggtcatgaccgaccgccccatgtatttcgactgcgccaacgagcatggtctggccattgccggactgaacttccctgggtacgcctcctttgcgcacgagccggtcgaaggaaccgaaaacgtcgctaccttcgaattcccgctgtgggtaacgcgcaatttcgatactgtcgacgaagtcgaagaggcgttgaagaacgtgacgctcgtttcgcaggtcgtgcccggccagcaggaatccctgttgcactggttcattggtgacggcacccgcagcatcgtcgtcgagcagatggctgacggcatgcacgttcatcatgacgatgtggacgtgcttaccaaccagccgaccttcgactttcatatggaaaacctgcgcaactacatgtgtgtgagcaacgagatggcggagccgaccacttggggcaaggcggaactgagcgcatggggtgccggtgtgagcatgcacggcattcccggtgacgtgagttcgccgtcgcgtttcgtacgcgtcgcctacaccaacacgcactatccgcagcagaacaacgaagctgctaatgtgtctcgtctgttccacacgctggtttccgtgcaaatggttgacggcatgtccaagatgggcaacggccagttcgagcgcacgctgttcaccagtggctattccgggaaaaccaacacgtattacatgaacacgtatgaggatccggcgatccgctcgtttgccatgtccgacttcgacatggattcgagcgagctgatcaccgccgattgattccgggaatttcgagttcgaagattccagttccgaagattccgcagtgatcgcactatatggacagcataaaagtgcacaacgtcgcaacctgaaccgcaccccgattgttggactgaagaaattcagattcgatgatcggaggtgcggttcaggttgcgacgttgtgccttgaattttcattgctggtgcaacgcttgtggatgatgtgggcccatgggttcccggtacgatggtgtttgcctgcgacgaccgggtatcgggaggtcccatgggccggtacgcccgtcttgccttggccgagcgcgaggaaatcgtgttgctgaggcacggggggctgcggcgggatggccggagcgacgggcggggacaaagcgaccatcagcagggagatggccggaaactcgttcgccgttggctcggggcggtgccatcgtgcatcggccgcccagcgtggctgcgagtcccgaagggtttcctgcgtgcggcccggggtcctcgacggcgagcgaggggcggggcttgtgcggcgtcttgtcgtgcgggagcatcggtcgcccgggcggatcgcgggcgggatcgcggtcgaacggccgggactgatggtctttgcgtccgcgatccaccgggcgatcaacgagcggcggcttgatccacccggcctgacgcgtatccgccgtggaatcagggcgcgtctgcgtcataaaggcaaacgccggcacgggaggggcggaggaacggcgtggcgagatcccgggcgcccgtcccatcgggcagcgtcccgagatcgtgggggaacgttccgggctcggcggccgggaaggcgacgccgtcgtcggcaaaggcgccggggcgtgcctcgtcacgctcgtggaccgcagaagcggtctgctctccggaggacgctgtgccgcgcatgccagacgcgacgttgccgatgtggggatcggcgcgctccgaaggcatccggagagccggaccgtgaccttggaccggggtatggggttcgctgacttcgagaaggtcgtacaggccaccggcgcggtgttctgcttcgccctgccccgccatccatggcggcgtggcggcaatgggaacaccgacgggctgattcgtgagtgtttccccaagggcgccggcttcaccgccgtcggcgagcaggaggtccgggccgtgtacgatgccatcgatcacagaccacgcaaacgccatggataccggacaccctgggaagtccaccattcaacggtgttgcacttgctctgacgattcaagcaaagtaataatcgaaagatatagataattatgagtatcaatcataaaagcgtgtgcgtatctagcattcatgcggcaaattgatgaagcgtacccctaatgacatacaatatatgcgaaaacattgggattgagagcatatggggagcacacggcaatgaggcatggcgcacattcggaacgagaactgctttctcccggcatgagagtgctgatccgcggccaggagtggcttgtcgataaagtcgagccgaacagtcttggcaaccatgccgtttcatgcaccggtatctccgctctggtgcgggacatgacggccacgttccttgatgatttggacacaatcacgcctgtcgatccggtgaagacccgcttcattcccgacacctcggcaagagctgcgaagtcgcatctgttcatcgagagtctgttacgtgccactgcgccgaccgatgcgaggattcatgtcggcaacaaggcagccatggactccctgccgtaccagctcgttccggcgaagaaagcgctcgcccaacctcgccagcgcattctcatcgctgacgccgtcggccttggcaagaccttggaagccggcattctgatgtcggaactcatcaagcgccgcaagggccgccgtattctcgtggtgacggcgaaaagcatgatggtccagttccagaaggagatgtgggaacggttcaccatcccgctgattagtctggactcctcacgcatccagcagattcgttccgagatccccgcgaacgccaacccgttctcctattacgacaaggtgatcatctccatcgacacgttgaagagggacatccaatatggcgcggcactcgatgcctcgtattgggacatcatcgtgatcgacgaggcacagaatgtcgccgaccgtgccgccaacggccgcagcgcgcagcgcgccaaactcgccaaacgccttgcctcccgttccgacacgttgatcatgctgtccgccacgccgcatgacggccgcgctcgcagttttgcttcgttgatgaacatgctcgacccaaccactctgccggatccggagcgttacgacaagaaagacgtcgagcacctgtacgtccgccgtttcaagaaggacgtgatggccgaggtgtcgggcagcttcccggaacgcaaggtgacgcaggagaaatgcaaggccaccgcagccgaggaagaggcattcgattatctgaccgatatgaaactcgtcatggacatgcatcagaagagaagcaattccttcttgttcaagacgatgcttgagaaaagtctgttttcgtcgccggctgcatgcatcaagaccatcgacgagagagtaaagcggcttgccaaaaaagatgtgtccgatcagaccggagacatcgacaggcttgaaggactcaaggccgctttagagaaaatcggtccgatgcagttctcccgataccagagactgctgcagctcctgcgcagtgccgattatggttggcataacggcgaggatgctgacgaccgtatcgtgatcttcacggaacgcatcgagacgaagaactatctcgaggagcacttgcggcaggatctcaaactaccgaagaaggctatcgtctccatggatggaggcatgagtgatgtggaacagcagaaaatcgtcgaggatttcggcacgaagtcatcgtctatacgtattctcgtggcctccgacgtggcttccgaaggcttgaacctgcactatctgagccacaggctcatccatttcgacaccccgtggtcgctgatggtgttccagcagcgtaacggacgcattgatcgttacgggcagcgcaaacagcctgatatccgtttcatgatgatttgctcgcgtaatgcaaagattcagggtgacacgcatatccttgagattctgcagcagaaggaagaccaagcgcgtaaggatatcggcgatccgtctctgcttatgggcaaattcgatgtcgatcaggaggaagagttcacccgcgaagcgattgagtccggcgaatcggcggaagattttgccgctaggcttcgtattcctgacgaggacatcgatcattcggacgagcgctccgaagatgtcgaaactgtgccggatgacgatgttttcgacccattgagctttttcaacctcactacgctggatggttccgatactacgagcactgaggaaaacgagcccgcaggggagagcgtgactgggagtgccgacgatggcggcatagtcgattcctctacgctgatgtcggattacgagtatgtggatgaggggctctcctgcgaggagttccggcagtcggctggtcttagctcgaaacgtcagttgcgtgatgctcatggattcgcggtggagttccaaggggatagcccgttgcgcgcgtggctgcgcagacgtgtgccgaacacgcgggtgttgcaagacaacatcgccgaatggagtgatgacgcgaaatactgcgaagaccaagccaatggtctgctggcacgtatcaacgacgagtcatggagtcgggtccaatacctgtgggaattgaatccgatcacggaatgggtcgggttgaaggcttcctcactgctgtaccaacgtgacgaggccccgattattggcgtgaccaacggaaacctgcatgcggatgagacgattatgctgatgaacggcatggtcgccaacaggcacgcatccccggtgatcgatgaatggttcggtgtacggtatctcgatggcgaatgcatgggcatgctgccacttgaggaagtgtggcgtatcaccggatatcgtgggaacttgattccgggaaccactgaacgtcgttatgtgaatcgagaggattccgcggccagctccgaacagatagatgcggcacaactgctgttggaggatgcggtatcgcgcggcaagagcatgctcagcgattgcggtgaacaatatcgtgcgcaggcagatgaagaagtgactcggcaaatggaccgcatcgagcgttggtcccatgcacgcaaggcactgttgcaatcccaaggcaaaaacaccaaggaaaacacaaaacaggttgatcggatgctcgaacactatgccgactgggttcaggacacattggacgcctccggcgaaccagtaatccgcattgcggccgcattcgtaggtaaggaatagagggggagaccatggcgaaggaactgaacgagacattcccaggcatcgaggcggtcaacgacttctacacgccgtactatatgaaggaatattttccggatgaagtgaagaatgcctccacaccttggaaacagcttcctcccgaggaacgcccagcgcgactgctgaaggacatgcgccagtcgttcaccgaagtcatcaacaacaacgagaacgatctgtttccagctgaacgggtacggaatttcatcgacggcatgctcgccgcactcggctatacgcaggaggggaatcaaaccaaagacgagggattgtctgaccggatttcagggaagtctgttcctgtctactatcaggtcaatgattccgatggggctccgcgcttgcaagttctggtgagcctgtccgatagtgctgaggcaggtgttctggaaagccccatcgaagatggctctggaaaggacggcacctcctgtgaggaatatgcacgtatgctgctcgccgatttcgacgagccggcacggtggattcttctcatggggttgcatcagatagcgttgatcgaccgccgtaaatggaatgacaagaaatgcatgctgttcgatctggacgagatcttcagccgccatcaggatcatgtgtatacggcgatggctgtgctgttgcgtcgcgatagtctctgcccgaacaaaggtgacagtctgcttgacacgtttgatgacacgtctgcgaagaacgcggttgaggtgtctgataatctgcgttccgcgttacgtgaatgtgtggagatccttggcaacgaggtcatccacgactggacttgtaataaggggcggagcatcgatgaaatcgacgcgggcgacttgactgtgcaggcgttacgctacatgtaccgtctgctgttcctcctgttcatcgaggcgaagccgtcgctcggctatgcgccgatgaaatccgacatctaccgtaccggctattcgctggacagcttgcgagatattgcggaacagatgcgtggtcgcatggatgaggctggcgattccacctatctagcggacacattgcgccgactcgacgatctggtgttcaacggttacccgaaggcggatgaggatttcaaggggttggttggcgaggaagccatcaatgcggtgttcatggttccgccgctcaaggcgcacattttcgatccggagcggaccgcgctgattgaacatgccgcactccgcgacagcgtgatgctgcgcatcatcgacctgatgagcgtcaccaagacgggtaagggagtcaaacgcaggcagcgcatctcctatgcggccctgggcatcagccagatgggtgccgtgtatgaggcattgctgtcctaccgtggttttatcgccaaggagaagctctacgaggtcaaacgtgccaaggattcctacgaccctttgaaagtcggctacttcgtgccggaacgcgaactcgacaactattcggagagcgaacgcgtccgctacccggacaaaaccccgcatgctggcgagctgcgcacctacgagcccggcacgttcatttaccggcttgcaggccgggaacgtgaaacgtcggcctccttctatacgccggacagtcttgcgcaatgtctggtgaagtatgcgctcaaggagattgagccacgtatccaccaagccaccgatattctgagcctgaagatctgcgagccggctatgggctccgcgaccttcctgaacgagaccatcaaccagctggccaccatgtatctgaaccgcagggagaaggagcgggtcgccgaggaaggacagaaggcggccattcccgcggaacgcaggcaagctgaactgcagaaggtcaagatgtacatcgccgaccacaacatctacggcatcgacttgaaccccgtggcagtggaacttggagaggtgtccctatggctcaacaccatttgcgaaggatccttcgtaccatggttcggcacccagctgcaatgtggcaattcgctgattggcggccgtcgcgtcggatattcggaatcgaatctggctagcgctaccaaaaaccgccactggtatgaggtcgaacccacgcatatcgggttcaaccagagttcgtcatccatcaagcgtatctaccagttcctgaccggagatccggagatgtgcaggtatgacgacaagaccgtcaaaagcatagaatccgaacatttggaaaccatcaaggtctggaagaaggaattcgccaagaagccttattcccagacggagattggtctgatgaggtcgttgtcaaagaccatcgacgaactatggcgcggccagatcaaagcgcgtcggcaattggaaaaggcgactcaagacgatttgattatctacggttttgacgcgaacgtttccaaaaagaccgcgaaggctttggaaaaccagcagaagcatgggcaggggttgcttggcatcgaaaatgaatacttccgtggcaacaacctcaccattcgcgagaaagatgagatgcttcgcattgcctaccattcggaaaaggctgagaacgccagcgaatacgctcgtttgaaacttgccatggactactggtgctcgctgtggttctggcctatcgatcaggcgggtctgctccccacaagatcgcagtatctcacggaaatgtcgctgatcctcaccggcgagattccacaggaagagggattcactctgatgtcgatggataacaatcagcccacgcttatggacaccatggacgatagtcatgaacgcgactacatgtatgaccacactgtggatctcgatgagctttgcaaaggtgatggggaaccagcgcaaaggcttcgcttggtgaaggaaatcgccaagaagcagcgtttcttccactgggagctcgaattcgccgacgtgttcaaagacggcggcttcgacttcatggtcggcaacccgccgtgggtgaatgtgcagtggagtgagacggatgccgtttccgatgcgaatccttattttgcgattcataagcttacggcttccgatctgagtaagcgtatgggtgaacttctaaagaacgcacgtatacgaattatgtatcttcgggagtatgtgaatattgccggtgctttggcattctatggttcagtggggaattacccactactacagggacgaaccaatttgttccgctgtttcctgccgaatgcctggagctatacgcgtgcgcagaatggcgtaagcgcatttgtccatccagatgaggtttatgcggacacgaaggctccacttcttagaagagaaatgtatcgtaggatatgtagccatttccattttcagaatagacttaatttgtttgcgggcgtggacagcaatgcacagttcagtctcaatatctatagaaataaaattaattcaagcatttcatttgattcgatttggaatttgtatgcgccgtccactatcgatgaatgctatgcatctgatggtagtggggacgtgccgggaactaaagatgataattggaattgggaggtaaaaggccacaagaatcgtattatccacattgaggaatccgagcttaaaacttttgcattgttgctaagtgaacaggggacaagttcgtggagaaacaccccgcttgttgctgtgcatgcgcaagagctttttgatgcaatttgtaaaatggcaagtgtatctcgttgcttacgtgattatggggaagacataacttattcgagcatgtggaatgaaactaacgcacgtaaagacggtacgatatgcgacgaagttcattttcccagtgtcgatgaaaaaataatttattccagtccattccttggcgtcgccaacccccttatgcaaggtgcgaaaagaaattggaagacgaggaatgactatgatttgcttgatttgatggagataaatgattcgtttgagccgagaacgaaatacagacaagcttgtaccgattttgagtaccagcaaagactcccgaaaatgtctgacggaagcaatttcgatgctgtttatcgcctcgcatgccgtcgtatggttaatttagttagtgaaaggacgctgcaagcgtcctgtgttcacccaggcgcagcctgggtgcacaccataacaggttatggtgtgcacccagagcgctacgcgttgctcgcgctcatgagcggcctcgaggccgctctgccatatgattttctcgtgcgctccattggctatgaatggatattcatagctccacgctgcagctttttccagttccagaaacaattctggctcccgaaattcgtctccgcggtctgttgctcaactgtctgaccaagccatatgcagacctgtggcaatcctgctgggacgagtcgtatacgtccatgagctgggcgaaggatgatcctcgacttaccgccgatacgttcacctcattgatgaatgagtggaactggcatacgccattgcgcacggactatgaacgccggcaggcgttggtggagctggacgtactggcatccatggcgctcggcatcaccttggatgagctcatcgacatctaccgtctgaccttcaccgtgctgagcggctacgaggacgacacttggtacgacgcgaatggtcgtatcgtgttctctaagaagaattacggtgatttgactttcaaacgtcctgatttcgagaaaatcaagaacgcgcctgcgggcgaggtgttcacccgcaccatcatggacgacacccagccgggtggaccacgtgagcggaccatcgaatatgtggcgccgttcgacaaatgcgatcgcgtagaggattacaagaccgcatggaagttcttcacacagaagtatggagataacaaatgattcccatggtgcttgcacggcacatccagtccggactcgccgattacgtggagaccacgttccccatgactaacaagccgttccgcggctccatccgcaaactcgcccaccaagagggcatgctttcccaggagccgttcgtatcggtcaaactgccgttccgtgtggtcggcaaacatgcggaattcccattcccctgcctgcaccccacgtaccggccatatgcgcaccagatgcgcgcattcgaacgcatctccgccggtgaatccacactggtggccaccggcaccggttcaggcaagaccgaatgtttcctgtacccaatcctcgactactgttaccggcagcgcaggcttgggcgcaagggcatcaaggccgttctcgtctatccgatgaatgcactcgccaccgatcaggcgaagcgactggccgaactcatccacaacagtccggaactgcgcaacaatgtgaccgcgggcatgtatgtgggccagatgagccaaggcggcagcgacaaggacaaccacgccatgaccgccaccaacatcgtgaccagtcatgatgagctgctcaagaacccgccggacatcctgctcaccaactacaagatgctcgactacctgctggtacgtcccaaagactcccggatttgggacagcaacgatccggatacgctcaaatatttcgtcgtggacgaattgcacactttcgacggcgcgcagggcaccgacctggcctgcctgctgcgcaggctcaccgacaggctgaatactaccagcgatgacatgtgcttcgtcggcacgtcggccaccatgggcactgaagagacggtacgtgacgtctgtgagtatgccagccaaatcttcaacaccacgttcacgccggaatccgtggtgactgaggatcgtcttcgcgtcgacgaattcttcgtcaccagcgactatgacgacaccatgcctactgccgcgcaggccgatcggctcatcgaactcgaagaggacgtcgaccccgataaataccttgcctatgcggcccaaacgtggcttgacgacgcccccacagagccggtctccgcagacaaggcccgcatccggctcgccgaatccctgcgccattcaaggttcctggccagcctgtccgcgcttatctgtgacgaaccccagcaaatcgatcgcaaactgttggataggcttgccattatggacgcgaggttcaacgccttgcacccacgccagcagaaggcctgtgtaaatgcgctgatagcgctcgtctcccgcgctcgcaacggttcggaggggcacacacgtccgttcctgaacgtacaggtacaactatgggtcaaggaactcggccgcgtagtcgccaacatcaccccgcaggaagagagcatcgactaccgtccggtcgtcgaactgtccaaagacgacctcaagacccgcatgccggtgattaactgccgtgattgcggaggaaccgcatggattggacttgccggcaaagacggcggcatcagcatgggtgacccacgaacgttctacaacgagtatttcgcctaccatgccgacaatgcgttggtgaccttgcaaccctgcaccatggattatgttcttgacccacatgccgacaacggagccatggtctggttctgcaatgcgtgcatgaaggaacagaccgtagaacgttttgaatccacggaacgtgaatgcccggcctgtggagagcagcgtatacccatggtcgctaggggcatgaagctcgtatccggcaaccgcaaacactatcagtgtccgttctgcggcagcgaacaggacatcgccatggtcggtgtgagaaccactacgcaggtcagtgtgatgcttacccaactttccggagactccttcaacgacgacagcaaggccattgtgttctccgacagcgtgcaggatgcctcctaccgagccagcgtgttcaactcccgcacttggcgattcgctctgcgtaactccgccatggactacatgcgcgaggaacgcaaagacggtgcctctctcgctgagtatctcaataaccagaacagctactaccatcgccgctatccggacgaaaacgaatacattgtgcggttcatcgcaccgaacatgacatggatgcgcgaatacgaaaccgtattgcagggcaatcctgccgggcccggtcgccgtcagctgctcgattggatcaagcgcagactccgattggaatcgctgctggagttcggcatgcgctcccgtaccgggcgcacgttggagaaatccggttgcgccgcaatagcattcgaccagagtctcctgaaacgtgtggcacaggccgttgcggaacgttgccataacgagatcggactgcacgagaattccatcatgaaggccgactggctccgactgatcatggcgttcctcgaccagttgcgtatgaaaggcgcgttcttcgacgtgacctatgaccagttcctgcagaatgatggcaacaagttcctgctctccaacgcgaacatcaaatggatgcccggcatgtacgcggatggcatgccctacttcctgtcggacaaggagccagtgcgcaaaggcgttttcgataccttggattcgccggcataccgtcgaatcgtcgaccggtacctcaccgacggtgcccttgaaggtgatattcatcatgaactgttgggaatcgtgctcgaagagtgcatagcagtaggattcatcacgcagcaacgttatccaagcatgaaaatggagcgcaccgtgtacgggctcaacgagtccggctgcacggtcagcggcaaggtaacgcagttgatctgcgacacgtgtggacggagctattcgtgcgctacgcagaaccttgacgcgtggaacggagcacgttgccgtatccgcaaatgttcgggcagactggtatccggcactcctgaagccgaagccctggaattgcgctactatggcaagctgtactgcggagagccagccgatcgcatccacgctgccgaacacacggggctgctcaatggcgatgaccgtgccaaggtcgaagaggagttcaaacgcaagaaccgcaagcccggcgacgtgaacgtgctcgcctgtacgccgaccttggagatgggcatcgatattggagacctctccacggtgattctctcgtcgattccgcctacccaagcccagtacatccaacgtgccggtcgtgcagggcgacgtgacggcaactccttggtgctggcggtggccaataccaaggaacacgatacgtatttctatcagcggccgaaggacatgcttggaggtgcggtgaacccgtcgcacatcttcctcgatgcgaccgcggtattggaacgtcagctcaccgcctacgcattggatcgttgggtgcatgccatgctggatgccggcaatgagccggccgatgtagtgcctgataaattgaaaaactgcctggataatgtcaacggcagcggttccagcggattcccggtgaacttcctgaactggacaggccaacattccggtgagttgctcgacggattcggacgaatgttctcgttctccgaggaacttcggacgcaactcgacggattcgtgcgtggtacgaaagacagcagcaccatggccaggcgcgtctacgatgtgttccaaaagaccaacgatgccgtcatgacgcttgaagcgcagaggagcgatgcgaagcacctgctcgacgagctcaagaagaagccctccgactcatcgttcgaagagcagcagcgcgaatgcgaagatgagattcacaatcttggccgcatcgtcacaagcattctcaacaccaacacgttcaactacctttccgacgaaggcatcctgcccaattatgcgttcccggaaaccggtgtgaccctccacaccatcctcaaagaggacaaggaaccgtccgatgcggcacacggaatcgagcctgccgcgcaggacaagacgaaacgcagggggaaggccacgcgtgatttcgtgcgcccggcggccacggccatcacggaactggcgccgggaaacacgttcttcgcaggcgggcgcaaatacaagatcagccgtgtgctgtgtgcgaaaggcggcaccgacgacgagctggcaatgtggcgcctatgcccgaactgctcgcatgcggagcctgcttccagcactgagaacctcgccagttgtccatcctgcggatcaatgcaatgggccgatagcggccagaaaaggccaatgctgcgcatcgacaccgtcatatccgatgagacctacagcgaaagtctggtcgaagacacctccgacagcagacctaagacccagttcctgaaggacacaatggtggacatcgatccggcagacattcaatcaggatggcagttcaaaggaaccacgaactttggattcgactacacaccccggggcataatccgggaaatcaacttcgggcaggtctccgacaagggagcttcggtggaaatcgccggcagtaaagagatacgcaacggtttcaacgtgtgtctgaaatgtggtgcattgctcggcgaacatggatcgaggcacgcctacttctgcccggaacgcaagaaggcacaggaacagcagttggagcaaacggagcagaacagcacgtgcctgttcctataccgtgaggtcaaatcggaagtgctgcgtatgctcgtgccgggacttgccgacatccaaggtgccgatggtgccgcggagtcgctgactgccgcagtgatgctcggcctgcgtgaacgcttcggcaatgtggaccatctgcaggcgacgctcatgaacgagccgttgccggacaatcccggactgcgcaaaacctatcttgcgctatacgacacagtacccggaggaaccggctatcttaagcaactgtccgacccggatacgatgttcgaggtgctttccagggcaaaggaagtcatggagcattgtgaatgtgcaaaaaacggcggcgacgggtgctacagatgcctgtatgcatacagacaaagccaggacctgaaatttatttcccgtaagacagcgttggcaatgctcacgggcatcctcgacccgtccaacaaacgcagtcgtgtgaagaccgtttcgaagatcaacacgaacaaactgttcgacagcggactcgaacagcagttcgtcgaagctctccggtgcatgcatgcccatcccttcgcggaatccgacgatgccaaggggtgccgtgccatcgtcaaggacgaattcatcaatagcaaacccggatattccgtcaccgtgaacgggagcgtatggaacgtcgaaccacaagtctctctggggccggccgatggagttgtgattccctgcaagcccgatttcgtattgacggtcagcaatattgacgaatccggcgatgtggtcgagcatgatggaaggaagccaattgccgtcttcaccgacggtctgcaatatcatgcaggcatcgtcgcccaggattctctgaagagggaagcgcttcgtcaggcaggttaccgcgtatggtctttggattatgacgatgtgattggctatgtgcagggtaaggatgtggtgcagctcgctgatccgatgttgacgcccaagtccatgccgtctccggcggcctacaagggcacgattggcaagagggcggacgaattcgaccccggcgaggttccggcaatggccctgctggaatattatcttggggaaccggatgccgaacggatattcgccacccaggcgctggcgatgagctatgccctgaacccgcggaacaagagtgtcgaacctcaggccgtggatatgctgcatcggatcgaggcactgcacggcgagaacgaatcggcattcatgatttgctcgtcctggagtccttcgaactgtacaagactgaaattccaatccggtctgcgtatcggagaggatatgcggaccaccgaacctcacgtcggcatgatgttctcggacgtccaacgcgatgccgtgaaggcgaagaacgatgattacaatccgttgaacgctctggacgagaacgaggcggaagcattcaaaacgcaatgggcgtccttctggcattttgcgaatgtgatgcaattctcggaatacttccatgccatcggcgatgccgcgctgagtgacacgaccatgtacgagccgcttcgcaacggtttgcggaatattcctgacgtgcaggaaagcaatgattccgcgtggaacgatgtcctggcggatccgacctatgtgtattgtgcggatgagaccaaggaagccgtcaaacggtttatcgagtctgacataccggcaccggatgtactcggatatgagctgctggacgagaacgaggaaatcattgcgcaggcggagctcgcatgggaggatgggaagatcgtgtttttcccgtcctacgacttgcaatccgaccgagagaacgtcgacgaattcgtcaagcgcggctggactatcattacagaaaacaacgatgaccttgacaaggtgttcgcttcactgacggaaggtgaggaacgttgatggcagatatacgtacgatgaacaaacccgtggtcgcgcttggccgtgatcttatgggcagcttgttcgatttgccaaagaaagcgcagaaacatgccacgacgtttctgacaaaattccagacgaatccccgatcatcaggaatcaatctggaacgaatcgccaatgcggcggacgaaaaactgtattccgcgcgcatcgaccaacggtatcgcgccatcatcgctttccagaaaagcagcaatgtgtacgtcctgctgtacgttggcgaccacgatgacgcctacaaatgggcggaaacaaagaaactcgacgtcaacccgaacacaagggccatccagctgtacgatatggtttctcaagaggaaatcgacacggcaatgcgtgaagattcccagagcgaagttggatgggggagcgttgccgcaaacgtgccccaaccgaattccactataccggaatccgtttctcctcccatggaagaccatgacggcacgaatcacggaacagcttcagctagtgcaacttcagccgtggcggccaagaagccgcaggcaccacggcaagctcccgaacctcataccggtccgcttcccgacacttaccgggcattgacggacaatgatatgcgtcggttcggtgtgccggatatgtacgtgccggtcatgtgcacgagaaagacctggcaggaattcgaccggtgggggtcaatgctcccgaaggatgttttcacgtacctcacccttgttgccgaagggctttccaaatctgaggtcttcggcttgttcgatgagaccgaaggcaagatcagcgacaggctgggattggaacagcagctgcccacttcgtccatcgactctggtgaagaggtcgatccggaggatttccgtgccgccttgtcaagctacgcctcgcagcagtctttcgtggtcgtgcagggagaggcggatctcaagcgtattctggacgcaccattggagcagtggcgcgtgttcctgcatccgtcgcaacggctttatgtggaacacgactaccatggtccgttccgtctgctcggtggcgccggcacagggaagaccgtggtggccatgcatcgcgcgaagcgtctcgccgcgagattgctgagaaacggcagtcatcagaaagtgctgttcaccgcatactcgcgtaatcttgccaccgatattgcttcgaacctgaaactcatctgcacggcggacgaattcaatgccatcgacgtggtcaatctcgacaaactcgtgaaagacctactgacgagccatggttattccggcgaaatctggtatgacggcagtttcgatcacggtaacgatcttgacgacgcgtggcgcaaggccatcgcctccatcggcgtgaacgatccgaaactcacggtctccttcttcaaaagcgagctcagccaggtgattgtgccgcaacaggtacggaacgcggtcgactacatgcgcgtgctgcgtaaggggcgtggcacgagattgaatcgagcccagaaacttgccgtatggcaggttgtggaaacatatcggcgcatcatgcagtcgaacgacgcgtacgatgtggacacggccatgcagaatgccgtgtctctgctcacgcagggcgatgcgccgaggaaatacgcgcatgtggtggttgatgagggacaggacttctccgcgccggcatatcgtgtgattcgcgctctggtggacgagggtgataacgacatcttcattgtcggcgatgcacagcaacgcatctacgggcataccgcggtgctatcgaaatgcggcatccgtatccaggggcgtgcccgcaaattacggatcaactatcgcaccaccgaacagattcgtagcgccgccgactccattttccgtagttccggtgccgatgtcgcggattcggtgtttgcggatgttcgtggtatcggagatgcttcgccggccacgacgttcgatgacctggacggaggggagagctcgaccggcgatagcagatcgttgatgagcggtcccgttcccgaaacgcggcggtttgcatcccagtcggatgagatggatgccgttagggaatggatttatggattgtgcggcacggcggaaaatatggccggcgatgagttcgacggtgagcgtgtggatccgcgtaatgtgtgcgtggtggcgaggagtcgctactgcatcgaccattggcgtgaagctctgaataatggcttgccgtatggcgtgtaccagcttggtagggatgcagaaaacaggcaaaggcaaggaattcgcgtcgccaccatgcatcgagtcaaaggactggaattcgactatgtggtggtagtcgacgtgaacgatggggtatgcccaccgaagcccgtgttgcaatctgctggtgccgattcggctgcgttgaacgaaatctacagggaggaacgaagcctcatttacgtagccatgacacgtgctaaaaagggtgtgctgctgactggcgtctcggcacaggttggatgaaaggaataacgaaatggctagtaatgtctctatgttttatacgaaaaaagagcttgcccttaaggaatcggcagagcgtaagaaggggaaaagggtcttttatctggaatcggatgggtggaatgattatggatatgagacgttatttgagctttattggacagatgaagataacaaatttcatgagattggtccagtaaaaatcgctcataaatctgaaaaaattacaagagatttgcttgaaaatagttttagtcgcctagaggaaaatttttgttccttaggtattgacgataaatattatataaatataaataaaaataagttgcatgatgtacttatatctttgaatgatctaattttaagtaagaaaatagattatgtaagttcttctggattttatcaagtttcgttaatgagaaaatatgagtctgataaagaaggagcagagaaatatatttccacagtgcgagatattgtcgacaaaggacttgctgaggtggggctattccatctagagtatgtgttcaatagtgaagctgaaaatagagaagaaaatgagtatctaatacggaaaattgtttttgaagcagattcaaaagtttttcctcctgaaaacattcatgtgttaattggagaaaatggtgttgggaaaacgactttccttaaaggaattgcggaaaagtattctggaatcaatgaagacgtgaatcatatcatttatatctcgactaataggttagatgccgatgtgaatcaggcgggatccatggatatcttttcttctgacgctttaaaaaaacttttagtcgacatttctaggtctaatagactttcagaaaaactaatgaatagtttgagaagaattgcgcagaatgtaaaattctatgggttggatttcatttcgaaaattgatttttatcttgaggaaaataattctaacgaatttcgtaaatggattgcagatgaatctaatgtagatcaatgcagtgctggtcaaaaagaagtcctatttgtatttgcttttatgatttataaattcaatacgtctagatcgttgctcattattgatgaaccggaaaattatttgcacgctccgcttttaagtgcttatataaacgagattcgctctttcttaagcaatgaaagaacaggtgcaatggcaatttttgcaactcattctcctgtcgttttacgtgagattccacgaaaatgcgtgtatgtacttcgatcaagagatggacttcgctacgtctctcatcctaatattgaaacatttggagaaaatcttggcgtattgcttaatgaagtattcggcgtgaatgcagacaaaagtggctacttcagttttttgaaagacacagttaagaaaattccaaaagaaaaggtcgagaaaaaatataataagcctttttctaaggagagtctttcaagctattgcatggatgaatttggagaaaagcttggtatggaagcgagagcattgcttccatacatcgtaggtgaagcatggccgaaagggcagcaatgaaaaacattaaggatatgtttagcaatattttccctgatgtaccttgtcgaaagcgtaaggataaagaaagtatttctcagtatttaaaagacgtctattctattttatttactatattaaagaataagaagacaacggaaaatgtaaaagattatgaaaagaaacttattgcaattcggataagggggtgcggatgtttttttggacggttagacggccagtccaaggtgtttgcggtaacatgcgaactccaatccggacaccaaagcgtccaacttttcatccgcacccccccgtgcgcacttaaggacgcaaacagggccatttgcgttcctatgttcgcgcacttgtcgtttcggcgcgcacttaaagacgcaaaacgggctgatgcgcatagaagatgcacggcgacaatgcgctggacgacgccaagtgattatcagtcggattggcgacggtgacggcgagcgacgagggctttggagccgcgatcggagagttgcgagaccgcggctcccacggcggcggacaatgcggcgaacaggatgctcatgaacaggctctcctgctggtccacgactccgtcccccagctcgcccgtgccatcggatggacgcttgcgggcgacgaacttgttccacaccagagtgaacagcttgccggccacgaaccctgcgatggacggcagcgcgaatttgacggccttatcgccgagggagtcggggtcgttcagacgctgattacgcatggcatccactttctcgttgattcgggcgaagccttcgatgatccgatcggtgcttgaaccgtcgagccccgatccgtcgttgcccggtccatcctgaaattctgtcatgtcaccattattttgcgaggtggagacgcatcgcatataggcctcggcatgcgaatatgctgcaggttgagtacagtactgcatatgactcaaacgacaggtggcaacgcggctacggcagggcgactggttctgctccgacacgggcagactgtgtggagtgagtccgggcagcataccgggcgcaccgatattcctcttaccgccgaaggcgagcgacaggcccgcgatgccggcacccggattcagacggcgtttccgcagggattcggcgagaactgcgtgtacgccagcccgctgaagagggcccagcagacggcaagcctcgccgggttcgctccgcgtacgctgccggcgctcgcggaatgggattacggccgggcggagggccgtacccgtcagaccatcgcgcaattgcacggcggctcttgggagctatggaatgatggtcccgatgcgctgagccccacaatggaaggcgactggacggagacgctgccggacggcgagcaggttcccgtgcataatgggccgggcgagtcgctgagcgacgtctatgaccgtgtgcagcaggccatcgatcaggcggtgccgctgatggagagcggccattccgtgctgttcgtcgcgcacgcgcatgtgctgcgcatccttacggcacgttggctgggggtcgacccgcatttcgcacgtctgctgcgtctggataccgctcattattcgattctgtccgtatacaagggggaccgtgtcatcgagcgctggaactgctgacgtccatgtacgtcggtaagaaaccctccgccggcgtcgacgccgaaggcctcaccgtcatcaacggcaaactggcgtcacaagtacaacaatgcgggcaagaactggcggcacaccggtgacgtgtggcggtacgggttgcggctgttggtcgcggcggtggtcgcagaggccccgtatgacaagatcgtgaccggccgatggtgggattggagcgtgatgaatcccatattcggacttctgatcgcgctggtggtctgcgccctggcggtctgaaacgggttcagtccgtgtacagggcgtctgactcgcgcagcaccagggtcggctgcacgatttcatgcggcttctcgggttcctctccgttgatgagcttgattgccttctgggcggccgaacgtcccatcttgaacgggtcctgtttcatggtggtgaggttgacggtgtcggcataggggctgtcgtcgaagccgatgatcgagtagtcgcgtggtgtgcggtgtccgtagcgttcgagcttgagcatcagcggaatcgccatcatgtccatctggcagcagatggcgtcggggaactcgtccagcgcgagcagtgccgacagcgccgaatcggcgaatgcgcgtccgcgcggcacggtgaccacctgccagttgagttcgcgcgtcttctcgacgttttcgcaggcgcggatgaatccgcggccgcgggcgtcgatcgaggagtccatggactcggacgccgccgagcaggcgtacacgatgtgcttgtggccgaggttgagcagatgctgggtggccgtgtacatgccgttttcgtcgtcgatactgatggaggcgtcgaatccgtcgatggacggcgtgttgatgccgatgatcggcacgcggatgcgcttgagctgttcgacctctttctcgtcgatggcgaaggacgccacgaacaccgcgtcgacgttgcgtcgcactggcaggtcggtgaagaacttgcgacgcatgtcggcggtgtcgatgtgctggaagacggagatgtcatagccggcgtcgtgcatgatcgagttgatgccggcgaagatctgggtgttgaaccagctggtgatctcctcgttcatgagcagcgccacgcggaacgtctgcccggatttcagggccgcggccgagcgggagatgttgaagtcgagctggtccgcggcctgcagcaccttgtgccgtgtcttctccgacacgacttcggggtgggcgaatgcgcgggatacggtggatatggagacccctgccgcttttgccacttcgcgtattcctgctttattcatgtagacaactcctttgctgtgtgctgaattccccatcgtgccgtgactgccgacatcatatttgtttcatcatactgcaaacgttctcaaagagaaaggggcgtgtgtaaggctctttgaaaatgaaaaccgttctctcggttacggaaaatgaccacggaagttcacgttacgttcggatactcgtcgcgcgacggttgaatggccgacatagtttgctcggtgagggccgcgaggccttccggcgctgccgagagaggcttgctgtgcccgacggcgccggtgattgaccgccggggcatgcccggcttcgtgattggaagaagagatccatgaacatcaacaaaatgctcaaaggcgccgtcgcggcgttgacctcagctgcggccctgggcgcgctgaccgctccggcgttcgccgcgagcggcacctacgatctgaacggcaagggcgtggacgccctgtcggtgcacggcggcgcccagcgcatcgccacgatcggcaacgcgaaggcgaagaacgtcatcctgttcatcggcgacggcatgggagattccgagatcaccgtcgcacgcaactacctgcacggcgtcaacggcacgttccagggcctcgacaagatcggccagccgggcgcactccagacctcggccggcaaggccgtcgaaagcggcgtcggccagtacaccacgttctcgctgggcggcagctccaacgattcgctgatggccaaggattccaagggccagctcaccggttccaagaccgccggcgtgatcaccccggtcaccgactcctccgcctccggctccggctgggcgaccggcaccaagacctacaacaacgccgtgtccgtggacgtcaagggcaacccgcagctcaacctcattgagctcgccaaggccaacggcctcgccaccggcaacgtgaccacctccgagatccaggatgccactccggcggtccaggaatcccactcctccgagcgcgcctgctacggcccgcagggcaagtgggacggcaccgacaagaacggcgacggcaaggtcgatatcaaagacgccgagctcgccggcatcggcagctgcctcgccgaccagctcaaggccaacggtggcatcggctccatctccgagcagctgctcgacacgcgcgccgacgtgaccatcggcggcggcgccaagtacttcaaccagctcgacgagaacggcaacaccctgtggcggcaggccgctgaccgcggtttccagaccgtcaagagcggtgacgtcgacggcttcaagaacctgacctacaaggatggccagccggtgctcgccctgctcggcgacggcaacctgccgacccagttcaacccgtctgtggccaccaagcaggacgccgccaaggacgagaacccgaccgtgtgcaccaccaacgccaagtggctcggcaatcagggcgcgtccctcgccgacttcaccgacaaggcgctcggcctgctgcaggccaacccgaagtccgagaagggcttcttcctgcaggtcgaaggcgcttccatcgacaagcaggaccacaacgccaacgcctgcggccagatcggcgagaccgacgaccttgacaaggccatctccgccgccctcaagaaggtcgacctgagcgacaccctcatcatcgtgaccgccgaccacgcccacacctcgcagatcgtcgaatcccagccgtactacgcgctgagcaccgtgctgaagaacgccgacggctccaagaccaccatctcctacggcacctccgagaagaacctgtactccgacggccaagacaccgaaggcgcggccgattccagcaaggcccagggcaacatgagccacaccggcacccagctgcgcattgccgcatcgggtcccggtgcgtcccgcgtggatggcctgaccgaccagaccgataacttctacacgatcgccggcgcccttggcctggcgaccgacaccacatcgcagaacaacctgtccaacggcggcaaggtcaccgtgaacaaggacaaggacggcaagtacagcgcggccgtcaccggcttcaacggtgacgcggtgctgtcgtaccagctggtcgacaacgcctccaagaaggtcgtcgccgagtccaacacgtccaccccgctctccggcgtgcgcgtcgccaccgcggccaccacctcgatctcgttcgccgacttcactccggccgagggcgcgtcctacacgctgacggtgaacggccgccagtccggcaagtccgcctccgtgagcttcccgtccgcctcaggctccgccgacaagacgccgaacggcggcaacggcagcggcactgtcgctcagggcaccgtcaaggagccgaccgcttctctgggcaagaccggcgcgaccgtgctcggcctggcgctgatggtgctcgctctgggcgccggcgcgatggccgtgcgctccgtcaaggcgggtcgccgctgagctgacgctcgccgcgattcgtgacgtcgcctggggcgactgatacgccagtcggctgcaacctgtgatggttgcggccggctctttgcatttgggggctctcaaaactcgcagatatggcggctttttcgctaagaaatcggtgtatctgcgagttttgagagcggacttgagtgatatcgactcaagtttttgtgaagaagtgggaataaaagctggtgctcgaaagttgagtagtgtaggctcaagttttggaaggcaaaacgagggcaaccttgaggcgaagacccgtgggcgtcgatcgagcaccgatggccgcggggccaagacttgagcaagcaaacgtaaacgaacaagatatctaaggagcacacattatggcacgtgcagttggtattgatctgggtactacgaattcctgcatcgcgacccttgaaggtggcgagcccaccgtcatcgtgaacgccgaaggcgcgcgcaccacgccgtccgtggtggcgttcagtaagtccggcgagattctggtcggcgaggtcgccaagcgtcaggccgtgaccaacgtcgatcgcaccatcagctccgtgaagcgtcacatgggcaccgactggaccgtcgagatcgacggcaagaagtggacgcctcaggagatctccgcgcagatcctgatgaagctgaagagggacgccgaggcgtacctcggcgagcccgtcaccgatgccgtcatcacctgcccggcatacttcaacgacgcccagcgtcaggccaccaaggacgccggcaagatcgcaggcctgaacgtcctgcgcatcatcaacgagccgaccgcggccgcgctggcctacggtcttgagaagggcaaggaagacgagcgcatcctggtcttcgacctcggcggcggcaccttcgatgtgtccctgctggagatcggcaaggacgacgacggcttctccaccattcaggtgaaggccaccaacggcgacaaccacctgggcggcgacgactgggatcagaaggtcatcgactggctcgtcggcgaggtcaagaacaagtacggcgtcgacctgtccaaggacaagatcgcgctgcagcgtctgaaggaggccgcggagcaggcgaagaaggaactgtcttcgtccacttcgacctccatcaacatgcagtacctggccatgacgcccgacggcaccccggtgcacctggacgagaccctgacccgtgcgcacttcgaggaaatgacctccgacctgctgggccgctgccgcacgccgttcaacaacgtgctgcgcgatgccaacatctccgtgagcgacatcgaccacgtggtgctggtcggtggctccacccgtatgccggccgtcaaggagctcgtcaaggagcttaccggcggcaaggaagcgaaccagtccgtgaacccggatgaggtcgtggccgtcggcgccgctgtgcagtccggcgtcatcaagggcgaccgcaaggacgtcctgctgatcgacgtgaccccgctgagcctcggcatcgagaccaagggcggcatcatgaccaagctcatcgaccgcaacaccgccattccgaccaagcgctccgaggtgttctccaccgcggaagacaaccagccgtccgtgctgattcaggtctaccagggcgagcgtgagttcgctcgcgacaacaagccgctgggcaccttcgagctgactggcatcgcgccggctccgcgtggcatcccgcagatcgaggtcaccttcgacatcgacgccaacggcatcgtgcacgtgtccgccaaggacaagggcaccggcaaggagcagtcgatgaccatcaccggtggctcgggcctgccgaaggacgagatcgaccgcatggtcaaggaggccgaagcccacgaggccgaggacaagaagcgcaaggaggacgccgagacccgcaaccaggccgaggcattcgcctaccagaccgagaagctggtcaacgacaacaaggataagatctccgacgagatcgccaaggaagtcaccgacaaggtgaacaccctgaaggaagccctgaagggcgaggacatcgagaagatcaagagcgcgcagagcgagctcatgacttccgcgcagaagatcggcgaggcactgtacgcgcagcagggtgctgcgggcgctgctgatgctgccggtgcggctgccggtgcgtcgggtgccgcctccaacggtggcgatgacgacgtggtggacgccgaggtcgtggacgatgacgacaagaaggacaacaagtaatcatgtccgagttcaacaaggacgattacctgaacgacctgcctgacgcggacaacctgtccgccaccgggcaggccggcccttccgacggcgctgccgccggttctgccggcaaggcgtcggactcggccaagtctgcggatgcgtctgctgataagggcgctgccggcccggctggggacaaggcgtccgccgaagcgggcccttccgataagaccggtgactccgctgccgcgggtgcggatgacggagcggccgccgacgactcgctgaccccgctgggcaaggccaagaaggaagccgccgactatctcgaagcgttgcagcgtgaacgcgccgagttcgtcaactaccgcaatcgtgcgcagcgcgagcaggagcgtttccgccagcatggcatcatcgacgtgctgaccgcgttgctgccggcgctcgacgacatcgatcgcatccgcgaacacagcgagatggacgattccttcaaggccgtggccgcgaagatcgacaaggcgttcgagaagttcggcgtggagaagttcggcgaaaaaggcgaggaattcgacccaaccaagcatgaggcgatcctgcacaagccggacgccgaggccgagaaggagaccgtcgacacggtcgtggaagccggctaccgcatcggtgaccgcgtgatccgcgccgcccgcgtcgtagtagcctccccgcaaaactaacccccccccaagaggagtttgcggaaatccggctaccctcagatttccgcaaaccacctgtctcatctcgctgtcaccgcggcaagcgtgcgataccacactcgcgcaaaacatgcacccgactcggagatgcgacgcaagtcactgcacctaacgagtgcggagcgggcgggcatgttgtccgaccgtaaacctcggcccgagcggcctggagcgaagtcggacaacatgcccgcccgctccgcacggtctacggtctccgcaccgccccaagcgtccgctaccccaagcgacaaaactccgcacggtcgcgcgttgaccgcagacacgatcacatcaccgtcgtctccgctccggtcacagcaaacatgccgacctccgcggtgacgaacgccaatacgcaacaacagaaaaacaacatacgacacacatacacgcatacacgaaaggagacctgaatggctgagaatgaatggctgagcaaggatttctacaaagtcctcggtgtctccaaggacgccaccgaggatgacatcaccaaagcgtaccgcaagctggcgcgcaaataccatcccgacctgaacaagacgaaggaggccgaggagaggttcaaggacatctccgaggcgtacgacgtgctcagcaacaaggagcagcggcagaagtacgacgcgatccgccagttcggcatgggcggggcgcgtttctctggcggctccggccagggcgggttcgacgcttccggattctcggatatcttcggttcgatgttcggcggcaacggcggcaatgtgcgcttcagcacgtccggcggcggtccgagcaatctcaacgacatcttctcgatgttcggcggggctgccggtgggcgtggcagtgcgagctatggcggttcgcgttacggtaacccgtatgaggagccgccgactccgcagcgcggcgatgaccgcaagtccaagatcacgttgacgttccgtcaggcggtcaagggcgctaccgtgtcgctgcgcgtggacggcaagcagttcaagacgcatattcccgccggggtcaaggacgggcagaagattcgtatcgcaggcaagggcaagccgggcagcaacggcggcgcgaacggcgacatgtatctgaccgtgcaggtgaagccggatccgcggttcacgatgcgcggccatgacatcgtcatggatgtgccggtgaccgtaggcgaggctgtggccggtgcccgcgtggaagcgcatgacatcgatggcgagaccgtcacgttcaaggtgccggcgggctcgtccagtggcgcggagatccgtgtcagcggcaagggcgttcagtccgccactgccggcgacctgattgggcgcgtgcagattcgcgtgcccgcgaagcctggtctgggcgcgaagcacgccgcgaaggaattcgacaagtccgtcgaaggctacgccgaagcggttgccgccgagcggtaatcctcccggcggcatctcgcatcgtcgcggagcgactgggggcggttcaccatcaccccgcagccgataatcaacgttaaggagatgatgatcatggcgcgaatcgcacaggaagtcaggcgtgcgtatgctgcttgcgccgcggcgttggtctccggcggtgttgatctcgatgcaatcgacgcgctcggcctgaacgtggagatgccggtgttcacggtgagccaggcggctcagatcgcgggcgtgcatccacagacgttgcgtcagtacgaccgccttggtctggtggtgcctcagcgcacggagggtggtgcgcggcgctacacgcttcgtgacgtggcgcgtcttgcacaggcgcagcagttgagccaggacgagggtatcaatctcgcaggcgtcacgcatattctttcgttgcaggaggagaacaggcagctgcgccggcagattcggcatcttcgccgtcgactggacggcgatagcgtgttcgaggccggtatggatggtgaagtcgtcgaggtgcggcagtcgccgttctatcatgtgcgtcggcgcggacgcgcatatatcgcaccgttgcagatcacatccggtcgcgaataggcggccgtcatcccgtcatagtcccatctggcgtccgctggatgggacttttgtcgtatggggacgtcttgtatcccgccatcgtcccgttttattcctgtcggatgggactttgggcgggtgctggatgggaagtgggggaatgatacggaattgcagacaattgtatgtcattttgttcacaatgtaggctataatactgtacccgacagcgattttgctatgccaatgaagattgaatagcaagatactatacaaataacgcttgatggtgaggaagccatgccgtcccataggtggaacggcggtcggggcccaaagtcgtgacccggcgttgcacaggagaggaacacacatggttcgttcgaccaagccatcgctgctgcgccgtcttggcgcgctggtggcggccgctgccatgctggtggtactgcccgcaggggtatccaccgcgagtgcggccagcgatgatgctgacatgctcaccgtcacgatgacgcgtaccgacgccctcggcgacgaggtatatgtcggtgacacgctcacctacagtttcaccaacaccaacaacacgagttcggcattcaccgcattccccgccgagtcgaatctgagcggtgtgctgaccacaggaacgccgaactgccgttatgagaaccttgcgggaggcgcttcctacccttgctccacggccagccacaccatcactgcggatgatctcacggccggcagcttcaccccgcgtaccgtgtggaaggccacctctgaccgagggggcactcaggtgctgcaagacaacatcgtctccaccggcgataccgtcaccgtgaaggaaggcaagcgccccgatccggccaccatccccacagaccgtgccgatggtgaggccgtgcgcctggccaccgcccgccagaacctcggtaccgaatgctaccgtattccggcgctcgccgaggcgcccaacggctggatcctcgccgcattcgaccagcgtcccaatacggcgatggccaacggcagcggcgtcaagtgctgggatgccccgcagccgaactccatcgtgcagcgcatctccaaggatggcggcaagtcgtggacgccgatccaatatgtcgcgcagggcaagaacgccccggaacgctacggctattccgacccatcctatgtggtcgataaggagaccggcgagatcttcctgttcttcgttcactcgtataacaagggcttcgccgactctcagcttggcgtcgatgagagcaaccgcaatgtgctgcatgcggtcgtcgtcagctcaaaggacaacggcgagacgtggagcaagccgcgtgacatcaccgctgacatcaccaagggttacgagaacgagtggaagtcccgtttcgccacctccggtgccggcatccagctcaagtacggcaagtacaagggtcgtctgattcagcagtatgccgtgggccgtacgaccggttcgaacgccgcggtatccgtgtactccgacgaccatggcaagacctggcaggccggcaacccggtgacgggcatgctgatggatgagaacaaggtcgtggagctgtctgatggccgtgtgatgctcaactcccgcccgggtaacggttccggttaccgtcgcgtggcgatttcggaggacggcggcgtgaactacggtacggtcaaaaacgagacgcagctgccggatccgaacaacaacgcgcatattacgcgcgcgttcccgaatgctcccgagggctcggcgaaggcgaaggtgctgctgtactcgtcgccgcgcgcgaacaacgagggccgtgcgaacggcgtggtccgcatctcgctcgatgacggtaccacgtggtcatccggaaagctgtacaaggaaggctcgatggcctactcggtcatcaccgcgctgagcggtgccgctggcggtggttatggtctgctgtacgaaggcgcttgggtcaccggcggcggcattgacagccacgacatcatgtacacgcacatttccatggattggctcggctacctgtccgccaccgcagatgacgtgaccgcttcggttgaagagggtgccagcacggtggacgtgaccgttccggtgagcaacgtcggttctgtggattacaccggcgtgacggtgactccggccgatctgccgaccggatggtctgcctctccggtgaacgtgggcgctcttgccagcggcgcgtccaaggacgtgaccgtcacggtgaatgttcccgcaactgccaagaaggacgatgtcgccaagatcgtcctgcgtgtgaccggcacgtccgctgcgaatgccgacgccacgaccggctttgacggctccatcacggtgaacgtcaccgaaaagagcgagcccgatcctgagccggagccgaccatcaccggtgtttcggcggtgacgtcgcaggctggtgtgaaggtcggtgacgtgtttgatgcgtcgaaggtgtcggtgaccgcggcgatgagtgatggttcgtcgaaggcgttggctgccggcgagtattcgctgtcggctgtggatgctgacggcaaggcggtcgatttggctgagccgttcgcggcggctggtgtggtgacggtcacggtgagtgtgcctgtggagggtgcggatccgttgactgcctcgttcaccatcgacgtggccgagaagagcgccgatcctgagccaaagcccgaacccaagcccgaaccggagaagccggccggaccgaaggtcgacgtgcccaccgagaagcccggcctgtccaagaccggcgcttccacggcaggcatgtccatcgtgttcgtcttgttggcactgtccggtgttgcggcgttgtcgctgcgccgccgctccgctcactgatctgaccgagacctcactgccgcggcggtaaaccgtccgaccgatgagtgacggcatacaggaaaagcccccgaaacacgggggctttttcatgttgtaattcgttcactctgtagactacaatgagggaaatttcagcgtatcgctgtgattctcatataaccgatagttcataaaaattatgcggtaaagaagccgactgcgccgaagaagacgctgctacccccgtatcggtccggaagctgacctgccgcagagaagaaagactcgatatgaccacaatattccgacgtgccacggcaaaaacgctgatgcgcaagctcagcgggctgctggtggccatcgccatgctggcagtgctgccggctggcaccatcagcgcgaatgcggcggacgaaacaccccaagaatatctgcaactcaccctgacccgcaccgacagcaacggcaccccggccgaagtcggcgacaagctcacctacagtctcggctacaaaaacgtttccgataccggtttcattgtgcatcccacggcgtcgaacctcaacaatgtcgccacgccgcagtcggcgagcaaccccaatcccatgtgtcggtgggggaatctcgcggcgggtgcttcggctgcatgcacttggagcgcgagcaaggagttcgcctaccatgtggtgaccgaagacgatgtcgcaaacggcttcacgcccaccgcgaccgtgtcggcgaccactcaggacggcaccaatggcgttctgcaaagcgtcgacatcaccggcgagacggtgccggccgtccctgcgacctccacactgcgcgtcgccatgcagcgtaccgatacgctcggcgataacgtgaagatcggcgaccggctgaccttcaacttcacctacaccaacaaaaccgcgcagaagatttatgcctacccgagcgagtcgaacatcgaacgcgtggacgtggtgtcctatccgagaaacagctgccgatccggagtggaggccaaccggaccgcatcatgtgggttcgcctatcacgtcatcaccgctgaggacgtcgtggcccgcagatacacgccgacagccacattccgcgccacatcggatcgcgacggcacgcaggtgctgcaagatgacatgacgttcaccaccggcacggtgaccgtcgcggggccggccgacgacgccgcgtccacgccgacggagcgcaaagacggcgaaccgctcctgctggcgaccaacaagcagatcggcaacaccgattactaccgcatccccgccatcgcgcaggcacccaacggctggattctcgccgcatgggatttgcgtccgaaatcggcggcggacgcgcccaacccgaactcgatcgtgcagcgcatctccaaggacggaggcaagtcatgggagacgctggcatacgtggcgcagggacgcagcgccaccaacaaatacggctactccgacccgtcctatgtggtcgacgaggaagccggcaagatcttcctgttctgcgtgaaatcgtacgatcagggctactttggctccgtattgggtgtggaagatgcacgcaacgtgctgcaggccgtcgtcatggaatccgacgacaacggcgcaacatggagcgagccgcgcaacatcaccaaagacatcaccaagggtcacgaagacgagtggaagtcccgtttcgcatcctccggccatggcatccagctcaagtacgggcagtataagggccgtttgatacagcaatacgctgtgcgcaccacgagcaacacgaacatcgcggtgtccgtgtattccgacgaccatggcaagacctggaaggccggcaaccccgtgaccgaagcgaacatggacgagaacaaggtcgtggagctgtccgacggtcgcgtgatgctcaattcccgtccgggcgcggcgggataccgtcgcgttgcgatctcggaggacggcggcgtgaactatggtccgatcaagtcggagacccagctgccggatccgaacaacaacgcgcagatcacgcgcgcgttcccgaacgctccggaaggttcggcgaaggcgaaggtgctgctgtattcggcgccgcgtgcgagcaacgagggccgtgcgaacggtgtcgtgcgtgtttcattcgatgacggcaccacatggtcggccggcaagctgttcaaggaaggctcgatggcctactcggtcatcaccgcgctgaacgacgccgccggtggtggttacggtctgctgtacgaaggcgaaagcatcacctacacgcgcgtgtcgatggaatggctgggatatctcaccgccacggcgagcggcaccgcgaccgtcaaggaaggcgaggggacgctgaccgcgccggtcaccgtcaccaacgacggtctgaccgactacacgaacgtcaccgtgacccccacaggtctgccgtctgattggagcgccgaagccgtgaacgtcggcaatcttgccgccggtcagagcgcgaccgtgaacgttccggtgactgtgcctgcggcggctgtcagtggtaccgtcgcgaaagcgacgatgaagatcaccggcaagtacgcgcagtccgaagacacgctgcacagcttcgccgaaggcgagttggcggtgaccgtcaccgaaccggatcccgcagccaagcggctcaaactcaccatcgaacgtaccgatgacaacggagacccggtcaaggtcggtgacacgctgacctaccggatcacctatgagaacgtcggcacgcagtcattcgcggtctatccgcgcgaatccaatctggacggcgtgacgaccccgcagtcggcgagcaaccccgctcccgtatgccggtggagcaggttggctccgggagcgaccggtgcatgcgtcagcggcaacggcaaacagctcgcctaccacacggtgacggaagcggacgcgacggccggctcgttcacgccgagcgcgaccatcgacgccaccgcagacgcgagcggcgagacggtgctcgaatcagtgtccatcaccggtgaccccgtcaccgtgagccagccggtcgaactgccggcggacatcgccgcatggaagacccgcaacgaggcgctcgacgactggcaggcgctctccgaaaagctcgcaaagaccgaccgtatcaactggctgttcaccggcgactccatcacgcacggcgtgcagttcacgcgcggctaccgcacctattcggaactgttcgcgaaccatctggacaccacgtcggtgcgcggtgtatcccgcgccaacgatgtggtcatgaacaccggcatctccagcgcggacgccagttggccgctcaaggacggcgcattcgagaaatgggtgtccgacaagcaccccgacgtcgtgttcctcacgttcggcatgaacgacgggcgtacaggccaggcgttcaccgtcgaccagtacatcgccaacctgtccacactgattgacaagatccgcgacctcggcgccatcccggtgctgcagacgcagaactacacgaccaacacgacgttcaacgccaacctcgacacgtactttgacgcggaacgtcgactcgcgctcgacaagaacgtgctgctggtggacttcaacaagcagtggctggcacttggcggcggcaaccgcgaatccggcacgtatatgggtgccggcaacgacatccaccccggcgagaacgggcacatcgaatgggccaagttcacgctgggagcgctcaatatgatcgccaacgacgacccgctcgcccggtggagcagctccgacacgacactggacaagccgaccgtgacggtggacgccgacggcaacgggctgaagggctcggacgggcttgaacccgccccggccgcggccaagtccgtgggcaagttcctctccggcgcacagtacgttgacctgggcggcgatgtggtgagcgctgtggccggcaagcgggagtccaacgtgaccatcaggttccgtgcgtcggcgaccggacagccgcagacgctgttctcgctgggcgactccgactccgcgacccgcgcgaccgtgcgcctgagcgcgaccggtctggtgcagtttctcaactccggcaacaccggcgacttctacacggtcggcacgaacgacctcgcggatggcgcatggcatacggtgtccgtgaacttcgtggcgaacggcttcacgatctatgttgacggagccgcgatgcgcgcgatcagcggcggcgcgggcactcagctgaacgtgccgggcgcgatcacggtgaacacggccacggccggcgcgatccgcgggaccgacagcgccggcggcgcgcagcagctcaccggcattgtcgattacgtcgccgcatggagccgcacgctgaccgatgcggaagccaagcgaatcagcgccgaaaccagtgccgtggcggtgacgaaggtcgatgcggcggtgaacgcgttgcagccgatcatctccgataccggtgctcgcaaaaatatcgtgttcatgggtggcgagaccatcgaaggtgggtatacggatcatctgattgccaagaacatcgtgcagctgctcgacgagcgcgtgcgctgggaatacgtcaccgggctgagcgccacggaccgcgaactgcagcgtgccaagttcttcgtggcggccgggcagggcggtctaactgccaagcagatggacgaggactacgctgcgatggtggacgagtattcgccggacatcctcttcttggctccggacctgtatgacgctgacgggaatcttgcggaaagcgacgccgccgcgttcgccgggcatattcgctccgtggccgccaaggcgaaggaggcgggcgccaaggtcgtgctggtgacgccggtcaccgtgcgcggcggggaagacgagtatgccggcgctatgcgcacggtggccaaggaagacgatttgccgctcatcgacgcgcaggcgtggatcggcaaggtcgtcgccgctgacgcgagcgtcaagaccgcgtggttcaacaaggccggccagctcaactacgccgggcatctcggttacgcgcgattcatgatgcgctcgctcgacctgtacccgagcaacgtgtcaggcagccgcatcgcgtcgctgccgtacgacaccgccaatgttactttggtcggagcgagtgaaaacggtggcgagctgccggtcgggcgcgtcgagggcaccgacagggcgcacatcgacaccatgcagatcggtgcggcggcttcgctggtggtcgccgacagctacgccgtctacgagatcggcgaggacggcgggcggaccctggtcgcggacggcctcaagcccgcggatgtgcttgcggatggcatcgacgtgaccgtaaacgatacggcggcgcaccggtatgaagtggtcggttcggcgaacgtgccggagggcgcggatgccgtgaccgtgacatatacggcgacgctggcggctgtcgaggagccggagcccgggccggatcccgatcccactccagacccgagcgaaaagccggacggtgacggtaccggtgacggcactggcgccggtaccggcgacgtgcagaagccgaccccggacgctgtggcgaaaaccggtgcggatgtgttcggtcttcttaccgcagtggcggcgctgctcgcggcaggcggtgtgacgctgtcgctgcgccgtcgcgcgaatcggtaagtctcttgactgggcggcggcagtcaacggttcgtttcgatttcgactgattgccgcagcccgtaccgaatcggttgactggtcttgagggccgttggcggaaatcctgccagcggcccgctttcgtttgcgctgattgcgggttgcctcggtcgaagtatggtcgttgctgagtcatgagcgtgtaatggacgtcaagaaaatggacgtcaagaatcaggcgccctcttcgaggtcatctgggataatgaaaacgaaagcccggttgctgggcatgcaggcatacagttggcgtcaatacaaggtgggttgtgcatgagtgacatgttgttgaaggccgtgttctgggatctggacggtacgttgatcgattcggaaccctactggcacgagggcgagatggagatcgccgcggcgcatggcgggtattgggatgaggatctagcgtggtcctgttctggcactccgcttgaccattgcgcgaaaacgatgatcgagcacgggacgaatctgccgcccgagcagattgccaaggcgatggtcgattacgtcgccaagaaggagttcgagagggtgccttggacgaatggcgtactggacgtgctggggtcgctggtcgatgccgggattccctccgtgctggtcacgacatcgccgcgcaggctcgctcagaacgtgattgatcatgcgccggccggcgcgttcgctggattcgtctgcggtgacgatgacctgccgcataagcccgatccggctccatatctggcggcggcgaagatgctcggcatcgaaacgggcgtggccggagccgatgtcgccgcggcactccctggcatcgcgaggtgtgtcgctttggaggactcggccacgggcatcgcctcggctgtcgcgtccggagccacgaccattgcccagctcggcttcaaccgcaacgccaaagccgacggtccgcaatgcgcctccatcgacggcttcgccggcatcaccgccgaagcgctgaatgccttcatccgccagcgcctcggctcctgaaccaccagcggttgctgaatcttcctcccgctggcggggctgtcgactgaaagccgactgggggtggtctttaccatgggggcggtctttaccgtatcggctccagacccccccccagtctcgctgtgctcgacagcccccgccagcgggggcgtatggtcatcgggggcgaaaaatgaaaaaggccgatcccggtggaatggaatcggccttcgtggagctgatggtaatcgaaaccacgacctcttcgatgcgaacgaagcgctctaccaactgagctacagccccttggatgttgccttgcttcgcaggacaacttaatacacattaatacgacccatgtccaaatgcaagccggcgtgtgtgaaaattgggtgccggttatgggctgatatgcgtcactgtgcgtggggtgcgtcactgggtgagccctcacccagtgacgcaacggaacgtaatcaggcaggccgggcggccaacaggagtggccggtcgcgttacttgttctgcgtgccggccgccacactcgatgagttcgccgcggtaccgggcttcttgccgaatttcgccttgagcagtccgatgatggtcggcagcagcgacaccagcagaatcagcacgatgaccaattcgaaatgcttctgcacgacggggatgttgccgaagaagaatcccagcagtgtgaacagcgtggaccagcacaggccgcccagcaccgagaacggggtgaaccggctccagcgcatgccggaaataccggagatgaacggcatgaacgtgcggatgaatgggaagaaacgcccgaggaacaccgccagtggcccccatttttcgatcatcttctcggttttcgccagccgttccggcgtcatggccttcaccttgcctgacgcgatgattcggcgtccgaagaagtgtccgatgaagtagttgctctgatcgcccaggatcggagcaatccacactatgggcagcagtgccatcaacggcagcccgctgtcgccctgcgcggcgaagaagccggctgcgaacagcagcgagtcgccggggaggaacgggaagaacaccacgcccgtctcaatgaatacgatgagaaagatgaagccgagcgcaggtgcggtgcccatggcaatccagctggcgattgcgccgcgagggtccttcagcaaattgacgatgaaatgaacgaaacccatgaaaattcccgtcactatcaatggtgtaattccattaagaaaactctaagaaccataccagcgggggtgtaacaggggagacgcggtatatagcggtgcggataggcggttttgcgttcttaagtgcgcgctgaaacgacgaccgtgcgcacttaggtacgcaaacagggtcatttgcgttcttatgttcgcgcacttgtcgtttcggcgtgcacttagggacgcaacgggtggtcgtcaggtacttggcgtgcgggatactgggaaccatggatactgtgcaagatgattcgcaagtcgtgccggagggcgcctcgccggacgccactgtaccggacgccactgtaccggacgccaccgagccgaaggccgccccgcggacggtcatggtgccgagcggcactgttgtgctcgccgccacgccgatcggcaatgtgggcgacgcctccgaccgattgaaggcgctgctggcggacgccgacatcgtcgcggccgaggacacgcggcgactgtatgacctcgcgaaccgactcggcgtgcacgtgaacggcacggtcatcgcctatcacgaccacaacgagcgagccaaggccgacgggctgctcgaccgtgtggagaccggcgccaccgtgctggtggtatccgacgcgggcatgccgaccatcaacgatcccggactggcgatcgtgcgccgggccatcgagcgtgggctgccggtcacgtgcgcgcccggaccgagcgccgtgctcgacgcgctcgcgctctccggcctgccgaccgaccggttctgttatgaggggttcctgccgcgcaagcactccgaacgcgtgcagcatctgcgcatgctgcagtccgagcgccgcacgatcgtgttctacgagacgccccatcgcatcgcggattcgatggatgacctgctcgatgcgttcggcccgaaccgcgcgatggcgttgtgccgcgagctgacgaaggattatgaggagattcgtcgcggcatggtcggcacgatacgccaaggcgtcgttgacaatccgccgcgcggcgagatggtgctggtgattggtggcgcgtcggatgaggaggcggaggcggccgcgccggcgacgttgagcatcgacgatctggccgtgctggccatcgaccgtgccctggaggatggcgtgcgcatcaaagacgcgatcgcgcaggtggtcgccgaacatccgctgccggatggctcgttgccgaaccgcaagcaggtgtatacggccgttctggcaatgaaatcctgacttatgccgccggcagaccgtcgagcaggatggtcagggcgcggttgacgccggggccgcccgcctgcgcgacgtattccagaagtgcggcgtccgcgctgggattggcgaccagccagcgccgcagttccggctcatgctcggcgatgaaccagagcacttccggcgcggtcgcgggatcgcacgccagcagcggggagagtctgagcggcggagggggaggggccgcccgcgttgaccgccgtgacgccgtcgcctgttcacgccgttgcagagcatgcatccgtctgccgggaatgctcttgcgtttggctcgtctggcttgactgtgtcgaagccgtcgcctggccgtccccgcgcggggacgctcgcacagcgtctccgcgggattctgcagtcgctgcaatgtcttctcctgtgatggcattcgcatgtggctctcctttcgtcgtgttgatgtgtcgtgctgatgtgtcgtggcggtgagccgtgtcgatggttgagtcggacgggaggccgatgcggccccgcgaccgcttgcaatcagaagaaatgcttcatcgatgtgaacagttccctagccggttgggtgttcggccagaaatggttgtcatcgagcgtctgcatgcactgcgtaagactgacctgatactcctcgaacaaggcgcacagcacgtcgcacgcgtcatgctcgttcagctctcccggcgtcagcagcgcgatgtcgcaggctgtgcgcatcggcgtggtgatgcgcaggttcccgacctgtatgacgtgctcgggagccgtcttgcggttgaagacgcgaatcttccgcccgtgcgaatccgcccggtaatgggagctggatatgacatcgaccgtgcgcgggaacgtgccgccgagccatacccacgcggcggtgagcgcgcatgcaatcgtcccgaacgggatgagtttcagcgcgatcatcgcgcggccgtacagggtgtcggcgtgctcggcgctgtatgcgttggtttggtcgagcgagtgcagggtgccgaaatgcgtcagccgagccatgctgagcggaccgggaaggtccttgtgggtgagcagtggcgtggtgtcgatacgcggcatggtgccgcgcgcgatgaggtcggaaacgattgcgacggcgttgtcgctgcggctgattgtgccggctgactccgtgccgggccgcgttgcgccgggctgagtcttgcttggtgccgtcgcagtgggtcgcgttgcgctgggcggccctgtgtcgggctgtgtcgcgttgggctgcggcttgccgacttttgccgcttcagcgacatccgtctggtcgggcgccggcgcgactccatatctgatatccgaaggcagtattctgttcatacgccgaccataaccatacgatgcggcggtccgccaccgacctggcgaaatctgtggatatgtgcataactcacattccgcgacgccgcattgtggataatgctgtggatatgccgcggtgtccccgctgagccggataatcgggatttatgagtcatgttttggtaaatgtcgcttggccgtacgcgaacggcccccgtcacatcgggcatgtcgccggtttcggcgtgccctcggacgtctacgcccgatatgagcgtatgaagggcaacgacgtgctgatggtgtctggcaccgacgagcacggcaccccgattctcgtcgaggcggagaaggagggactgaccgcccaggagctcgcgaaccgctacaaccgcgtgatcgccaaggacctgtgcgacctcggcctgagctacgacctgttcacccgcaccaccaccggcaaccatgagcatgtggtgcaggagctgttcaagcagtgcctgcagaacggatacatctataagggcacgcagaaggtcgcgatctcgccgtccaccggacgcacgctgccggaccgctacatcgagggcgaatgcccgatctgccacgccgacggcgcccgcggcgaccagtgcgacgcctgcggcaacgagctcgaccccgacgagctgatcaaccccgtctccaggatcaacggcgaaaccccgcgcttcgaggagaccgaacacttcttcctcgacctgccggcgctcgccgaggcgaacctcgcgtggctcaagacccgcaagggctggcgcaccaacgtcatcaacttctccatcggcctgttcaaggaagtcaagccccgcgccatcacgcgcgacatcgactggggcatccccgtaccggtggcgggatggatcgacaatccgaacaagaagttgtacgtgtggttcgacgcggtgatcggctacctgtcggcctccatcgaatgggcccgccgccaaggcgacccggagaagtggcgcgagtggtggaacgacccgagctgcccggcctactacttcatgggcaaggacaacatcaccttccactcccagatctggccctccgagatgcttgcctacaacggcaagggttccaagggcggagagaccggtgaactcggcccgctgaacctgcccgagcaggtggtggccagcgagttcatgacgatggagggcaagaagttcagctcgtcgcgcggcatcgtcatctacgtcaaggacatcctcgctcgctaccccgtggacgctgtgcgctactacatctcgatcgccggaccggagacctccgacgccgacttcacgtgggccgagttcgtacgccacaacaacgaggagctggccgcgagctggggcaatctggtcaatcgcgtcgccaacctgatcaacaagaacttcggcgagatcccggcgctcgacgaggactcgatgaccaacgaggaccgtgcgctgctcaaggagacctcggacgcgttcgacgagatcggcgcgctgatcgagaagcatcaccagaagaacgcgctggtcgccgcgatgcgcgtggtcggcgacatcaacaagtacatctccgccgaggagccgtggaagatcaaggacgacgaggctcgtctgggcacggtgctgcatgtggcagcgcaggcggtgtacgacgcgaaccaccttctggcgccgttcctgccgcacgcgtcgcagaaggtctacgaggcgctgggcggctcaggcgtattctcgccgctgccgcgccttgaagaggtcgaagacctcgacaagccgggcttcacgtacccgatcatcaccggcgactacaagctcggtgagaccgtgcacccgtgggagagcgagcgtctggtggccggcactccggtgccgaagccgcatccgattttcgcgaaaattccgcctgaggctgtggccgaggagctcacccgcttcgacaccgagctcgccgcccgcaagaaggccgaggctgagcggtttgccgcggctcaagccgaactcaagcagtgaaatctaggcgctgacaagggccgttgactgttgaggctttgttgtaatccccctgacatatgaatgtcagggggatttttcgtccaatacgtgagcaatggtagaaaataggaaatatttttcgtatattatgctcaactgacagtcatacaaggaagtgacgccgcgctttggcggctatcgcatgtgttgcgatgaccggcatcatgcaagtaccggcggcgccggccgccaccggtaccggtgtcacggccggcgagcaagtcgacctgaccgatgtggcaccctctggtgccaaacagtcgttcgcgcccgccgcggaatccttcagcatggccgttagcgagcaacgtgactccgccatgcgcatgagggtcatggacggggtgctcaaggcgctgcgcatgcgcatcaacggtgtcatggaagctggcgcggccatacccctcactgagagacgtcggcaattccccttcacgccgatgaccaccgggacgctgctgctgacccgtgacgagctcatggacgtgcagcagcgtatcaatgaatacctgcggctgagcgagcatcggcgcggcagcgattatgagtatcaggtgtcgtatgcgtggtcgctgctgccatcgaacccggctgcggtagttggggaggatgtggatgcggtgggtccgcagaggatgattgcgacgaccggtgaccacccccagtcgctacgcgacagccattcgggccctgcaattggggacggccttcggccgcagcccacttgctcgcctgtcggatcgccttcgtctacaaacagctctgccgtttgctcagcccgccgcaaagtgacggagggttgttaccggtgaagaacggccatgttccttgcctattggccggttttccgtacattgtgccgggatgtgactacatgctcacaagtcgggcacacatctcacagataattccgaggaacgtgcatcattcctccaagcatgatgcggttatatagaacatgtcagcggttgttacaacgttggcgaggttgttgaaaccccataattgaaccccttcttctctctcttctctcacccggcggcttccccgccgggttcttcttttccggtgtgtggttgcgcctatcggaccggagcgtgagggcctttcatccaaccccctgacgcgacacgcccggattgcgtagcacaatcgtctatctgcgttcacagggtcgcggcattccgccattctccggaatgccgtgcttcaattgtgcgaagcaatccgggcgtgtcgcatcaggggttggatgtcggactgccgcgcacggcggattatgaagggatttcgatcgtgcgtgcggcacgatcacaacagttgcatgatgttcctttcattgttcgggtcggcacccggcctaccgtacggtgaagccttactcttctccatatttcttgagcgattcgccccactgctgcagggcctcgtgcaaggtgagtttgccgtggtatgactggccgatggaatccacggcgatcgagttcgcgtacgccgtgtacgacagatacgtgaagtcggtgcgcacgtccttggacgcctgggcgatgacggcgtggggcttctgccctccgaagaaatcatcggtctgggccgcgggtcgccgagcgtcgatttcagcggaggaatgccctcctgcgcaagattccccttcacgccgtcgccgtgcgcgaacgtgtaggcggccttggcctcgcggtcgtctgtgccggtcggcagtgcgagcgcaccgcctccgttctccccgttcggggcctccccggcagcatcatcgcgctggtggtcaaggacactgccgacggcgtctcgtcgcagatcctcaaaggggcgcaggtcacggccatggaatcggacagcgcggtgagcgtcatcgaaacggggtcgtccgggcagcgcacacagcagatgctcgaccatctcgccgacaaggtgaacggcgtcatcctgtccaccgacgcgcccggcatcagtttcatccgcgactatgcgaagcgcgtgccgctggtcgtgctgaactgtcctctcgaaggcgtggccagcgttgtgcccgatccgcgcatcggcaccgtgcgcgctgagcctgctgaaacgctcgcggtcacgtacgtcgccggcccggccgcgtcatgggccaatcagtcgaggtggccgcggtgcatgacatcgggaaccgcatgggattcaaggtcaatcagataggcccggtgcaccccacagtcgagggcggctatcaggccgcgctcgcattggagggaggggacaccaccgccatcatcacctacaacgatctgatcgcggtgggcatcgtgctgcggttcaccgccgacggcgtgaacgtgcccggtgacgtgtcggtgatcggattcgacaacacgctgatcgccccggtggtcacgccgccgatcacctcgatccgcattccgcgcgcccagctggggcaggtggccgtacgccatctgctgctgatgatgatatcgccgatgatcctgctgggggtgttcctgtggattccggagatgccgttcggcatatacgtgttcgcctgctggcggtgtacctgggagatgacgcctgagactgccggattcggcgcgcacgcgtggggcgagaagcgtgacgggcacgtcggcatggcgggctggctgcggcgtgcacggctggtgttgcgcgagtatgcgagcacgctgcgcgtcaaggagctccgcaagcatctggccatctaccttctggtgcaggtgacgatggacgtgttcggccagacgttcgtgttcttcgtggtgcacgactggaaccatacggcggcgttcgcgtcgctgatgccgggatgcgccgccatctcgctgccgctgatgccggtgttcggctgggcgatgaccaagataggcccgaaacggctgtacgcgatcaatttcatcggctggcttggtacggcctggctgttcgcggcgtggatgctggtcggcgcgctgccggaaccgtggtggacggtgttcccgtacatcgcggacatcgaccagatcgtgactcgccggtaccgttccgccacgttctccggcattcagacatcgttccgtcagctgggctcgggaatagcgacgattgccgccggcctggtgctgggcgcggtcggcttcgacgcgacgcgcgcatggcagacgacggtggcgggcattggattgggagccgtgctgctgggctggtttaccgtcttgccgtcgcgatggtcatctgctggattgtgtccgcccatctcgccatcaacaagcgtgcggacggcatcgtattgacagagatcacccgcctgcgcaacggcggcgacaaggccgacgtcacgcccgaaacccgtcatgtggtggaacgactgaccggcctgccctacgagaactgctggcggtagccggcgaggcgagactcatgaacggccgcgcagcaatgccgtgccgctcgctacactggtgagacatgagcaagcatcatcatcgtgaccgcagctgggcgcccgcgccgtcgccgctgcccgacgacgcgcacgtcatcgacaaccatacgcatgtggcatccgtcattccgtttgcgcgggccatgagccacgaagccgtcgaaaaaggacagccggaagtaccggtgtacgacgtggagcaactgctcgcccaagccgcggcagtcggcgtcaccggcatcatcgactgcgggtgcgagctgccgaacctcatgaccgccatccagatggccgtcgaccatcccgactctgttcatgccgccatcgcaatccaccccaatgaagccgtgctccacggtcaccgcggcgtccccggaccggacggtctgtcgctgaaatacaagccccaccatgacgtgagcttcgacgacgcgctcgccgaagtgcatcgcctggccctcgcatacccgcatcaggtggtcgccatcggcgagaccggcatggacctgtttcgcaccggggaaggcgcgaaggaactgcagcgagacgccttccgcgagcatatcgcgctcgccaaggagctgaacctgcccatgcagatccacgaccgcgactcgcaccgggaggtcatcgagacgctgctcgcagacggcagcccagagcgaaccgtgttccacagctactccggcgacgccgaaatgggcgagatcgcgcgcgacaacggctggtatctgagcttctccggcacggtcagctacaagggcaacgacggtatccgcgaatcagcccggctggtcggactggaccgcatcatggtcgagacggacgcgccgtatcttacgccgatgccataccgcgggcgcaccaacgcgccgtacatgatcccgtacacgctgacggcgctcgccgacgtgttcgacctgcccgtcgccgaagtcgcgcgtgcgacgcggcgcacgacacgcacggtatacggggtgtgacgaggggcggcaagggcggccggcgtcctccccaagttggaaaaaaccgaaaaggggcatatactgaccgcttgaatttgaaataccaaggtttccgttagtagctgtacctagaatatgcggatatcatgtgcggattatccccgtcgatggaggaagcatcatggctcaaaagcccgatgaaacgttgttacgtgccgacacgttcaccaacgtcccgaaagtctctcgtcgcacactgacgaaagaggagcgcgaagagcttgcaaagcagcaggcggcagaaaccaaggaagcggaaaaactcgccaagaccgcaagcaagggcgcgatcggccgctggtggcgcagattgcagtccggccccaacaagatctcgctcggcatggccatcgtcgcgctcggcgtggtctacggcgacatcggaacatcgcccctgtacaccgcgcagacgttcctttccggccagggcggcatcgccaacaccgaccgtgaggccgtgctcggcatgctgtcgctggtgttctggtcgataacgctgatcaccaccgtcaaatacgtgctcatcgccatgcgtatcgacaacaagggcgaaggtggcatcttcgccctgtattcgctgattcgcaggcatggcgcatggctcgccatccccgccatgctcggcggcgcggcgttcctcgccgattccgtgctcaccccggccgtgtcgatcagctccgcggtcgaaggtctgaagacgctgccgccattggaggcgctgttcaaggaaaacggcaacctgacgctgatgatcaccgtggtcatcatcgtcgtgctgttctccgtgcaatcgcgcggcaccgaaagcatcggccgcgtgttcggctccgtggtgctggtgtggttcacgttcctcgccgtggtcggcgcggtgaacctctccggcgattggtccgtgctcgcggcgctcaaccccgtgtacggcgtgaaattcctgttcagcccgcacaatgcggccggcatcgccgtcatgggcaccgtgttcctgtcgaccaccggcgccgaggcgctgtactccgacatgggacacgtgggacgcggcaacatctacttcacgtggccgttcatcaaggtcgccctggtgttcaactacttcggtcagggcgcgtggatcctcaagaaccagaacaatcccgagtaccagcacatggagggactgaacccgttcttccagatgatggatccgaacgtgcgctatgtggccgtcatcctgtcggtcacggccggcatcatcgcctcgcaggcgctgatcaccggcgcgttcacgatggtgtcagaggcgaccggcctcaattggatgcctcatcttcaggtgcggtatccggcgcgcacccgcggccagctgtacattcccgtcatcaactgggtactgtgcgtggccacgctcatcgtgctgggcatattccgggattccgagcatatttcggcggcttacggccttgcgctgacgatcacgatgatcaccactacgatcctgctggcggtgtacatgtggtacgaccgcaagcgggtgctggcggtcgtgttcaccatcgtgttcctcgccatccagctgatgttcttcatcgcgtcgatggcgaagttcctgcacggcggctggttcacgatgctgctgacgttggcgatcctgttcatcatgtacacgtggaacgagggcacgcgtctggaacgcgcgcagcgccgccacatgatgccgaaggacttcctgccggcgcttgaccgcctgcacggcgacttccgcatcccgtatttcgccgacaacatcgtgtatctgaccagcgattcggatatgcgacgactggatacggacatcttcttctcgatcttcgcggatcatcccaagcgcgcccgtgcgtggtgggcggtgtcggtgcagactaccgacgaaccgttcacgcgcgagtactccgtgcagaatttcggcacgagctacctgttccgagtgcgtatccgtctgggattcaaggtgtcgcagtctattccggtgtacctgcaccagatcatgcacgacctgtcggattccggtgacctgccgcagcagaagtccgtctacccgaaggtggacgccgacccggagatcggcaccatccgttacgtgctgattcacaaggacctgatgccggaatccaagatctccacgcgaggcgcgatgtcgttgcgggccaagtacgcgattcgtcacgtcgccggctccccgatcaaatggttcggcctggcgccgttcaacccgttggtcgaggttcagccgctgttcatctccactcgccgaccgccgcgtctgaagcgcgtcgcgttgcgttcgcgcacgccgcgcgtcaacgagatcgtgaccgtcagcaaaccggaagaacggccggctgcgaaaccgaccgcgaagaacggtggctcgggcagcacgaaggctgcgtccgcggcgagggacggaagcaagacgaagcctgcgggctcggcgcagaaggccgccgctgcgaaggacggcgctgcgaagcctgcagccgcagatgccaagggaggcgcgaaggtcgacgcgacgaaaaatgatgccgtgaaggtcgacgattcggcgaaacgcgctaagcagtagacgcacacgggccgcactgccggctcgcgtgcgctcctgatggactgatggactgcggaggcaaaccgcccatgcgttacggcctgggtgccgcgtatttgcgccagccgccgcctcagtacgggcgatggtcgtcggatggcgcagccatgacaggaccgttgccggctgttccgtctgcgcaatagtcgctctctgcgccaccgtcgcggtagccgtcccgctggtactgccgttcggtgcatatccggttatcgcaaggacgacctctactgtctgtgaccggcgagatggcatcacggtctgcgtttggccggtcagccggctgccgacttgtccgggaaacttggtcgaaatggatatgtgacgcctgccaagttgtccgaatccccggcggatcatactgcatggctgttcagcgcggaagacagtgaacagttgtccggcgatgagattgtctcgtacctgctgtccggtctgctgacgtatgacaccacacagaacggatgcgagatattggacacgcaggcacgtgattttcaggtcgctgaattatggatgatgaatgctgccggcttgcatgaagacggcgaggatggcccagctgacgatgctgtgtttggccgcgcagcttgttacgctgccattggcgtccatgacggttggattgcctgcgctggacggttccggcgtgagtctgcctcttgcgacgttggcggcgcttgtgcctgcgacgatgattgcgtggtcgctgcctggcatgtctgcggctgatgtggctgccgtcaggaatacgtggctgatggatcgtgcggcgttgctggtgttgattgcgggaatgatggcactgggtgcggtgatgataccggtatatggcacggcggccggggtcgcgcaggcgctatctgtgggcggacttggctgcttcggggtgatatgtggccgcctgtgcggactgagagttggcgcggcggcacctgcctcatacctgttcgtctgttgtgcgattggcgagcgggcaggtggacgcttgttcttctggcagtttcccctgatgatgacgcttgcctgtcaatcggccgtttgtgtggccgtattggtcgtatcggcatgtgtctgccgggtgccggaccgcatgcgcatcgcggccgtgcgcacgctataaggaactcctatagccacgcccgcttgtcagccgccgcggcacgatacagtaccaagcatgtgcagattactgggatacgcgacatcgggattcaacctgagcctcaacgacgtcctgggcatgcacgaggtgacggatttccgtgatctcagcgagattcacaatgacggttggggtgtcgcgttgctgtcgaaccccactgagctgccgtttgccgccggcgaggtacgcaagcccgagaccggcacgaaactgtacaagagcacactggccgcccgccatgacccgattttccgtgactttgcggacgaccccgcacgcggtggcctgtggcacctgcgtctcgccagctccaacctgccgctgattctggagaaccagcagccgttcttcgcgaacgggctgagcttcatccacaacggcgacatctccgacgaccgcggcatcaacatcgtgctcaatcgtgcgtacccgatcaatcagggtgcgttcctgtcgaccggcggccgttccgactccgcgatcttcttctcggtcatcctcgaatacatcgcgttcggcttcgcgctggacgaggccgtggcgcaggcggtacgccagctgcgtcaggcgtaccccaagtccagctacaactgcatgatccaaagccaggaccagctcgtggctttgtgcgccgccggccgcgagaagacgtcgccgcgcatcgtcgagatttacgacgagtacggcaagggcgagaaagctcacgattaccgtgtgatgaggtaccgtgacgtgcaggactgtgacggcaagccgtccggtgtggtcgtggcgagttccggcttcgagcagaacgagtccgatggctggaaggtgctgaagaacgatcagatgatcgtggcgtccaaccgtaccggcgaataccacgtgcgctccatctgagaggcgtctatcgggcgattgatggcacccggcatctgtaacttgctcgcaacgctctcctcttttcctcctcaccggcgcgacacgcccggattgcgcagcacaatcgacgtcgctgtttatgatgaaggccggaaaatggctgatctgtggaaatgcaccttgcgattgtgtgatgttatcggcgtgtcgcgatggctacaatgagccgtatgaccggttatatccccacactcgaccagattgacgagctgcacaagaaaatcgccccctcccaggccgcctatgacctggtgcacacgcattgcgttgtcgtggcgaccatcgcccgccagctcgcccgccatcagaacgcgctgttcaccaacaagctgggccagggcagcggcaacgcgcttgacgattccgccggggcagctgaacaagccgacctgccgtcggacggcatcaccggtggccgtgtgccgaaacgcctgatcgacgagcatctggcgacgatcggcggcctgctgcacgacatcggcacgtatcgcgtgctcaagcacgacggcagtgatggcgaaccgctgcaattcgacgggaaacgttacatcctgcatggcctgctcggctacgagtacttgctggagcagggcgtggacgagtccatcgcccagttcgcgcgcaatcatactggggtcggcctgacccagcagatggtcatcgcgcagaacctgccgctgcctccggtcgattacatgccggtcaatctggaacaggaaatcgtgatggtcgccgacaaatacaacagcaagtcgataccgccgaagttcctgaccgcgcaagcctacgccaagcgtgcggagcgctatggggaggcgaacaagcggcgctggctggatctggtcgaccagtacggtgtccccgacgtgccggccctggccgcgaggttccgcatgcgcatgatctaggtggaatcaatgcgcccccgctgggtggatagcccggtggactgcccacccagcgagggcgtatcagatgaggccgtttatagcttgatgatggtttcggctatgttggcaacggcttctgattcggtgaggatgatcacgcagcgtttggggtcgccgtgggtgagcgacgtgagcagctgcaggatctccacgctgtcgtcatcgttcagcccgcccgtgggctcgtcggcgatcagcacctcggcctcgcaggcgatggcgcgcgcgatcgccacgcgacgctgctccaccacgtccagcttgccaaccggagcgttcggggtatccacatcgaaatggaccttgtgcagcagctcgcgtgcgatcaccggcttcggcttgaggaacgtgcgcccggaggcatccatcgcatacaccaggttgcgttcggcgctcatgtcgtctcgtaccgcatactgctgcggcaccagtcccagtcgatgtccacggacttcgccgggctcaagctccagcaggttcgcgcttttgttcatcacattgccgtcatgcggccggatgatgccgctcatcacgcccatcagggtctcgtgcagcacgcggtcgttgtcgggcagcagcaccgagtacacatgcccggcatagaacgcctgggtcatgcggtcgagcacgtgacggccggacttcttgtcggtcactgtgaccttgttcatcgagaacgtcgggtaggacttgagacggatgctgtccgccttgctgcgcttgagctccttgtcgatgcgcgatgacaggcgcattgcagggtcgacgctggccgatgccacggtgaccctgccggccctggtcttcttctggccatcaccggccgtcttgcccccggtgctcagcttgagtgtttcgttgaccttgctggcgttggccgctgccacatccaagttctcgtcggcggtgtccgccgccgtggtgccggtatcagcatcgccggtatcggcactggtgttatcggcggtgttgtcggcgctggccggctcctgcgcggcggcatcctgcgtatcatctccgggattctcgtcgtcggccggtgcctcctcggcggagccatccgtcgcgaccgtcgtatcggcttccgcggtagtgtcgatttccgcgtcggcagcgtcgatcacgatggcgtcggagtcgtcaccgtcgtcgtcgaagacgatggagaactgcacgctgtccggtaccgtcgtcgaatcgctcgctccggcggcatccggggattcggttgccgtgtcggccgtggcgtcggctgccgcgtctgattcgaccgccgtgttctcgccttcgggaccggtcagtgtgacgtcgtcctcgttcatgtcgtccgccttattcgtgttcgtgtcgttcatgcctgctcctgtgccgattccgccgtatcgtcggcgtctgccgtatcactgtcgttcgctgcgttgtcgcttgttgcggtgtcgtccgtcccgccgtcatccacgacctcgacctcattcgaggaacgggccgcaaacagcgtcctgacacggaacagcagcacgcggatcatggcgatcaccatcagaaccacaatcgtgccgagaccgctccagatgacagtccagatcaggttgcccggcacactgaccgcattgccgtcggcgagcttcgtggccagcggcttgaccgcgaacgcgccgacgaccatgcctacggcgaatccgacaaggttcagcaacagcgtctccagcatgaactgccaggcgatacgcccacgcgagacgccgatgacgatctggttgccgatttcacgccgacggccgaccagcaggctcgatccccacgaaagcagcaacagcaccgcgcccacaatccagagggcggcgagcataggcttcatcgagctcgccagggagcgcagcggcgcgatctgcttctcgtgctcgattagcgtcggcgaggtgagctcatggttcgcgggcagctttgccttcttgatgactttctcgaacttccgataggtcgacatgctgtcgagcaggaacgagatgttcaggtcgggaatcagccagcctttgccgtcggccgcatacaggccgtccatcgcgaaggtgtagtacgcggtgtagatgacgttgtcacggttgtccttggcgagcttggcgtccgaactctgccccgcggcggccggctccgtgtactcgtaaatgccgcggacggtctgctcgatggtcttcttcgcgtcgttcgggaacgcgacggtgaacttgtcgcccacgtccaggccgttcttcttcgcgaacgcctgtgaaatcagcacgcctgtcttcgactggctcgagtagtccagttgcttgcccttgacgatcttgtaccggccgagctcgttctcatgcgcggcctccagcgaagagaagctgcggtacagcatctcgccgccggtcttgtcggcgctctggtcgtcggtgccggcgatggccttgacgttgccgctctgccgcaccggcacggtgatggtgagcgcatagctgtacgtcaggccggcggtctgcagcgcagacgcgtagttgtcgtatgcgtcgaacgccaggtagttcttcgtataggaagaatcggcgccgttgtaggttgccttggtcttcgcatccgggcggatgacggcgctgaccagctgggggttgtagccatcggtggccgattcatcggcgtgcaggacggagaaaccgaacaatgtcccgaatgtgacgatgatggcgatgaacatggtcaacagcgtgcgccatttgcggcggactatggatgaccatgcgttcttgagaacgaacatgcgtgtacttctccagttcttcccagcgggggctgcgatcatggcaaccgtgcgcccgcgttttcgtgacagtggccgggacgccacccgaagaaccccgaaaggccccgtaaagcacggcatcccgtaggcaacactatggtcgcgctatgtgtatgttatcttgctccatactgttatacccctcaatgaagtctgaaagcagtctgacaaggtcgcgggtgttgtgccgggccatccttccgcctgtcccgggcaatggtgaaaaaaacgtcgaaatacaacggttcagaaagaagacttagcgtgcggtaagcatcgcacggtatcatctgaggttgtattacgtagcgtcgagagccggtccgcccgaaaagacggtgtgacggcagaccatcgaacccgacggaacgataacggtcgtcgcgtggaacgacggacgcgacaaaacggaatgtaacacgaagcaaacgaggttaacccatgcgccgatccccccagcacatcggacgaaaaggacatcaattcctgtctcaagcgctgcgtccgcggcgcatcgtgctgtatgtggtgttcgtgctactgggagccgtgttgtcggtcgtcggtatctacggaatctccgcgctcaaactgtacacggaggcgaaccgcttcatctccgcttccgaaaacctcgccaacaccgcgctcggctgcggtggcggaggtaacatcggcacgtccgcacgtgagatggtgacgtccacgcgggcgctgcgcgacgaactggacaagccgcagtggacgttcctgcgcgaccatacggcgtacgggaacgacatcaccgccgcgcgcacgatgctggacgccatgggaaacctggtggacgggccgttcaccgatttgatggacctgagcaagcagctgtccggcttctccatgaaagacaaatccgtcgacctgagcgcggtgacggccatgccgggcatcgtcaagcaggcccgagccgacatcaaagtcgagacgcagcggctggagaagctggcgcctccgaagagcttgagcatcgtctccatggtgaagaccggcgtctccggcctgaaatccgtggacaagatgctcaacgaatacgacgagctgatcaacctgctgccacagctgctgggcgagaacggtgagcgcacgtatctggtcgcgatctacaatccggccgagctacggtccggcggcggcatggtcggcaacatcgcgccggtgaccgccgaccacggcaaggtcacgatcggcgacttcatcgccaccaccgacatcacctacggcacgcagccgtacgatgccgagaacgtcaaggaagctgcggtgttcggcgaccaggtgtggaaatacccacagacgaccaccgtcaacccgaacttccagcgggctgcggtcacattgaagaacatgtggctcgcgcagccgggcaatgagaaccaggagatcgccggtgtgttcgcgcttgaccccgtgttcttgcagtcgctgatcggtgtgacgggatcggtcaagctcagcgacggcaaggtactggacggcacgaacacggtcaagttcttcctcaacgagctgtacgtggaccacccgatctacaaggagcagaacgcctacaccaacaaggcgtcgaagacgatcatgacccacgtgttctcgggcgcgggcgcgtcgacgctgtcgccgatgctcaaggcgctgcggcagacgtccgcgaacggccatttcaagctgtggatggcgcaggaggaggagctggcggcgctcgtccagaccaaggtcttcgacgcgaacgtcgcgggcatgattcccggcagtgtggaacagccgaaggccggcgtctacgtgaccgaggcgaagcccagcaagctcagctggtatcttgagccgagcatcaccgtcaagaagacgtgcggcagcgatttcgccgcgaactcgtaccgcatcagcgacgaagtggacgcgcccgcccgagctaccaaccccatgaccatcgcgaacgccggcctcggcgacgaatacacggtgacggtacggttgaagaacacgatgaccgaggagcaggcgaagtcattgccggcgttcattaccggcaatacggagaagggcacgatgcagccgcgactgttcctgatggcgcccgaaggcggcgcgatcacgtcgctcgcctacgaatccggcgaaatggtgtcgaatggcaccgtggaggaccgccagttcatcaacctgcgtctgacccagggcatcaagccgggtgagacggtgaccatcgcgttcaccgtgcgggcggcggagcaggcgaagtcgacgctggacgtcgtcaccacgccgattatcaacgagaagggcatctacacgggcaccaacggcaaggtcaccgacacgtgcggcgctgatgtgccggatgcggtggaggaccagtgggcgggaactggcagcgacggttccgacggtggcaaatcctccggcaagacctcatcgaagcctgccgacgagaacaagaactccaccgactcctccaatggaggtgtgctggacaagctcagcagcatcaaggatggcctgagctgtccggtggatctgaagaaattcatgtagccacggacggccgcgcgggcacagctgtgcgtgtccgcgcggacaccttacgtaggatgacggttgctggcgaactcgcggatttcgtcgcgggtcgaatccttcgacccgtcgtccacgaacaggaagcgatagtcgatgcgatcgtcatcgtccggtgccagctaggcgttctcagagaacgtggtgagccgggcgaacagcatcggcagcgactcctcctcgttgtaacagggtatgagaatcgtcacggtgcgtttgttttcgttcgttgtctcttccctttgatgcctgatctggtgtgacggcctgcggcatgtaatcgacttccgctagccatgatagtggatgttgtttatgcgagtggtgttccattctggcgttttcgtatggtttcaccggtctgatggccgggctggccggttccgccggcaatgtggacaactgtggataaggggtgagttatccacttatccacagattttcgagggtgggtggcgccgggagccttgggtgtgccatggtgtgcctatgcgcgaggacgcggagggaccgtgacggcagtggcgcatacgaaaaggagcgatcatggcgacatcattctcgatggataccatcggatttctgcaggctatcaacaagttggagcggcgattcgaggaactcgtctctccggagactatgcgcaaggtgtgcgaagactatgacagggacggcacgcccacgccatgggatcaccggttgtacgcgctggcgcgcgacgtgttcgcgtgcggcagttggacgacgaacctgtgcgcggcggcgatgtcattcaacgggcggctggtgggcgagtgccggaggtttcttcacggctgctccgaaacggtgcgcaagtacggcatctcggtgtggctgtacgagctgctgaacgattccacgctggctctgtttcgcgacgacccgtccgattacatgccgtcgctgattcgtatgacgaccgtcgaggaactgatgcgacggcctcgcggcaggaagcggttcggcaaccgcaagcagcgcgggctcgccatggaggagcattcgacgcagatgcaccggctggcggcatacaccctgctcaattggggtgccgatgagcggcgcagcctcgacatcgctcggatgctgctgctgtaccccggcatcggcatgtgcatgctgcgcgaggacggagacgtgttgcgcttcggtgcggcgccggacatgcggtatcggcgcgtggtcgactatctgcacgagcggcgggcgcaggccgatgcggaatacgagctgcatggcaatcagtggatgagtgagtatatgggtcgtcatgacgatgaggaaccggctgtcggagagattgcgacggcagatcgcgacgcgggcggatgctcgtcgaagcgagatggcgttcgcggatatgccgaggtgggcgacgagtcgctgtgcgactgcgagagctgcgcccgcatcgacatggaggataggctggatctgctgaaatgcgagtggcgatacatgtacgatgtcgtccggctgattgatgcatacgagaagatgtgggacgatgaaccaatagatgtcgatgaccgcatgctcgcgctggaacacaatcgggatgtgccgggagaaccactatggcaggatgtggcgttcctgaacgatctggcatactcgctgatgggcgacgtgatggcccatgaccttatcctcggattcgagcggcgagaccgcaagcggttcgaccgaggcgtcgagcagctggaactgcttacggagacgctcgtccggttcggtctgctgtcattgccgataatcgcgttcatgaacggattcgatgaattctcacgggggcttgatgacgactacgcgacggacggcacgctttacagtacgtccgaggcggacatacagcgtctcacacgccgcatgcagaaacgtctcgacaagctgagcgaggaggaaatgaacgcgaaggcacatttgggcgagtccttggcgaacatcgtattggcacggttcccggacgagcgcctggcgcgggggtgcgctttggcgttgttccgcggcaatccggaccaatatgatgaggtcgtggaatcgatgctgatgcgccctgatgacgatcccggtgacatgggccccggcgacggtgatgatgcgccccttggcgatgttcccaatgacgacgtgctcaggaagctcgacttcgatgtcgaggaactggacgacgacctggagctggcgatggccgttgacctgtgatcgcgggggctcgggccgcgggctgggcgtcatcgcgagattaaggtacacccggcatcgtgccccacgtatgggtgcacgctgccgggcggcgacgtgagtaggcgactcagtacgggtggctcagtgcaggtagtcggcggcgttcgtcgggctggacggcacggcgtgaccctccgtcaccgtgcccaggccggacaggtatgcctcgcggccggattcgatggcgtgcttgaacgcgcgggccatcagcgggatgttgccggcgctcgcgatggccgtgtacgccatcaccgcgtccgcgcccatctccatggcctcggcggcctggctgggacgcccgatgcccgcgtcgatgatcaccggcacgtgcgtgttcgcgatgatgacctcgatgaagtcgcgcatgcgcagtcccttgttggagccgataagcgagccgagcggcatcacgcaggcggcgccggcctcctcaagccgcttggccgcgatcggatcggggaacatgtacggcatcaccatgaagccctccttggcgagcatctcggtggcgcgaatcgtttcctcgttgtcgggcagcaggtacttcgtctcgtgctcgatctcgaccttgacgaagtccgtctggcagacctcgcgggcgagacgcgcgatacgcacggcctcctccgcgttgcgtgcgccggacgtgttcggcagcatcgtgatgcccttggggatgtagtcgagcaggttgttctcggtcgtgcggcagcgacgcaacgccatcgtcacgatctgcgtgccggcgttctctatggtcgccttgatgaggttcaggtcgtagcgccccgagccgaggatgaagcggctggtgaacttgtgcccgccgagcaccagcgggtcggcgtcgccggtcgcgatgtcgtcgtaggcgtgcgcgtccggttcggggagcagcgcggtgttcgtcgccgtgccgatgagttcgtcgagcgccgggtcgtccgattgggcggccggtgtggttgatgcgatggtcatgatggtacctttctttgaggtatatgacgcttgatgcgtgcggtattcgggtcggagtgcggttcgctggccggcatcggcatgagcccgtgccgatgccttgccgcgtgtttgccgggctctcagccgccctgcacgaacgtgacgatttcgacggtgtcggtgccgctcagcatggtctgtgcgcgcttgtcgcgcggcacgatggcaccgttcacctcgaccgccacgcgtcccgcgttaaggcccttgcgcgcgatgagctcgtcgacgctgagcggcgtggcgatgtcctcctgctgcccgttgatgatcatgtgtccctcctcggtcgctggcgtgattcccatatcggcgacattgcgctgccggccgttgccggtcgatctccgatcgggtgcgccggcgtccgccgatatgaaaaacgggtcgctggagcaagccgtaccctgtgaggtggtgcgcccctccatgacccgaatcatgcgttttttcgttatgcctgttctgttatatgccgggatgcccggtgcgtttggctgggaaccgtccgccatcggttggcggatgccgattgttgctgcgctgcgactggacaactcgtccctacggcggcattacccgcatcaagttgacggtcgaagcgtcgcttcctctcagccttgcggctcccgttcggttgcgccttcatcatagcccagaccgcgtgacatcgcgcccggccgcagggcttcgcggcctttcaaaatccctcgaattggttatgattgtcgtaacgaagagacaggggatgatgatggccagatgcgctcgatgtggtaatgaaattccagcgggatcggcgttctgcacatactgcggcattccggtcgcaagcggtgccgccgcagcgcccggtagcggggcgcagatgcctcaacctggtacagccgcgtccggcttcgctccgaacacagtacccggtacggggacgttgccgcctgtcccgcagccagcgggccccgcggataacggcggcagcgcaccccaaggtcagcccgggtcgcaatcccaacccggcaagaagccaccacttacgcccgcgcaacgcaagaagcgcaagatcatcatcgccatcatcgcggccatcgtcgtcgtggcgatcgtcgtcggcggagttgccgcattcctcatccttcacggcaggaagaacgcggccgcgggccccgtgcagaccagcgacacgactgatgcaacgccgaagaaaacgcaaaagcaatccccgacgcagatcgaaggcaaaaagcggtcagcgaagtcaccatgaccaacttcgtctgcaactacgacacctccgactgggggtgggacggcggcgcagtgctttccgacgtaatgccctgcgccaacggcgatgcgagctccagcagcgattccgactatggcagttccagccaatccgccgatgacgggcaatatgcgttcggcgtctggacgccggcaatggacgaatcgaaggtgatctacttctcggctctgaaatccggggagaagatgtactccgatccggtcgtcgccgccacatacggtcccaacccggccgtgttcgtgatctacgcggtcaagaccaaggcggtcggcaccacgccggaaaccgtgcacctgttcgcccatcaggtcgatttgaaatccggcgaattgtccgatcgtatcgatctgcgcaccgaggaagacaatctgatcaacctgcagcaggattacgaattcgatgtgctcgcgcaatccaacaatcgcgtcgccatcgagaaaagctggaagacgacggagaagaggactgtcaacgacgatcagcgtgaggtcgaaatcggccacaagcagatcatgggattgagcggcggcgcgaagcaggccgagaccttgcagacgttcaaggacagcgtgagcatcagcaaggacagcggcggataccagtcgttgaacactactgaagtcgatgtggacgattaccacgtgttcgacacatatgtggtcaaggacagcgcataccacctgtattccatcgacagcaacaaggaaatcgtgaagcttccttcggactactgctcgcctggcgacacctaccgatgcgacttgcagggcctgtatcggttcggcgcgaatcagtacgtgctcaatccctctgaaagctataacggcaacaagctgctgattctggatgcaggcacgggcaagaccaaaaaagtcaccgacctgctgaacatcaacacgaaggatgaccagtacgtgaacttcacggacttcggccagttctcggacggttccctgtatttccagtgggatgagtcgagcgacagcaagcgtgtgtttatcctctcgcgcgacctgaaggtcaccgaggtgctggacggcgggcggtgggcccgcctgatgctgaactccggtgagttcgaaggagccaactatctgctgaagcagttctacgtcaaaaccacggacgagaacatcatcgtcgacgagaagggcgagacggtcggcagctacacgttgaccccgtcggacgatgacgcggacgactacgaccatacggccgtggactggattatgtggagggatggctccgagaacacggtgacggtcacgcgcgggcaggcgcccggcgagccggccccggactcgtccgacggcagcgggtcgagcagcggcgatggcagcgccggtgacagcagctccggcgactgaccacgcgccgggcggtgccgccctcatgacccacctccatactctctgaacggtagctgcacggccggaaacgtcggcatgacattatggcgttgtctggtggcaatcctgtgactatcactttccttcacataaacggtgtcacaatgaaaggtatgacttacaggaacgacaaaactggggaagccacggtcgagcacacctgtgatgcccgtgcggtgttcgacaagctcgccatcatcgtggtgacatataagcgccagcagttgctggaggaactcctggcctcattcgcgcagctgacggtcgcgccatggcgcatcgtcatcgtcgacaacgaacactccgacgagacgcaggacatggtcgacgaattccgggagaaggccgacggtctgtgggggacgacggacgccgaccgcaaagatggcacgagccgtgtggtgtacgctccgcaaaccgacaatcttggcggtgccggtgggttttccgtcggagtaaaagtcgcgtacgatctcggggcggaatggttctgggtgatggacgacgacgtcgccgtactgcctgacggcatcgagaagctcgcgaaatggggtcgcgaccatgacgtgatccagggcggcaagctcgatttcgacggcgggccgttctactggcagtacaacttcatcgtgccgctgggcatcccgagcccgatcgcgccggccgcattcggctccgccgggtaccgcgtgatgaacacgctgtgcttcgagggcgggctgttccgcaggcgcatcgtggagaagatcgggctccccgacccgcggttcttcatctactgggacgacacgatgtacgggtatctggccagcaaggtcaccaactcgattgtggtgcccgacgtggtgatgcggcgcacgcgcgacatcagcaactgggacatcgccggattgcggcagctgaactccacctcggacatgaaccggtaccacatcctgcgcaaccgcgggtacatggcccggtacttcatggtgcacggcgactaccggccagtgctgttcgccttgggaacggccgccacggtggcgaaagaggttattcgcctggtcgcggtcgaccgcgagcacgtgcgcaccgggctggtgcagatcgccaagggatggcgggactcgcacaagttgatgcacgacccgaagtggcggccgatgccgccgttggtgcggcaatagcgtcagggacgctctcaaaactcgcagatacaagcactttttgcgtatattcatgctgtatctgcgagttttgagagcgcgattttacgcaacgacgaaatccgacacgtctttgatcaggtcgaaggcgtcattaccgcgtgtggtgagcactcgcagacagatgccgttgacggcgcggctgactcccagctcgccggggaaacctatggcgtccgcgtgggatcggatgtggtcgatgagttcgttttccgccttgatgcgggcggcctcgatgcgggcgcgcaccgcttcggccgacatgtcgggatcagccgccgttgctggctccgccgtggcgcctgcggcatcccgtggcgcaggcggcgacgcgagcggatcgacctccggcacatgcgcgtacagcacgccgcagtgggtgaaattccgccacatgcccagttccgtatagtcgagctgtcgccgatcggtctgctggccaccgacgatgcgtagggtgaatggggtgtcgaggactccatgagcgcgacggggctgaatgatgtgccgcagtacatcgcccacggtttccgctgtctgctgtacgtctcgtcccatcagcagcagcgtgttgcggattcaacggggtgagaaagaaaaagagaatgcgccgaaccacgaaagcgcctgtcggcgcaaaggccgctcgcagcggcaaaaaatggagcccggggctatgcatggcccgacgcggatatcagtatatccgggtttgccctgttacgctgtccgcgtgttgcgccggctcagtccagtttgccgcgacgccacagctgcgctccgtggcggaaatccttggacgtggcgatgagattgccggcggtgtgcatcagcttggcgctgcgggagcgcatgacatgggcttcggccaggtctgcggcggtcgcggtttcggagccggccttggcctcggcctgccgcaccatgtgccgcgcttcgacgcgcaatccctgcgccaccacgtcgacgaacgcgctcgccctctccagagccacggcgaaatcgccggtgaacgcgcctgcgagaatcgaatctgccgtatgtgcgatgtccgcttcggtgggtgcctggtcgacgcctgcgatggccgacgcggcggtcgccaccggttcgccgagccgccacagccgcgagatcagatcgcggtcgcgccgcatccatgagcgcaacgtgtacagccgccacatgatgcccggcagcgagtcgggttccgaccggctccacagttcggcgatcatgtccacgccttcgcggtcgaccagcgtcagcacccgttccacaacctgcggatcagcggagtgatgcacgcggtcgagcagagcggccgccgatgcgtgactcatttcgctgaccacgctgggatcggcgcctccggcgatgccctcgatgagaccggggtcgatctgcccggggcgcgatggccgcggcgagccggtcggcgtgaatcccgtgcggctgggaacgacggagcctgaaccaaaatgcatgctagtagacaagtggcgtgaccttctgaatgtcgatgatggaaacggtgtcaccgcagggtaccacgaacagcgcgatggcggtgccggtcggcatgtacggcgaggacggaatcagccgtttcatcagcgatttcgtcgcgcacagttcgcgcagatgcccgaaaataccgccgatgaccggacgatgcatgcagaccgcggtcgcactgtgacgctgcaacgtatttttcagctccttgtggaagcactgccacgccgcttccggatcggcggcgaacgcgtcctcggtgagcggttcggccgtatgcagcggcaatccggtctgccatgacagcatctgtatggtctgctggcagcgcagccacggcgaggtgaccagccgcgtgggattgtagcaggcgagctcacggtcgagcgaatacgccatcgacgctccgcgcggcgtgatgggacgcttgtcgtcggtacccgtccactgcttgcggggctcggccttgccgtgacgcaccagcagcagcatgtcgccgtccagcgcgccttcctccacacggtcgacgaacaacgcgagaatatcgcggtcggtcgaatgggtgagcatacgccgcgcgcgctgcacgctcacccacatgacgctgtcgatctcgcccacgtcagcgcgatgcacggggccgaacgcgtcggcccgccgcacggcgtcctcggggtcgatcggccttgccatccagaagagaatgtgcttcgtgtcgacggttcgatccttggaacggcgggttttcttgccttcctcggcaagcgggtattcgatttcgccgaggaacggtccgagcgcgaccggcactccggtctcttcgctgacctcgcgtaccgccgcatggcggtgggtctcgttgagctccagcttgcctttcggccagctccaatcgtcgtattttggccggtgcacgatgcacacttcaagcgtatcgaagtcggccagtcgggatgccgcggacgtctgccgcccgtcgtccgagaacttcatccatccttgaaaatcagtattgcggcgatacagcaccgcgcctgcagcttctacgattttcacctcaccactcacccttccattatgcctcaccggctgcatgactacgttgtttctcgtctgtaatgacgatggccggcccttgcgggtcggccatcggcttatgcacctactgtacctcgtgcgccgcttgtcttgcggaagatgcggtgcacgaggctcgtgccggatgccctatcgggcgtccggccgggtgccatgtcagttgttggtgcgcgggcggcgctggtgcttgcggatgagatattcctggctgtccaccagcgggcggccttcgtcgtcgcgcgaatgatggatgtacgtgccgtcgggctgcatgtgccaggaggccgtggagtcggacatctgcaggtccacatagcgaatcagctcgtcgatctgctcgggcgcggtgacgcggaccagcgcctcgacgcggcggtcgaggttgcggtgcatcaggtcggccgagccgatccacacttccgggccggagatggggccttcgccgatctgcgggccgtcggagttgcagaaggcgtagatgcggctgtgctccaggaaccggccgaggatcgaacgcacgcggatgttgtcggacatgccgggcacgccgggcttgagtgcgcagatgccgcgctcgacgatgtcgatcttgacgccggcctggctggcgcggtacagcgcgtcgatggtcttctcgtcgacgagcgagttgaccttgattttgatccaggcttccttgccggccttggcggcgtcctcctcgcggcggatgcgctgaatcaggccggtacgcacggtgcgcggggcgaccagcaggcggtggaagctggacttcggcgcgtagccgctcagctggttgaacaggcgggtcaggtcctgaccgaccaccgggtcgcaggtgagcaggccgaggtccgtgtacaggcgggcggtcttcgggttgtagttgccggtgcccacgtggcagtagcgcttgaggccgtcctgctcctggcggacgacttcgatgagcttgcagtgggtcttgaggccgacgatgccgtagacgacgtgcacgccggcgcgttcgagcttgcgggcccaggcgatgttggcgtcctcgtcgaagcgcgccttgatctcgaccagcgccagcacctgcttgccggcgtgggccgcgtcgatcagcgcgtcgatgatcggcgagttggagctggtgcggtacagcgtctgcttgatggccagcacgcgcgggtcggcggccgcttgggcgaggaacgcctgcaccgacgtggagaacgaatcgtaggggtggtgcagcaggatgtcgcgctcgcggatcgcggcgaagatgtcctgtgcgcggctcgattcgacttcggcgatctgacggttcgtggtcgggatgaacgggcggttcttgaggtccgggcggtcgagcgactgcagttcgaacagtacggtgaagtcgagcggcgcgggcaggcggtagacctcttccgggttgacgccgagctggtcggcgagcagctgggagaggaacgggctggtcgcgtcggagatctccaggcggatcggcggtccgaagcggcggcgcagcagctccttctccatcgcgttgagcaggttctcggcgtcatcctcttcgacgtcgatgtcctcgttgcgggtgacgcggaacgagcgcgcctccttgatgatcatgccggggaacagggattcgaggtgcgcgatgatgaggttctccatcgtgatgaacccgaagcgctcctcgcggctctcctcgtcggtcaggtcgtcgacggggacgaggcggggcatgttgccggggatcttcacgcgggcgaagtgggatttgccggagttcgggttctccaccagcaccgcgaggttcagcgagttgccggaaatgtaggggaacgggtgcgcggggtcgacggcgagcggcgtgagtacggggaagacctgctggcggtagtagcgcgagagacgttcctgctcggtggtagtgagccggtcccagctgagcagcacgatgtgctcgtcagcgagggcggggagcagcttctcggtgacgtagtgcgcgtgctcgttctgcaagcggtgcgcctgctcgctgatggcacgcagctgctggcgggggctcaggccgctggccgcggtgacggcgatgccggtgtcgatacggcgcttgaggccggcgacgcggaccatgaagaattcatcgaggttggaggcgaagatcgcggcgaaattgcagcgttccagcagcggctggtcttcgtcctcggcgagttcgaggactcgctggttgaacttcagccagctgagttctcggtcgaaatagcgatccgcgggcagcggctcttcgccggcttgcggctcgcgcttgtcgggtttgtctgtctcggctatgtgctcggcgatttggctgcgcaggatagcctttgaaggtgcgtcaaatgtttgtgccatgtatataactttatgcgagaatatggcagttttctatgctgcgtgtaagaaattcagcggttgtttaccattgtcgtacggatggggtgtcgggtgatggtacggcgacacgccgatgggtcgtcggttccgcacacaagtgaacaacgaacccgtccgataggaacatgaggtgacagttttccgtcataattgagcggtatcgaacacttgcgcaaaaaatcgcacaacgtagttgggtgagttgcggtatcgcggtgttgcgcctagattatgaagtgcaaggacaacttaagagcaggcccacaatagtgtatggtcacgaaggactgttacgttgaacgggcaatggaaagacttaccgttacgacgatgaggttgtgcagcgatctgctcaagatggacttgcaggaaaacccgctccggcgggtttttccatgtgcggcggtctaatggcgagggtgggcttggctcgggttggggttcggactgttggctcctgctgttccgcgtgacttcctgtgtgcaatcattgggttaagtggtcgaaagtgtgtcttacccgggtgtattgccggtgtgttgatggggcagtgtgatcgttcggcccggccttttctggcgccgaactcgcaatcaccgggctttggccttcgaaacgattttttcgccgaatcgcggattgcggcgatttcggcccgtgttgcggtggcgatggtggtggcggacggcagttggcggcgggctgtaccacaccacgtgattttatgcggttttggggctggtgtggccggggaggatattggggtgcttctgggattgttggaaaatggcggttctcatggtttgtgctgtaccacaccatgcgatgtgagggttcacatttcattgtgaggcctgcggaaaagccacacaatgcattttttgtgtgtttttcctctggtgtggcacgccggtggttatgacgggcgggtgggttctggtcaatgtttgccgtgaccgactgaccggcagagatgatcggaggcgcgatgggcgttcgtgagcgcggggtatgcgacgttcggcgagatgcgcacgggcgaaggttgcagagaggttggctcggattcctcccgactccgctgccgggtgctttcgactggatgctaagtggagacggttccatatcacgcgaatatgcccatctaggcgtcgtctgtccacaaaaactgtggataacacgccgtgatgtggataagtcgcgggccttcgaccacattgtcgtctcacgttgcgccgctgcggcgctattcgtttcaatcggaatatgacacacaacgttacagttcagaagattggcgccgccgctccgccgggtgcagcggcgtcgcggcaggttcccatgccgcctcgccgggcctccccggacgcttggcgaaggccggctgcgcaggtttcccggcttgactcggatgctgcaagccatcggatgcgtgcgcgcaagcccatgaccatgccgcgagtcgtatgcccgagcccggtctcatccgtggacggcaatcagtcgatcggcacgctgacgcatgcaggatgccataatacagtggtgttctcttccgcgtccgggggagcgggaaccagcgtgttcgcggcgatggtcgcatggcgcttggcccagcgcaagttgcagtgcgcactggtcgactgcgatttcgcggccggaggcatcgacgtgctgctgggcatcgaaaacgagccgggcctgcgatttcaaacagtcgatataccactcgggaaaacggaaggtgcggcgctgaatggcgagttgccgcaatgggagcgcgtgggggtgctcgccagtcaaccttggaacggttcggatcccgagccatggacggtctctgccgtacttgaggcgctggcgcaggccaatgatgtggtggtcgtcgatatcggggctccgagcgcgttgcattcgctgccgatgctgcgacagtgccgccaggtggtattggccgagctgacggtgctcggtctggcgcgtgctcgggcggcgagggcgatgatgatacgtcaaggggagtcgcgcccgattatggtcggtgtcgtgccccgcggactgtcgcgccgcggcggcgtggtcgacgcgcacgaggcatcggagtatctgcatgaggagctggccggggtggtggctccggaccgcgggctgcatggcgatgtgctggaggggctgggcatccgggctatcggcaagagcagccgcaaggcggtggatgcagtcgtcggtgccatcgagacggggttgggaggtgatgtcccatgattgaatttgggccgttggatgcgctggcacgcgatccaacggtcaccgatgtcgcgatcacctgcgagggaagggtgtgggcggaccgaggcggaggaatgacggagtgccggttgcctatgccgttgcgcacgccgcgaatagtgcgtgaatatgcggtgcggctgtgtgcgcaattgggacggcgtcttgacgacgcctgcccgattgcggacgcgtcgagcgaggacgggattcgcgtgcacgcggtgatcgcgccactggtcgcgcagggcgcggcggtgacgattcgttttccggatcggcggttgctcggattgaccggattgcgtgatgctgggatgttcccgccggactggttgacgttgctgcggaatctggtgaagaaccgggctcgagtactgattagcggcggcacgggcagcggcaaaaccacgctgctgaaagcgctgcttgcggaatgcgattcattggaccgtatcgtcaccgttgaggaggttcgggaattgggggatctcggacgcggcaaccatgtgtcgatggtggtgagaggggcgaatgtggaaggcgccggagccgtaggactgccggagctggtcaaggcgaccctgcgcatgagaccggatcgggtggtactgggcgaatgccgtggcgaggaaatcgccgatctgctgcgcgcgttcaattcgggccaccttggcggtatgaccacattgcacgcagatggcattgaccgggtgccggcgcgattgatcgcgctgggcatgctggccggccttgacgcgcatacgttgacgatgctggcggagggggcgttcgacgtgatgctgcatcttgagcggcatcatggtcgccggagaatcgcccagatcgggtgcctcggcatgcgcgacggagtgttgtccggcgacgtggtggcgttgtgggacggtgagggcgccatgatgccatgcccgcgctggcatgatttcaccgggcgatggggcatgtgagatggatcatgtgaatgaggcatgtgaggtgagacatatgagcgtgggtgggttgccgcgatgcgtcgcgctgatggtcgtgctggcatggatgctgtggccgtatgcccctcgcggccgtgccctgttgccggtctcttcgagggtgccgcgagcagggcgaaagaccggtgccggtgatgccgtccgtaatggccgtgtgatggggctgtccggcgtgatcgcgcatatgagttcgtctgttcgggccggcggcatgatctcagatgttcttgccgatgtcgacgggagcggattcgcaggggtgccgttgaccgcaagccggttgaaacggctgctgatgcgacagcgaatgccgggggagagcgccgcccaggccgaacatgtcgccttcgaactcgccgtggcctgtgcgatgtgcgagcggtcaggatgctcccttgccgattgtctggatgtggtcggcgagaaccatcggatttccaggctgttgcatgattcccgacgcagtgctttcgcggttccgcgcgcgacggcggcgctgttgggcgcgttgccgttggtcaccataggtttgggagagctgctgggcgctcgcccggtgcaggtactgttcggctccgcgcagggcaatgcgtgcctggcggtgggcggcgcaggctacgcgctgggactgctgtggatgtcatcgatgatgcggaacaccggcacgaacgttgataccgtctgattgccgtcatgaacattaaggggtggggtgatgtggaacgcgatggcgtgcgccgtcatggtgttgatggcattgatgatatggccggactcggcacggtcgggccgcttgactggcatgccgtccgatgttgcgggagaagggggtgctgctgtgtcgttgccgttgctgattggactgttgtcggtgtcgctgcggtcaggcatgtccgtcacgcgttctctggagggtgtgggtgaggctgtcggaggggctcttggcggcgggctgtgtgcggttgcggacgctctgcaccgcggatcgtcatggaaggatgcttggaatgccgccgatttcggtgattatgcggagacctcggcaatccttcggggcgtgttggagccatcgtggactcgtggtgtttcgccgatcggccctctgacgacggcttcggagcagtggacggaaggcgagcgaaccgcgatcgagcaggagtcggcgtctctgtcggtgaaactgctgctgcccacgggattgtgcatgctgccggcgttcgtgtttctaggcatactcccctcggtgatggcgttcgtgggatgaacttggtggcgacgccgcccgatggtcggtgaagaatgctgcacggccgtctgtcatccacataatgtgtggatgacacgccgcattgtggataactcggcagccttcgaccacattgcccgaaaacccgatggtgggcgggcctgatgaggcacagtggaaagtgccttgtagttgggcaaggccagtcgagaaaggattgtcatgaatatcgaggagacgatgattgccattgacggacgtaccgggcctattgcggcgatgacacgtacggtgggcaacatgggggcgtcggcgcggcggggcatttgcctgttggatgcacggctgcgcacgttgagcgcggagccagaggaaggggccaccaccgcggagtacgcggtggtgctggtcgcagccacgggcttcgcggccgtgctggtcgcgttgctcaaatcggacaccatcaagacgttgctgaccaacatcgtcaagaagtcgttgagtgtgggatgacgggcattcacgatggcgacgatgtcacatgctgacagtggagccgccactgcggagttcgcggtggtgcttcccgctgtggccatggtggcgatggtgttgctctgcctgacgagaacggtcacggtgtccatgcgatgccaggatgccgcgtcggccgtagttcgcgaactggtgacgagggaaggcggcctatcgggagcggggatgtccgtcaacgccgtggcgagtggcatcgcgggcgaaggcgcagtggtgtcggtcgctgatgatggccattcgatacgcgtgacggcgcaatgccccgtgctgccggatccattcggcgttctacccgtcaaagtaaccggctcggccacaggatggcggtgatgcctaagtccgtcttgccctcgctggcgggccgagccgtgagcaaacagcagagctgtttgtaggcgaggggtgaacgtcagtgaatccaatgggcggcatgcgtagcatgtctgtaattgcagggcccggagggctgtcgcggagcgactgtgccgtcttgccctcccgctggcggaggctgtcgcgcagctactggggtggtcaagcttcccctgcgcagcttgcctctgatgcggtggaatagcgacgaaaggaaaacacgatggtgcaacgaattcaacctaggagaccatcgcccgtgcgagcctattgctcgcggctgatgcaatccgatgaagggtcgggaacgatggcctgcgtgatgctgatcgcgctcgcggccgcactgatagcgaccgtcgcgtcggtcggaggcgcgctgctctgccggtcgcgtgcgcggagcgctgccgatgccacggcattgtcggcggcgtcggcgtactggtctggtggcgcatccgatccgtgtgccgtagggtggcgtgccgcggcagagaatgacgcgcaactggagtcgtgcgccgtcgagggagatgacatcgtcgtgacggtgtccgtgccgctgcgcctgccattcatgtcacgtgtcagccagcgttcccgcgccgggcccatcagctgtgaatagtcgatggggccactcgcggcgggtgtgggcggacagcattgatgccgatgccgagaccgattgcggagcctgtactggcggggaatgccgttgatgcattatgtttgacgtatgggcgaagcgaagacaatggtggcgttgatcggcaatcccgtttcaaacaaggggtggggtgccgtcgtgggcgaacaggtattcacgatgctggccgaagccggacagcggcatggattcgacgtaatggatctgaccggcaccagctttgatgattcgctgacggccgctcgcgagaaccgcaccctatacgactacttggtggtcgtaggcggcgacggcatgatcgccttgggggccaacgccgtctgcggcagcggcatcccgctcggcattgtggcggtcggttcgggcaatgatttcgcgcgaggtctgaaactgcccgtcaaccgggtcaaaaccgcggtggaaggcatcgtcggcgccatcgcatgcggcacctatctggatgtcgatatgggacgcgtgcgctcgacggagatcgcctgcatggtgcatgacgagtccggtgagcccgtggtggatgaggaaggccgcccggtgaacgggctgatcgaccgatactatgcggggatgcttaattgtgggcttgacgcaagcatcaacgatcgggccaaccattcgcgccttcccggagggtcagcgcgatacgctgcggcggtgctggtggagatcgcccgcatgaaacagtacggctatcacgtcaaggccacgctgtcggacggcacggtggaggaacacgacatcatcgcccctctgctcacagtcgccaatgcacggtacatcggaggcggactggaggtgtctccgtactccttgcttgatgacggaatgctggatctggtgtggctgaactgcaagccgaatgtcggccaatgtgccaaagcgctgtccaacgcctataacgggaggttgctcgccagccagatattcagctggaagcgtgtgcgccaggtggagataacccgcgcccacgagggagacgagcctccggtgctgatggccgatggggagtacgtcgggcatcttccagtgaccgtcaccgcgcaggccaaggcgttgcgcgtattggtcccgcctgcggtcgcccactggcatgacagccggagcgaggagcatatcatggcggcgatcgagcgcgacgggcgtgacccggtgaccggcgaattcatctgaccggcgagtccgcctgagcggagcctgcctgtccggcggctttcggccgacaggccaacgattgacgttgacgagtccgcaaacgtcgccgcggcggcaccatctgggcaagcccccgatgcgtgcgcaagtaatggggacaatagggaaagacacccggaaatagccgggttgcgataggttggagcttatggcacttgcactgtatcgacgttatcgaccggacacgtttgagggggtcatcggtcaggatcaggtcactgttccgctgatgcgggccctcgacagcggcaagctcacgcatgcgtacctgttttccgggccgcgtggctgcggtaagaccagttccgcgcgtatcctcgcgcggtgcatcaactgcgccaaggggccgacctcgcatccatgcggggaatgcgccagttgcaaggacctcgccactggcggtccaggttccatcgacgtggtggaaatcgacgcggccagtcacaatggcgtcgacgacgcccgtgaactgcgagagcgcgccggattcgcccccgctcgggatcgctataagattttcattcttgacgaggcgcacatggtcacccagcagggtttcaacgcgttgctgaagattgtcgaggaaccgccggaccatgtgatgttcatctttgcgaccaccgaacccgacaaggtgatcggcaccatccgttcgcgtacccatcattacccgttccggctggttccccaggaggtcatgggaccgtatctggaggagatttgcgccaaggaaagcatcaagccggaacccggcgtgctcaagctggcgatgcgcgccggcggcggttcggtgcgtgacaccctgtcggtgctcgatcagttgatggtcggcgcggttgacggcgtgatcgcccacgacgccgccgtggcgctgctcggcttcacgccggaggcgctgatcggcgaggccgtggacgccgtcatcgcgcgtaacggcgaagcgctgtatggcgtggtgcagaaagtcgtggtgggaggattcgacccgcgtcggttcgtcgaggatctgctggcgcgggtgcgtgatctgctggtgctgacattgggcggcgctcaggcagaaagcgtgctttccgatgctgccgaggccgaggacatggatgacctgcgtaggcaggcgtcgtcgcttggcttgggtgcgttgacgtcgatggcagaaaccatcaataccaccctggggtctatgaccggggcgatttctccgcgcatgcggctcgaattgcttgccgcgcgcttacttgccgggcgagagggactggatgtcgcgccggccgcgggaggcactgcgcccggggcggactctgcaggtactggccgcggagctgcaggagtgaatgcgcgaacaggcggcatcgccgagagccggtcaggcgggacgactccgcgcaggggaggattcatcggatccgctcgcaaccagcagacggacgctcgccaatcggcgacaagccagacgaatacgtcaccaagccgaaccgccggcacccaacctgatcgcgcactccagacggaagcgcccactatggcggaagcgcctgcaacagcggatgcgcaagccggtgccccgtctcccaccgctcaagcaccgtccgccgctcgagtaccaccggccggtgagccgacagccgcgcaatcctctccgcaggacgacgaccgcacgccggacgaacgctgggatgcactggtcgccggattgccggcggacgtcgccgcgtacgtgaaccgcagcaaggtgccgcgcatccacttggaacagcacgagccaggcggaaaaggcacgttgtggatcaagttcgacaaggcgctgagcaagtatgccttcgcgaaggccgtcgctggtgaggaagtcggcggaacccgcaacgtggtgcagatcatgcgcgctgagacccgcaaggcgttcggcgaccaagtgcagctcgcgcccaccaagaagatggccgacgggcaggtcgcgccgccgttcggccagctgccggcagacgagcagcagcgcatcagtgcccagatcgtcaaagcgagtctcagcgcatcattgggggcgatgagcgtcggcaacaatgccaaggagccgcagactcctcccgaaagcggcgacaccgcatcggccgatacggacgaagtccatcgagccgtacccgacgcgccggacgcgacagtggctcatgaccgcgacaataaccgggcggtcgcacaggatacctcgcgtgcggacgcgcagtcggcagtggatccgtgggcgctcccggaagcgggggctggcgatgcttggtcaccgactgacgatgcgtctcacaatgtttcacgggatgtttcacggaatgctccgcaagatgagggtcatcacgcgaaacacatcgccgtgccggatttgagcgacgacaccgacccgtgggccaacgacggcggtaacagtatgcccgttgacggtgtacgcggtggcgacgcgcccggcacacctcagaacgttgcccatgcgcagtcacagtcgcgagaggactccgagcgcaccaaccctggccccaccgccgtgccggagtccatgtccgcggaagacccctgggctggcatgccgtcatcagtcgcttccgcttcgtcgagcatcgccgcaccaagcgcaggcttcccggcagctctccaagggccttccgacgacttggctgcgcccgggcgcccggaaaaccccggagtcgaaccgggaacgacgcatctgcagcagactcccggtgccgcagccggtcagagagcatcccgccctgcgtatgacgacaccgatccgttcgccggagccgacccgtatgcgcaggaggacattcccatgccgaccgtggcaccggaagacgacgaatattcgatgaatgacgtttcacttggctcgcccgagacgatgagtctcgacgacgtcaagcagttcttcgaagtcgtcaagccggtggaggaatacggccccgacgaccccaagaaccccaggaacatccagcacgtcaacaaacatgattcggagtgagcacaccaatggctttggcatatgacggcgcgatacagcgactcatcgacgcatttgccggactgcccggcatcggcccgaaaggggcgcagcgcatcgctttctatctgctgtcggcctccgacgaggagacgggcaagctggtcgacgccatcacggaagtcaaggaaaaagtgcggttctgcgacatctgcggaaacgtgtgcgaggtcagtccgtgcccggtatgcgccgacccgagacgcgaccacggggtgatctgcgtggtcgaagagccgaaggacgtgatgagcatcgagcgcacccgtgaataccgcggccaataccatgtgctcggcggcgccatcaatccgatggccaacgtcggaccggccgacctcaacatccccaagcttctcgaccgcctcaagactgacgaggtcaaggaagtcatcctcgcactcgaccccaacatcgaaggcgaggcgacgacgacatacctgagtcgtctgctcagcccgctcggcatcaaggtcacccggctcgccagcggtctgcccgtcggcagcgacctcgaatacgccgacgaggtcacgctcggtcgggccctcacaggtcgccgcgaagcataaacgaggctgccagcgtcggcccgtcccggcgccgccgacgcgaatcatcgcccggatacctgcgcccgcagcgcggccgttcctgtccgcatggcggcgcacgcgtgcgcggcagtgccgaaattcctataatcgtgccgcttgcgtagtattgacgcagatgcattccgcgagaagataggacagcagtggctctcatcgtgcagaagtacggcggctcgtcggtcgccgataccgaatcgatcaagcgcgtggccaagcgcgtcgtcgagaccaagaaaaagggcaacagggtggccgtggtcgtctccgccatgggagacacgaccgacgacctgatcgaccaagcgctgagcatcgactccaacccgcccgagcgcgagatggacatgctgatgaccgccggtgagcgcatctccatgagccttcttgccatggccattcacgccgccggggaccgtgcgcattcgttcaccggtcagcaggccggattcttcaccgacacccgttacggtgccgcgcacatcaaggccgtgaagcccgaccgcgtgcagaacgcgctgtcgctcggagacgtggccatcgtcgcaggcttccagggcatcaacgccaagggagacgccaccacgctcggccgcggcggctccgacacgtcggccgtggcgcttgccgtggcgctcggcgccgacatctgcgagatctacaccgacgtggatggcgtgttcaccgccgatccgcgcatcgtgccaaaggccagtcgcattccggtcatcggctacgacgagattctggagatgtccagttgcggttcgaaggtgctggcactgcgctgcgtggagtacgcgcagcggttcaacatgccgcttcacgtgcgcagctccttctcgcatcgtcccggcacgctgatcgtgcccgacggagtcgacccgcgcagcctgcccaacatcgactgatgtcgtccactgacatacgacatattcgagacctgatttaccgttcacacaaatataaaggcgaaaaaacatgagcgacaacaacagcaaatccatgggtgacctgttccccgacctcggcccggaagccccggtcatctccggtgtggcgcacgaccgcagcgaagcgctggccaccgtgcgcggcgttccgaacgagcccggcatggcggcgaaagtgttcaccgagctggcgacggccggtgtgaatgtggacatgatcgtgcaggccggcgcgtccgtgggcaccgcggagatctccttcaccgtgccggaatccaccgtcaaggaagtcgagaacgtgctgatcgacaagcatgacgagctgggctacaagtcgttcgacatcaacaggagcgtcggcaaggtcgcggtcgtgggcgttggcatgaagacccattccggcctggcggccaagttcttcaccgctctgagcgacaagggcatcaacgtgctgatgatctccacatccgagatccgcatcgcggcgctcgtcccgctcgaccagcttgacgacgccgtgcgcgcgctgcacaccgcctacggcctcgacgccgatcaggtcgaagccgtggtctacggcggcaccggtcgctgatttttgacgcaatcgcgtaattgaccaccccgcccgctacgcggaatatctccgacagcaggagccggctgggtggtcaatttatctggtttgagcgttcttacctcctccttccgtattcattcgcgctcctgagccgaaggaggagcacatggaacgttccaacggaattatgcggctccttgtggcagcgacggtcgccgccacactgctgctgctcgccatggtcatagtcgccgtgatcgttacggtacgattccgccgtaatccgcgcggcaatgcacgtcacctgcgtcggtgacgacacccgatatgccgaacggccgggttgactgcggaatcaatccgtggtcaacccggccgttcgatggtctccagccgcaatttcagtctcagcggcaggctgccgtcacttcgcgctgatataaccgagcgccttgagcatttcggcgcattcgagcgcgccgccggcggcaccgcgcaacgtgttgtgagccagccccacgaacttccagtcaaagatcgaatcctcgcgcagacggccgattgacacgcccatgccgccctcgtagtccacatcgaacttgacctgcgggcggtcatcctcggtgaggtattggatgaagtgcttcggcgcgtgcggcagccccagctcggacgccttggacgtgtagttcaccaagcggtcgacgagctcttccttggtggccttcttgccaaagttcaggaataccgtggcggtgtggccgttgagcacgggcacgcggatgcactgcgaagtgatcttgagaccgccgtcgaacggcacgatctcgcccttgtcggcatccacgtgaccgaacaccttgagcggttccttctcgctcttcgcctcctcgccggagatgaacgggatgatgttgcccaccatctcaggccagtccttgaaggtcttgcccgcgccggaaatcgcctgatacgtgctgacgacgacttcgcgcggctcgaattccttccacgcggccagcgccggcgtgtacgcctggatcgagcagttcggcttgacggcgatgaagccgcgcgtggtgccgagccgcttgcgctggtgctcaatcaccgcgaaatgctccgggttgatctccggcacgaccatcggcacatccggcgtccaacggtgggcgctgttgttggagacgaccggggtctcggtcttcgcgtactcctcttcgattgcgcgaatctcgtccttcgacatgttcaccgcggagaagacgaaatcgacgccatcggccatgccggccacatcggcgacgtcatgcaccgtcatgcccttgacgtactcgggcatcggcgtttccatcttccagcgggggccgacggcctcttcataggtctttcccgcactgtgcgcggacgcggcgagtttgaccacctcaaaccacgggtggttctccagcagtgtcacaaaacgctggccgaccatacctgtggcgccaagaatgccgaccttcaacttttcggacataacaacctctgggtttgattcggtttcctatacaagcggccgcagtgacatggccgcacctatccaatggtacggaatgcgcggaacaagacgggccgctttcccgaatgatggccgtgttcgccgatgggtgggtgctgcggccgggattcgcggtactctggaagcatgtcaatagcatcgcaggaagcgcagaagcagctggatcgtatcgtggcgctgggctacccggacgtggcggacatgagcgccgccgcgttccgcgcgctcgcacggccgctgatccatgcgttggagcataccgatctgggctcgaacatcctgctgatccccacgcgcgagctggtgtcgcctgagtcgctgatcgcccgaaccagcatcaaccgcatggccggtttcacgacaatgcctccgcgcgacatcgcaagcttcctgccgcaggacgggttcgagccgccggaagggccgttctatctggttgtcgagccgcataccggcacctgctacatcaatcgcgagccggacgtggcgcgcaagctcatcgattccgacgagcgcacgccactgacccttgaagagggtcttgccattgccacgcagcaccccgattggcttgagatcaagaacgggttcaacctgctcggctctcgcagcgccgacgggcgcgtgcccagcatctggatgagccagaacgcgccgcgtctgggggccgtgtggccgaactcgcggcacacgtggctgggtaacgcctactgcatggcccggcgcggcgtgagtctgttccactgaatttcgctggagcgcttgtctgtcgccttcgctgggccgccgcacgtgtcactgtgcgagggtgaccgatggatgcttggtgtttcctgatatgtgacactgtgttgtacgacgcccggttttatgatgttcttgatgtgttcgcgagcgctttcgcgccggcgggcaatgatgagagacgccattgggcgggggagaaaggcggacacgcatgaagtgcccatattgcgggaatgacgagagcccggacagcaaattctgtgggaactgcgggcagccgctgcaacaacaggtatcacaggccgcgccggcgtcgcagcccgcagtatcgcagatgccccagccctctgcggcgcaacagccggcgactccagctgtaccactgccaggcggcggattcgcgccggctcctgctgcacctcaggagccgctccagcctgttgcccaaccggcgtggccgcaagcccagcagttcgcccagccgtcaggtgccggagtctcgactccggccgcgcccgcaacccagccatcagcggcgacgccggccgtgccagggaaaacgccgaagcccaaatccaggggcaagctcatcggcctcatcgtggccgtggtgatcgccctcgcgttgggtatcggtcttgccctgttcttcacgtatcgcgcgggcatctggggcggaaccccgctgcctaccgccgaagagatctccggtgcgtccggcggcgaagccaccgccgatgacgtggtcacccagctgaaagccaagggtgtgaaggcatcgaaggcgatcatcttctccggcaagaagaagggcgtgttcctcggatacgagggcatgaagcccggcgatcgcgtccagaaggacgccgcggtaatcgtccaggagtcgggtggccccggtgtgcccaagaacacgatgggcaagcaggccacgaaggtcgtatccacgttcaagacgatgggtgtgccggtacattacaagcaggtaccggtgtccgacaccaagaagaagccaattggttccgtggtggcgacctaccccgccgaaggacaggcgctgtcggacggcgacaaggacgacggcatctacatcggcgtcgccacgaagagcgacggcggcgccatcagcatcgacatcgtcggccgggacgtcgacacggtgaaatccgaactggaaagccaaggacatgacgtgacgctcgtgccgcgcctcgcctcgaagaagttcgtcggcaaagtgtccggttccgacccgatgcccggatccacagtagcggaaggcgatgcggtcacgctgtattacggcatcgacgccagcggcgtcaaggacgcctacacggttcacgattccccggagaccggcggcgacaatctgctcggtgtctccggtgtggccgcgggaacgtggtgcaacaactccggtgactgcatcacgttcaaggatggcggcgatggcagcgaaggcaactcgtacatcccctatccgaaaggtcgcgacggtaccgaatacggcgaatacgagtcgctgagctcctgcgatgccatccagcagccgtactgctccagcccgaaagctgactacctgctcaccggtgacaccggcgcgttcgaactgttcccgcgatccagtatgacgaactactggtgcggcaccagccaggaagactcgaatacggcaggcggcatcgtctgcaacaacggcaagatggtcgaaaacggcgattacaacaatatctccggcgcgacgtatcacatgcaggacttctatctggtcgtgccggtcggcgcggacctgaacaagctcgaaagcgacgggtactttgacgcggacgcgctggccgcggccaagaaacagaaagccgtgaacacgaccaagccgttcctgatctaccgtgacccgaagctctacgacaagaccacggcggacatgaccaataactccgccaacccgttcatgccgtacaacggctacgtcggcagcaaaagcgacatcgtcaagatgaagcccgctcccagcgacgacaccgtgtactatctgaccgtctccatcgacctggattggggtgagctgcccgacgccgatgtcaagtagccgggcggcagcgccggcgtggacggcggtgcatcatcggccaagcccaccaaggacatgagcctgacggatgttcgcaccgcactcggcaaaggcgatttctagccgatagcaggcaaatactgcctgaaagacgacagttggtgcctgacgttggacgacaagggcaaggccacctcggttggctcgggcaagctcatgctgagccccgatgatccgcagtcggtcacgctgcacgccggacggacacgggtggtgacggttggtggaaggtgccgtcggacgtcggcatcgagctcatggggccggatagcgactatcgctgcggcggcaagaaaggattcaaatcctgctatgtgccagccggcatcagcagcaacaaactggagggactggccggcgcgagctaccagttgccgacgtgtcaggccatgccaagcctgacagctccaagccgttcctgaaaatggaggggtaccacatgaacgtcgttccccccttgacgagaacgtgctgtacctgaccgagtagaggtagggccggcccggggacgagccgggtggatatacggcggatatgaataggcatggtgtcgacgatatcgccgccggaaccatgccctttgtcgtctgtttgccgccgctgcgctatcgtcgcagacgccgtgcgatggagcgcacgattgccgcgaagccggcggatagggtcagggcgacggtggcaaacacctgcggccggcgcagttcgttgcgcagggtcgcggcgcccgtcacgcaatgatcctcgaagaacacgcgcaactcattgccgctgtaacggccgaccaggtcgccccacgtgagcatgcgggtctcatacgcggccgggtcgtcctcgcggaactcgaacaggcggatgccgcgcaggcgagacttcggaccgtagcattcgaagccgcacgtcggcgcataccctagatcgaggtcatgcacgtgcccgacgaacgagttcttgtgatcgtgcccgcagtacaacgcgaaatagccgcccgcctcgcgcaatgcgtccacctcgccgacgttctcgtcagcgcagccgatcgcctcgccgagccgtgaccccggccggcatacggcgtcgttgagcacgtagcagcgcccggcgtaattgcgggcgccctccacggcgttcggcgtccatgccgggacctcggtcaggcagtcatagaattcctgcggcggaatatgctggaacgtgatcgacggcaccggttcgccatcgccgttgcgctcggcgagcgtgcgctgcacgtcgcccagccatgcgatcgcctcagcgctcggtgtgccgtagccgtccgaatccgctaggtcgagtccgcgcgaatgcgccacataccgcgggtactgggcgtcattctcctccggattgcccgcataatcgccggaattgaccagcatcacgcccatcgccacatgctccgaaccgtcggaggacagcacgggcagcgcgaatgtgcccggctcgatggccaacggcgagccgccggccacatcggcctcgggattcaggcagccggggaactcgcggtagatgtcgtcctgctcgtcaggcaggatgccgcactggaagtcgtgattgccataggtcgcggcgaacggcacacccgcgttgatgaccggtccgaggaacgcgctgaacgtgtcgcgcactttctgccgggtgtcgttcatcaggtcgtccatcgtgaccacatcgtcctgcggtggcaggtccggatcgcgccgcgccgcgatgcgcctgtggatgccgtgtagcttcgcctcgatttcggtgacgagacgtacgcgtgcgccggggttctcgccgcgccggcgcaggaacgtgtcgatgtacgcgggatcgtacccgcggatttgatcgccggtgaacaccaccaaatccggcctcgcctcgttgattgcggcctcgatcatgcggatcgtgtcgcggttgacttccgggccgtcctgaatgtcggccatttgcagcacgcggaacgtgccgtcgtcgtgaaaacgcagtgtcatgccctccactgtagcgagtcgccctgtgcggcgccatactcttcgcgaagtcgccaccacgcgtggagcgggcgtcgccatgcagtcaacgggcgtccggagaggggccgaaacgttatctcggcagggtatctacgtttcgagggggtgactcggacgctccggaacatctatctgcatttcgaggggttggtggccgagtatcaatggcatgggagccgcatgattccagtggcgtccatcatgcaatacctcgaatatcgagcaacgccaaccccttgaaacgcagatagatgttcggcgggcctgaaatcaccccctcggaagcgagataacgctccgaaggccgcatggattggccgcattcttgatatctcggcggtttaccggggcgcttcacgctagactgattaattgcatgacctatcgtgcgacgacaacatacggccggcaggcaacaggcgccggcatcatcaagtaaaggaggagatatgggtcaggatcaatcatcagtgtttgatcttgcggcggtcgccgcggcgtccaatggggggaacaacgacccgctgctgcctcccgcacgattcatcggcgagccgcagaagccgagcgatatgccttacaccaagtacgtcgcctacgacaagcaggtgccgttcgactatcccgagcgcacgtggccgggcaagcgtctgcagcgtgccccgcgctggtgctccgtcgaccttcgcgacggcaaccaggcgctcgtcaacccgatggactccgagcgcaagctgcgcttctggaacctgctcgtctccatgggattcaaggaaatcgaggtgggcttcccgtccgcctcggagacggatttcgacttcatccgcatgcttattgaacgcgagctcatccccgacgacgtgaccatcgtcgtgctcacccagtgtcgtgagcacctgattcgccgcacttacgaggcactcaagggcgccaagcgtgcgattgtgcacttctacaactcggtctctgtgctgcagcgcgaggtcgtgttccgcaagaacaaggaagaggtcaagaagctcgccaccgacgcggccgagctgtgcaaggaccttgaaaacgaggccaagggcatcgacctgtattacgagtacagccccgaatcgttcaccggtactgagccggaatacgcggtcgaggtgtgcaatgcggtcatcggcgtcatcaagccgacccccgagcacccgatgatcatcaacctgccggccacggtcgagatgactacgccgaacgtgttcgccgatgaggtggagtacgtgtccacgcatcttgatgaccgtgacgccgtggtgctctccctgcacccgcacaacgacgaaggcatgggcgtggcagccaccgagctggccgtgctggccggcgccgaccgcgtggagggctgcctgctgggcaacggcgagcgcaccggcaacgtggatctggtcacgctgggtctgaacatgctcacgcagggcattgatccgcagatcgactattcgaacgttcccgagatccgcaagaccgtcgagtactgcaaccagatcaagatctccgagcgtcatccgtacgcgggcaacttcgtgttcaccgcgttctccggctcccatcaggacgccatcaagaagggcctcgaagcccgcgaggtcgctgcggaccgagtcggcgccgatctcgacaagttcgtgtggctcgtgccgtacctgccgatcgacccgaaggacatcggccgcacctacgaggcgatcatccgcgtcaactcgcagtccggcaagggcggcatggcctacctgctcaagaccaaccacaacctcgacctgccgaagcgtctgcaggtggagttcgacaagatcgtgcaaaacttcgccgacacgaccaagaaggaagtcaaggacgaggacatctggcgtctcttcaaggacgagtacctgccggtggagcagtccggcatgacggccgccggcgtggtcgtcggcgatacgcatgacgcgacgctcgctccgtggggccgcctcaaactgctcaaggtggccgtcagttccggcgaggatggttcagacaccgtgctcaaggcgcgtgtgctcgaccgcggcgtgaatgtgggcgtggacgaacctcacgagcgtgagatctccggcatcggcaacggcccgattgcggcgttcctcaacgcggtttccaacctcggcattgaggcgtccgtgatggattacgtggagcacaccatgtccgtcggtaccgacgccatggccgcgtcctacgtggaatgccaggtgggcgaggacgctgagacccagatcatctggggcgtcggcatcgactcctcgattaccaccagcgcgctcaaggcgatcatctccgcgatcaaccgttcgcagcgctgatatttcgcggtaaacgaaagggtggctgcaggattcgtcctgcagccacccttttttgatggtcgtgagaggccggaaccacctccagtcgcacggggcctggccctcgtgcccccgccggtggggatggtcaacgcacgctaataaccgcgaatccggcctcgtccctcactgcgacgctatgccgttggtgctggattcattgccggtggagcagccggcggcggtggggtcggtcgcgcaatccgagcctccgccgttgttgccgttgttccctccgttgccgttattcccgttgttgccgccgttcccgccgttgccatcggacccgttgccgcccgatccattgccgttgccattcgaaccgttgccggtctgcggcgtcgtcgactgcgagcccgacccgtcgccagactgcgtgccgctctgcgacgactggtcgtcgctcttgctgccgccctgcgaattcccgctctgcgactggccgctgttgccccaagacgagtactgcgaaccggtgccccacgtgccatcgggtccaccgatcttgccgctgtcggtcacgtcggggaacttctcgtccgccacgttctccagcgccctcgacatgtagttggtgaacagcacggccggatatcccatgcccttgtaatacccgttgatggtcggcagttccagcgcctcgccgttcgctccgggattccagatggcgaacatggtgagcgtcgagggtgtgaacccgatgaagctcacggccttgttgtcgtttgccgtgccggacttgcccgccatcgtcttgccgatcgcgctcgccgcacgaccggtaccgtattggatggtgccttccatcgccttgaccaccagtccggtgtcgttcgcgtcgaacacctgctccgcggtggatggcgccttgtacagttccggccccttgctgctcttcacgctggcgacgatgtgcagcgtcggcttcttgccttggttggcgatggtggagaatccgcgcgccatgtcgatcatgctcaggccggagttgccgagcgtcacgtagccgtcatcggtgatcttgcctttgatgccggccgtgtgcgcggtcttgattatcgtgtccgcgccgagatgctgctgcagatccatgtacaccgtgttgacggagttcgccgtcgccttgtacaggttgatgtagccgtagctagcgccgcccgagttcgacatcggctgtttcagcccggggaagctgcgcggcgagttgccgttgaacacagtatcgaggctgacgcccgtctggacggtcgaaagcagcgtgaacggtttcatcgtggaaccgacttcgtaggtcgcgtcggtgacgttgttgagctgtttcttcaggtaatcctcgcccgcgtacagcgagatgattgaaccgtctttgacgttgaccgacaggccgccggtctgtacgccgtccggcatgcccgcgttgcccttggtggggctcgcggtctgatacatcagatcctgtttggatttgtcgatggtggtgacgatggtgtagccgccggtgtcgaggtcgtcttgcgtgaacgcctttgagttgatgagttcgctgcggaccatctgcagcagatacccgttggggccctcgtagatgttctgctgtgcgttggtgacggttttcggcatcgtggcttcacgggcctgtttggcggtgatgtagccgtcctctttcatgatgttgatgacgcgctcgaatcgcgatttcgcctgcttggcgttgacggccggatcccagttgctgggggacgggatgatgccggcgagcatcgctgcctcgggcacagtcaggtctttcgcgtccttgccgaagtacgcctgggcggcggcctggatgccgtaggcgctgcggccgagatagatggtgttgagatagttgcacaggacggtgtctttgtcttgcgtctgcgcgatcttgactgccagtatggcttccttgagcttgcccatgtaggtggtggtctcgccgaggtaataccgttccgcgtactgctgggtgatggtggatccgccctggcgggtgcccttggtgacgttgttgatcagcgcccgtgcgatgcccttgaggtcgatgccgcggtccgtgtagaacgtgcggttttcggaggcgaccacggcctggcccacgtatttcggcagtgcggagcagtcgatgatctcacggttctgctcggcgaacgtgccgattttcgttttgccgtccgcatagtacacgctggttttctcggccagcgcgatggtctccggctgggggatttcgatggtggcgtacaggtaggcgaacgcgccgatgccgacggcgaggaacaggccgatgatgccgagcgcccacttgagaatcagatgcttcttgcgccctttggctttcgggcctttcgagccgggggagcggtgggtgccgccgccgcggtgtgtgccttcgggcggattagcgccgcggccacgccttgagccgctgttgcgctgcgcgctgtaaccgttggttgcggcggtgccgccggttcttgtgcccgtcgctgcacccgcttgggtgccggtcgcggtgcggcctgaggcgccggccgcccgacggccggacgttcctgccgcgcgtcggcctgaactggaattaacagtgcgcgtatgtgaagccatgattctaccgtagtccttgcaatatgatgcgaaccggtttgcgcatattttcgcgctttcctcaccggttttcctctgaatccttacaaacgtcgatatcgtgcttggtgcttgtctatatctagcaaaaccacaaccatagcctctcggcgtgacggtatcgtgagaaacgttggaaaataagggttttagccggatgcgtcactgtgcgagggctcacacggcgacgataccgtcgcacggtgacggtcatgaccgtccttaatgtgagtcggattctgcattgtgggattgtatgaatgcttcgctggtttgggcccggccaaagcggtgcggcgttgcctcatccggtcatagtcccactttccggtgaacgtatgagactgtggccggatgagatgggcgggagatccggatgaaatgagaaaaggcggcggcggaagtgcccgccagtcggtgtcaccgggcgcgcagcatcggcgcgacctgctcctcatatgcggtgagggcggcgtcgatcacgttgtgcatgtcgtagtacttgtaggtgcccaggcgcccgccgaacacgacgttcggctcggcggctgccctggctgcgtaccgctcatagagcgccttgtcggcgtccgtgttgatcgggtagtacggttcgtcgccgcgctcggcgaagcgggagtattcctcccacaccactgtcctgttgtggttctgtgcgtcacgcctctccgggttgaagttcttgaactcgatggcgcgggtgtagggcacgtccgcgtcggagaagttcatcaccgggcagccgaagtggtcgtcctcgtcgtagcgcacttccttgaagtccaccgtgcgccatttcaggtcgccgagttcatagccgaaataccggtcaatcggcccggtgtagaccacgggcgtgccggcggcgcgcagcgccttcttgttgagcggctggctctcgtcgaagaagtcggtgccgagcgtcacatggatgcgcgggtcatcgatcatgcgctccatccacgcggtgtagccgtcgcgcggcagtccctcccatgtgtctttgaagtagcggttgtcgtagttgaaccgcacgggcagccgcttgatgatgctcgccggcagttcggccggatcggtctgccattgcttggcggtgtagttcttgatgaacgcctcgtacagcggccgtccgatcagctggatgcccttgtcgttgaggtttgtcgggtcggtgccggccagttcaccggcctgttcggcgatgagttgcctcgcctcggcgggcgtgtaggccgcccggaagaactggttgatggtgccgagattgattggcagcgggtagacctcgccgtcgtgcgtggcgtacacgcgatgcacatagtcggtgaatgcggtgaagcggttgacgtaatcccagacgcgtttggtggaagtatggaacaggtgggcaccgtattggtggatttcggcaccggtctcctcgtcgatatagctgtacacgttgccgccgatgtggctgcgcacatcgatgatctcgacccgggcgcccgcgcgctccgccgcctgctgtgcgatggtcaggccgaacaggcccgcgccgacgatcaccaaatccgcgttcatagcttccttccgttgcggcccgcgccggcggtgccggttgcgccgcgacccttccatttgatgattcgcgctgttccccgcgtcgaatatgaacggccatcatgtgcgtttcgttctcagctcgaccaaggataccgcacattatcgaccgcgcaaccatccctgtgaacgatttgatgaacgttcggtgacggcatgtccggcgtcttttacagcgcgcacacgaccagatatatggccaccacgtggcaggtgtacccgatgaccgtgcccatgtgaaacacctcgtgaaactcgaaccagcccggaatcggattgggtttgcggatcgcgaagcatgtggcgcccgcaatgtaggcggccccgccgcacgcaatcagcacggtcgccgccggacccaccgcgggcgcggtccacagcgccggaagcagtgtgaccggcgccagccccagcaccacgtacacgacggtgaacacccagttcggcgctcgcagccatacgatatgcatcaccgtgccgacgagcgccgccgcccatatcaccgtcaggtacggccatcggatcgaagggctgagcgcgaacagcaccggcgtattggtgccggcgatgatcaggaagatgttggagtagtcgatgccgcacagcacgcgcgtcaccttggcgctgcgccacggtacgacgtgcagcagggcgctgttgccgaacagcagtatcgccgacgcgccgtaaatcgcgcacgcggccttgaccggtccggccggcgcgatgcagatcagcacgatggatgcggcgatgcacaacggcagggtgatgaggtgctgccagccgcgcagccgaggcttgcggttgccgaatgcatcgaccggcgtgacctggcgttcggcggctttcagtgtggccttggcttggcgatagcgtgcgcgcgcggcgcgatactgctcgagggcgcggttcatcgcggtggccgaggcaccggtctgcgtcgcggccatgccggcagcggttgcggtctgcgctgtggcggccgcccgcatcccgccgcccgcggtctgtcgccgcgctgtttttcgctgcgccgcggacttgcgtatggatggtgcactgattgacgcgctcatcatcatcacctcgctgcggccggaatgcccggcctacactaacttacgctaccgtaacttagtgtaggtcgctgatggttcgctgacaatgcttctctggtggtgaatcgaacgccgtccggaccgccgaaggcagcatggcggttcgtgtgtatcatatattgaccgtcagctgaagattttcatagttttttcttatagccgggcataagcggattgtggatgcgccgggatccggaagtacgtgctcgactgccgtaatggataccggtcgaatatgctgtggccgcatgggaggggctgaaaagcgcggtctgatggaggtctgcctgtctgacgatggcgtgcgtcatgcgtgggacgtgagagtcggcgtatacggcattgtgatgtgagtgttaacaatatgttcctgaaatgttacgcgatgcgacaaaaagtaacgatatcggacgagcgccaggtctagtttctttcacagtgtcgtcgtgagtgacgcacgcaaagagaggaaaacaataatggccaataagcaatggcctcgctgggttgccgctgtagcggccctggcgatggcaggcagcctgcccggtaccgcgctcgcggctccggcacaaggtgacgcggcgtccacgacgccgactctgtcgaccggcaatctgaagagcaaggtctcatcccagcttcagcaggcgaagggcgaggtcaccgcattcatccagaccaccagcccctccgcgctggaacgtaagaacagtgtgctcaagaacttcagcaggcagcgttccgcgctgtccacgctgaagcagcgcgcgcagtcggcccaggcggccacgcagagcgcgaagaccgccgagaagacctcggtgaacgtgttctcgcagctgcagtcgctggactccagcgccaagaagatctactccacctcgtatgcgctgtccggcgtagccgttcgcgccgacgcggcgtcgctgcgcaagctcgccgagcagtccggctcggtggcgcacatcacgatcctgacgcccaagaaggcgctcgacacgaccaacggcagtggcgaagcccccgcgaacaagaacaacgaccagctggtcaacgccgtcaagacttgggaacagaccggcaagaccggcaagggcgtgaacatcgcagtcgtcgacaccggcctcgactacacgcacgccgacttcggcggcgcaggcaccaccgaggcctaccagaccgcgctgaactccaccgccgacccgctgaccgacccgaaggtcagcaagctgctcgacaagacgaagttcaagggcggttacgattacgccggcgccacgtacaacccgaacgccggcaacaacaatcccaccccggacgccaacccgatcgacggccagggcggccaccacggcacgcacgtcgccggcaccgcgctgggctacggcgtcaaggccgacggcacctcgggcaagaccgataccgcaggctaccagaagctgaccgccggcgacatcgccagctggaagattggccccggcgccgctcccgaggccggcatctactcgtacaaggtgttcggcgacaacggcggcaccaccgacctggtgctcgaagcgcttgacggcatcgccaagcacaacaccgaggcggaagtcaacggcgacgagtccagccgcatcagcatcgtctccatgtcgctcggcggcagtttcggcgcctccgacgacccggagaacgtggccgtggataacctcaccgcagacaacgtgctgtccgtgatcgcggccggcaacgacggcgacatcaccgacatcatgggtgcccccggcaccgccaagagcgcgctgaccgtggccgcgagccagtccggcaaggcgctgcaggacgccgtcgaagtgaccgacggcccggcctcgctcaagggccagaccctcgccggccagtactccgtgaactacgcgaagctcgacgacttctccctgaccggcaaggtcgtgcgcgtcaaggacaaggacaacctggaaggctgcaaggcatactccgccgatgacgccgctgccgtcaagggcaacatcgcctacgtcgaatggaacgacgccgctgtgaactgcggctccaagacccgcttcgacaacgccgagaaggccggcgcgaccggcatcctgttcggctcgcaggcgaacatccccgaggccggcatcggcggcaacgccgacatccccggcttccagctggtcaagaacgccgccgagaacaaggacctgcagagcgccatcgatgacggcacgctgacggtgaccctgtccaccaagctgcgtatgagcaaggacgccgactactccagcgagagcgaagacaccatcgcgtccttcacctcccgtggcatccacggctcctatgacggcaccgccaagcccgatgtctccgcccccggcgtgggcatcgtgtccgcttcggccggcaccggcaacagcgacgagatcatgagcggtacgtccatggccaccccgttgacctccggcgtcgccgcgctggtccgtcaggcccggcccgaataccaggccaacgtggtcaaggctcagctgatgaacaccgccaaccacgacgtgctcaccgcggatcgcaagaccgcgtacggcccgctgcgtgtgggctccggtcgtatcgacgcgctcgccgcagtgaacaacaacgtgcagcttgccggagaggataacgaggccatcaccgcgcagttcggcgtcatcccggtcggcaaggacggctacaccgacaagcagaccatgcggctcgtgaacaacaccgatcatgacattacgtacaagctcacatactcggcccgcaccccggtgccgggcgtcacgtactcggtgagcggcgacaacggtggggacaccgtggtcgccaagtccgggaccagcaccagcttccgcgtgacgatcagcatcgaccagtccaagctgacccgcactcgcgacgccacgcagtccgcgcaggtcgcaggcaaggaccgccagtacgtgaccgacgccagcggcatcatcaccgcgactccggtcacccaggaggatgacgccaccacgctgcgtgtgcccgtcacttcggtgccgaaggcaatctccgaaaccaccacggaactgagcggcttcaacaacaagaagggcacgctgtccgtgtccggccatggccttgaccagggcgacaccgccaccggctaccactccgagctcgtcccgttcgtgtacggtgccgaggatccggtcgacggctacaccggcaacggtgacgccgctcgcagccttgccgcaggtgacatccgcgcgatcggttattccagcaccgcacctcagctctccgatccgtcgcagggcctgctgagcttcggcatcatcaccgacaagacgtggtcccacctgggcaacaatttcattccggacgtgatcttcgacgtggacggcgacatgaaggccgactacatgatctcggtgagcaccaccgaaggcaacacgcagtacgacaccgcatgggccacgacgacttccgcgacaaccggcaaggtcgttgacgaggagcccatcgaccccgcatatgtctccgactccaaccaggtcgtgctctccgtgaagctgtccgcccttggattcaccaaggacaccaaggtcgccccgatcgcctacatggcacagatcgagtcgatttacgctgccggcgcgaaggatcagtacatcgtcgacactgcgggcggttccaaggacgactcgttcgacgcgtaccaccctgccctgtggttcggcgactccgccaccgaaggcaacggcacggtcagcttccccgacgagaacggcacgaaggtcgccgtccacaccgcggatgattcgtccgagaccgctccgaaggtgctggcgctgcacaagaacggcttcttcccgaacatcgagaccgatgagcccgtcatcgacgcgcacaccgtgaagaacatcgacaaggcgctgctggagactctggtctttgccgctagcaagtaccaggaatccaactacacggcggattcgtgggccgcattcaagaaggccttcgacgcggcgaagaaggtgctcgactccgacacggccacgcagcagcaggtcaacgacgcctacacggcgttgcgaaccgccatcaacgggctcgtcaacgcgaccgccaagccgtctaaggacaagctgaaggcggcggtggatgctgcggccaagctgaaggaatccgactacacggcggattcgtgggctgcgttcgtcaaggcgcttgatgccgccaaggcggtgctcgccaacgacaacgcgactcaggaagagatcaacaacgcgaccggcgctctgttcaaggccgaagaggctttggtgaagaaggccggcacgccgacgaagcccggcaagccgagccagcctggcgccccggcgaagcccggtgcgtcgggcgccaacagtggccagaacggcagcaatgccggcgtcgccaagacgggtgccgctgtcactggcatctcgggcgcagtcatgctgctgctcgccgccggtgccacgctggtgatcattcgccggcgtgacgcggtgcgtcgctagtctcccatagccgataatgccctttcccgcgagcgcggggaggggcattattgtcgttgcgcacccgatatccgggggtgatgtatactagtacagccttcacgtggcgttatgtcacccaatccccccagggcaggaatgcagcaagggtaagtggcctctgtcgggtacgtgaaggttttctttttcttttcttggcccctcaccctgaccgtcgcggcaccgtgaggcttaaattacaggttgaaatcgccgttcttggcaattccccgtgcgaaatcgccgtttttggaccttgaaacggcgatttcacacggggaatagtagatttcggcgatttcaacccgtattttgatatgccggggccaggttttcgattattctgtcggaatatgggcgcgatgaggcgactgacacatgtacaggctctacagtcttgaagtatgagtgaagaacagcgtgttgatgatcccgccgaaatctcgcgtgacggtgcgattccgcctgacgccgtgcaggtcagcggcgaccgggctgatgcggcaacgtcggcggaacgcctgccgtccacggagacgaccgatgcgcccgctgacacgccgaatgagccggataccgcagccgcatcggatacgacgtcatctggcgcgtcggcatcagcccccgcaccagaacaggcgcgctcgtcggcgaaacaggagccagaacccgtggtgccgcaggcgtccccggccagcgcatggtccgctttggagacgaccgcggatcatccgctgcgcaccctcggatcgcccgcgccggccgcgcgcaaacgtaaggccgccgcgcccgacgaacacgcggcggacattgacgacgaggcggacatcgagcgcggattggcgcgtcgcgacccgctgaccgtgcgcccgcgcgtgtcgagccgtgtgctgtgtgcggtgttcggcgtgctgatgatcgcgatctcgttcggcgcatggtggatcgccgtgcgcaccgaggacgggcaatcgtacgaggatatggtgttcagcggcttccacgacagcctgccgtcgtgggcgtccgctctggtcgccccgttcatcagccgcaatatcacgtcaatcgccgggcatccgttgaacttcaccgtaatcgtctccgcgctgctgatcgttgtcgcggcggtggtgatgctggtacgcaagcgttggtggctggtcgggcagtccgcggtgttcgccgcgctgtgtttcgcgtccacatatcttaaaggtgtgctgccgcggccgttcatcatcaacaccgtgtctcagcccgccaattccgcgccttccggtcatacgatgctggccgtcgtcgcgggcgtgctgctgctgttcgcggttccgcgcggatgccgtgcgtggatggcgctggtcggggccgcctatgcgctggtcatcggcctgtcggtgatcgcgggggcatggcaccgcccggttgacgtggtgatgagcctgctgctggcgggcggcttcgcgctgctggcgatggcattcacgcgcacgtccggcatggacgcgcccggcaaacgcgcgtcctcgccgagcgtgcagatcgtcggcacggtgatgatcacggcgggtgtgctgtgctgctgctatgccgcatacatcatgtggcagattgagcccggtctgagcctgagcgcgagctgggcgagcgtcggcgcccacgtctccaccttcgcgatgatagccggcgtttcgtcgctggtgttcgggatgctgctggcgatgcgccagatcacggcgtccccgttgagccgagccggcctggtgggggcgccgccggccccgccgaagaagaagcggtgaccgccgcggagccgcgcgatttgccgtttgaccatgccgcgtgagtatgatgaaggccaatgacattgtaggtaaggagagacaatgggcaccggcaacaagcttgtcatcgtggagtctcccaccaaagcgaagaaaatcggtgggtatcttggcagcggctacaccgtcatggcatcggtcggtcacatccgtgaccttgcacagcccagtcagattcccgcggacgacaaggccaggttcggcaagttcggcgtggacgtcgacgatggcttcaaaccgtactacatcgtcgacggtgacaagaagaagaccgtcgccgaactgaaaaaagcgctgaagaactccgacgagctctacctcgccactgatgaggatcgcgaaggggaggcgatcgcctggcacctggtgcagacgctcaagccgaaggttcccgtcaagcgcatggtgttccacgagatcaccaaggacgccatcaagacgtcgctgggcaacacccgcaacgtggacgaggacatggtggacgcgcaggagacccgccgcatcctcgaccgcctctatggctacgagctgtcgcccgtgctgtggcgcaaggtgggcccgggattgtcggccggccgcgtccagtccgtcgccacacgcctgatcgtcgagcgtgagcgcgagcgcatggcgttcgtgcgcgcctcctactgggacgtgaccgcggtgctgggcgcgacggacgcggagggcgagccggcgtcgttcgaatcgcgcatggtgtcgcttggaggcaagcgacttgcgggttccaaggatttttcggatgacggcaagctcacgccgtccggtttcgctgacaacgtatgccagctggatgaggcccatgcgaacgccctcgccaagctcctggccgacgcgaccttcaccgtggcatcgatggagaccaagccgtaccgtcgccgcccgctcccgccgttcaccacatccacgctgcagcagacggccggcaaccgcctgtccatgagctcgcgtcagaccatgcgtgccgcgcaggggctgtacgagaacggttacatcacgtatatgcgaaccgattcggtgaccttgtcgcaggaggccatcgccgccgcccgtgatgccgtcgaatatcatttcggaaagtcgttcctgtccgatgggcccaagcagtatgtgacgaagaccgctagtgcgcaggaggcccacgaatgcatccgacccgccggcgcgcggttccatgacccggcggagctctccggcaaggtgcccgccgaccagctgaaactgtacacgctgatctggcagcgcacgctcgcttcccagatggccgacgccaccggctccaccgcgaccgtgcgtctgtcggctcctgccggcgaggacggcgaggcgatgttccaggcgtccggcacggtgatcgagttccccggattcatgaaggccaccggggagggccgtcgtgcggcggcccccgctgcctcctcgatgggtgccggtgacggcgaggccgcggcgaaacgcgcctcgcgcgaaaccgacgacaacggatcgctgccgccgatgcagaccggtgaccgtctcgccgcgtcctcggtggaggctgacgggcacgagacccagccgccggcgcgatacaccgaagcgtcgctggtgaagacgctggaggccaagggaatcggccgtccttcaacctatgcgagcatcatctccaccatcatcgaccgtggatacgtctacgagcgcggtcgcgccctgattccatcgtggctggcgttctcggtcatcaagctgctggagacgaaattccccaagtacgtcgattaccagttcaccgcggatatggagaacgggctcgaccagatcgcgcacggtcaggagaccggccgtgactggctgacccatttctatttcggttccggcggcgacgcggcgacttcggcagacgaagcgcacgcgggcctgcagcagcaggtcgcgcagctgggggagatcgacgcccgcgccatcaacaccatcgacatcggcgacggactgcacgtgcgcgtcggtcggtacggcccgtatctcgaagacatgaaccacgtggatgcggcgggcaaccccaagcgggcctccctgcccgacaccatggcgcccgacgagctgaccgtgcaggtcggccatgagctcatcgacagcaatgccggtggcccgcgcgagctgggcgtcgacccggcaagcggcggcacggtcgaagtgcgcaacggacggttcggcccgtatgtggccttggtgccgcttgagacggacggcgggtcatccgagacgaagtccaagaagaccactgtgcccaagcccaagatggcgtccctgttcaagacgatgagccccgaatcgatcacgctggacgatgcgctgaaactgttgtcgctgccgcgcaccgtgggcgtttacgaggaggccaacaccgagaccggcgaacttggcgaggtcacggtcgaggcgaacaacggccggtacggcccctacctgaccaagaccggagccgacggcaagtccgagacgcggtctctcgcctcggaggatgagatcttcaccgtggacgtcgacaaggcgaaggaactgttcgcccagccgaaatacggacgcggccgtggacgcggcaccgcgaagccgccgctgcgcgagctcggccccgatcccgaaaccggcaagaacgtgaccatcaaggatggcttctacggcgcctacatcaccgacggcgaaacgaatcggaccgtgcccaagcagtacacggccgagtccatcgagccggccgaggcgttccgcctgctggccgagaagcgtgccgccggcccgtccaagcgcgggcgtcgcaagacgacgggtgccgccgcgaagaagaccgccgcgaagaagagctccacggcatctgccaccaagaagacggccaccgcgaaaaagacggccgccaagaagaccacggccaggaagaccgccgcgaagaagaccgccgagtagagtcgcgtcgcagccgccgcgatggcggcctggccgcgtcgcatgccgccatcgcgtacactgtgggcaagggggtagatatgactggattgttcatttctttcgaaggcgttgacggcgtagggaagaccacgcaggtcgagcgcctgcgcgactacttggaggctgcaggccgcgaggtcgtggtgacgcgtgagccgggcggcacggcattgggcggcagcttgcgtcagctgctgctgcgtgagccgggagacgccgcggaagccgacggcgccgatatcgcaccgcgcgcggaggcgctgatcttcgccgccgaccgggcgcagcacgtggctgaagtggtccgtccggcgctggaacgcggagccgtggtgatcaccgaccggtatcttgattcgtcgctcgcctatcaggcgggaggccgtgaactgaccgccgacgacgtccgcgggctgagcatgtgggcgaccggcgggctgatgcccgtgcgcacgtacctgctcgacatggacccgacggcggcgcaccggcgtctgcagcatgacgcggatcgcatggagtccgcgggcgacgaattccagcagcgcaccaggcaggcgttcctcgatctggcaggccacgagccgggccgttttcgcgtgattgacgccgcatggccgatcgaggccgtatgggagcacatcaaggcggacgttgacgcggtgctggccgatgccgcggcggatgagcgggccgcggcgcaggcggctgccgctcaggctgccgtcactaaggaaagcgacggtaacactccggctggaggtgcgcgatgagcgtatgggactccattgtcggccagcaggcagtggtcggccaaatgcaggccatcgtctccggcgacccgaaggcgctggcccagtcgtggctgatctgcggaccgcccggttccggccgctcgaatgttgcgcgcgcgttcgcagccgcgctggaaagccctgacaggggtctttccgacgagccgaccaatataacccgtcaggtgctgtccggcactcatcccgacgtgaccacgttggccaccaacaaggtcaccatcggcatcgatgacgtgcgccagctgatcctcacctccgaacagatgcccagcacggcgccgtggcggatcatcatcatcgaagacgttgaccgcatgctggaacgcaccacgaacgtgctgctcaaggagatcgaggagcccagcccgcacaccatatggctgctgtgcgcccccagcgcgcaggatgtgctgccgaccatccgctcgcgtacccgcatcgtcaaccttgccgtgccgtccacgaaagcggtcgcggattacctgatggcatccgtcaatccggcgctgccggcggaacgccaattcgaccgtcatgtggcggtgcgcgcggcgcggctcgccgaagggcatatcggcatagcgaaactgtacgcctccgacacgcaggtcatgtcggaccgggacgagctcatcgtcgggctgctgggactgcgcaaggcatcggatgcggtgctgctggccgatgatctcatcgacaccgccaaaagccaggcggaagccgacgtgaaccggcagacggccgccgccgaagcggatttccgccgcatcaacggcctcggcgagcaggaccgcatcccgccgaagctgcgcggcgcctacaacgccatcgccaagaaggacgagatcaagcggcgggccacgcgccggagccgcgacgtgcttgaccgcgcgctcaactcggccgccagcatctaccgcgacatagcggtgctgcagaacaacgccgaggacgcagtcgggctgatcaacatggagaaccgcacggccatcgccgagctgtcggcacggctgagccgtcaggaagtggtcgatcggttggaggccatcgccgtggccaggaagcggttgctgggcaacggcaacccgatgctggtgttcgaggcgctgttctgcgcgctgattccggggaggctatgacggcacctggtcaggaacgcacgacggtggagccccggacaatcaattggggcagcagcgagatgtgcgccgcctgatcgggcccctgcccgatcaggcgcagcgcctcggtgacgatctggaggaacggcgggcggaccgaggtcaacgtcggcatcgtcgtcaaggcaagcggggagtcgtcgtagccgaccacgcgcacgtcgtcgggcacgcggatgcccagcgtctgcaaggcgatcatcgcgcccagcgcgatcatgtcatcggcgcatatcaccgcttcgggcggtcgcgcatccgagtcggcgaacatgcgccacacgcactgataaccgcgctccacggtcgaatcgccgaatcggttccatgaggtgtcggtgacgagccggtgcgtgcgcatctgcgtatggaacatcgcgaacatctcggccgattcgaacgatacctccttgccggccagataggcggcggaacgcacgccctgctcggcgaggtgcgcgacgatgctttccatcgccgcattctcgtcgatgccgaccatggacgtgcggaaggatcgctgccgtccgccgacctgtacgatgggcgtcgtcatggtggtgcggtcaagcgtgtgggccagatcgacgcccgcggcaggaacgatgatgatgccgtcgaccttgcgggccaccagcgattcgatgcgttcgtcctgcgtatgctgctcgttgccgatgccgagcagcagttgctgtctttccatgtcgatgaccggttccagctcatcaagcagtccggcgctgaaatggtcggtcgccgaggggatgaccagtccgatggtgttggtggcggcgccgcgcagcgaactcgccgcatagttgaccgaatagttgagttcctcggcggcggcccggacccgccgtgcgatgtcgtcgtccttggtgcgtttgccggagagcacacgggagaccgtggcgatggagacgtgggccatggcggccacgttggtgatggaactggtcgccggctgtgggcgttgttccgggccgggcgccgggtcgtcgttgacggacgtcgtgtctggcttggatgccggtatggcgtccattacggcggatggctgtctcttcatggggctcgcagtgttcggtatgacggcgggcggccgccatatgcttgcgatgcgcgtcggtgcgcatctgatggacgggaatacgctgacggccgcccacgcggttcgtgcgggcggccgtcgaatgcgtgcgcaggttactcggccgcggtgagcgtctcgatgaggctgtcgatgacggtctcggcgttgtcgccgtccacggtgacctcgacggtgtcgccctgcttgatgcccaggcccatgatggacaggatggagccggcgggaacggggttgccgccctgcttggcgatggtcacggtgcagccggacgcggtcgcggcctgagcgaacttggcggccggacgggcgtgaatgccgacgggatcggtgatggtggtagtgcgggtaaccatggagacactcctttgcgtcgtcgcgccggtggttccggtgcggtttgtcgtgcgtcgatatcgacactcgtcagcgtgcgtgtgccgtgttggcccgcgccgataccgattagcaataacattactctatgccaattgctgggcggccgttcttttggctgctgacacagcagtgtaccatgattttccaattttctggaaaacgtttacttctagtcgtgtcgcgcttttgagggtgtatactggcgtggacagaaaatgatttaccggcgatgaagttggtgggtcaacaaagcggtccgcggatgggaagtaccggtcattcgcggcgagaggccataacataaggagaacatatggttatcaagggtgttggcatcggacgcggcgttgcggtcggcccggtcattcgtatggcagctgcgcttcccgaaccgtccgatgcgcctcgcgccgacagtgtctcggccgaatccgagatcgagcgcgtgaccaagtctctggcgctggtcaacgcggatctgaaccgccgtgccgaagaggccgcgaacggcgacgaaggcgccaagcaggccgctccgatcctgcaggccatcgccatgttcgcctccgacccggcgctcgcgcagagcatcaacacgctcatcgagcagggcaagaccgctgagcgcgccgtgctggaaggcttcggcgccgtggaagagatgttcaaggccatcggcggctatcagggcgagcgtgcggcggatctgcacgacgtcggccagcgcgtcatcgccgacctgatgggcgttcccgcgccgggcgtcccggtctccgacaccccgttcgttctggtcgcggaagacctgtccccggccgacaccgccggcctcgacctggacaagaccctcgccatcgtcacctcgcagggcggcccgacctcgcacacggccattctggcccgtgcccgcggcatcgtggccgtcgtgtccgccgccggcgccgacgacctgaagaacggcgagacggttatcgtcaacgccgcggaaagcaccatcaccaccgagccgagcgacgagcaggtcgccgccgccgaagccgcgaaggccaaggccgcgaaggccaaggagctgcgcggcaagccgggcgccaccaaggacggttaccacatcccgctgctcgccaacgtcggcaagccctccgacggcaagaccgcgctggagtacggtgcggaaggcgtcggcctgttccgttccgagttcctgttcatcggcaacgccgaaccgccgagtgttgaggagcagaccaaggcgtacgccgaactgctcgcccagttccccggcaagaaggtcgtcatccgcatgctggacgccggcgcggacaagccgctgccgttcctcacccccgaagacgagccgaaccccgcgcttggcctgcgtggcctgcgcacgctgcgcacccacatgaacgtgcttgaggggcagctcaaggcgcttgccgccgccgatgcccagaccgacgccgacctgtgggtcatggcgccgatggtcgccgacgcgcatgaggccgcctacttcgtcaagctcggcaagtccttcggtctgaagaaggtcggtgtgatggccgaggtgccgtccatcgccctcatggccgatcaggtggccaaggtcgccgacttcgtgtcgatcggcacgaacgacctgacccagtacacgctggccgccgaccgtacgctcggctcggtcgccaactaccagaccgcatggcacccggcggtgttgcgcgcgatcaagctgatcgccgacgcgggcaacgcgaacggcatgccggtgggtgtgtgcggcgaggccgccgccgatccggatctggccgtcgtgctcaccggcatcggcgtcaactccctgtcgatgaccccggtcgcgctcgacgacgtgcgtgccgaactcgccggcgtcacgcttgaggaagcgcaggagaaggccgccaaggccctcaacggcgacttctacaacccgtccgagtggaacatctgagggagtcacgcctataagaccataatgtgattccactgcctcaaacgagagcgacgccatacgagattcggctgttttgccggctcgtgtacggcgtcgcttttgcatatgcggtgtgatgaggtgcggtaaagcgcatgattaatcattgtccatactaagatttcgcaaatcttagtatgaatgatttaaaaaaatgtacagctagtgttatggagaaagaaatgttcgcgccagatgcgcccggcgagctggggggacctgcctaaccccgatatgctgcgtcgcccgaccatgcgtcgcgaagcgcagagcaccagcgccctggaaggcacgttcgagccgctcgaaaccgttctcgctcaggattatgaggtgggcgaggacaaaagcggactgagcgagtccatgcgcgaggtgctgaactacctcgacgcggcggaatgcggcataggccagattcagtccgggcatcccataagcctgcactctcgtgcgcgaattgcagaagcttcttgtgaagggcacgaagtccgacaatccacaggcctgggatatacgatccacccaagtgttcatcggcccacccacgcggcgcatcgaggatgcgcgtttcgcgcccatgcctccggggcgaatcgggcggttgctggtgctgttgcagatgatgagccgaggcctgctgagccatccgctgctgtccgtatccccgtggttcgagcgccgtcgacccgaatatcaggacagattgctcggtgtttccacgaaaggggattgggatgactggatactgttcttctgccaagacatcgaggaatcctgcgaggacgcgctgctgcgcgtgaagcgtcttgtcaatgtgcggcagaggtatcgcagtctattggatgagcacagatacagcggcctgtccgtgcagacggcgatgtacctcatcgggcgcccaccgtcacggcgagtatgttgaggagaaggttcggcaagagcccgtcggccgtacagcacgcgctgtctcgtctggtgtccgtgggtatactccgtgcgtatccggccggaaggggcaacctgtatatcgctccggacatccataaggtgcttgctgcaccgctcggcgcggcgattgacgtgtcggcgccactgatgtgcgagcgtggcgaataggcacaagaaaacctggcggtggcatgacgcaggtgctccctcccgcattgtttatacggtgaagaagttgccggggaagtgacggctcatgatggccgtgcggtcggcgtgcaccgcggcgcattcgaagtcgaatgcgcgggcgagctcgtccggtgcggtgacgaagcaggcggtggcgagtccatccgccagcgcggtggggtagggtcggccagccgccgatggcacatagacccaactcgcggcgacatcgcgcacgggacggccgtcgaccgcgttgagcagatgatgcagctgacggcctgcctcctcaccccaatggcgtcggctgggggcgctcgcgcagaacgccccgtcaacgatgcttgcgatgccgatcgcctcggttccggggttggcgggatcctccagggcgatggtgacggtgtcgccggtgtcgtgtcctgacccctcggcgagtggggccggttgagcaggctcgcccgtgcggatcagcagatcgccgcccgcgtcgatgatgtagggcgcgtgagagccggggccggtggcggattgccggacggtttcatcgcccgcgtgcccgtccaatatcgcgccgatcagatcggcgcaatatcccttgccgaaagccccgaaatccaagtgaaccgcgcgctgcgtcaccagcgttgtgccatgacgctccacatcgttgcgccatgtcgggcgcccgtggacggcaccgagatgatgctccgcatcgggttccattgtcatcgaataccgtgcgtcatagccaagccggatcagatcctcgcccacacacgggtcaagcgccccgtcggtcgcggtgcagaacgcatcggccagatcgaacagcccggaggcccaatcgggaaaatcaaacgagccgccatgcgaggattcgcccattgcggtcaccagcgaatcggcgcggaaccgcgacagcacggactcgtacccgtcgatgaacgcgtcgagtttcgagcggaagccgtcgtcgagggccgtcgccgactgaatgatcattccggtgcccatcgcgcgttcaaacgcagtcgtatacggcatccgcccatgcaatccgctcatgcccctcagcgtagcatttcgccagcgggggcagtcgccttagcctacgttgatgccggagattttgaggcctccgggtgagatgggacggtaagggttccgctggaggatgcggtgtccagccgttgcacgctgccgtcgctcaacaccacatgatgatgggccagacggctggcgttcgcgatgaagatgggccgatgctgctgttcaccggcgtctccgcgatcggcgtggcctcgggcgcgggctaccgcatcgccgcggtgtgcgcggccgtgctgtgcggcatcggaggcatcgtcttcgcgttctacaacgagcggaaggtgttgaatcgtcttgatggctgaagcaggctctcaaaactcacagatacaaggggaaaaacccgaaaaacgtcttgtatctgcgagttttgagagcggcccctaatgggccacccatacgatgaccacaatatgagacatttcggcctcaggggccgctctattaccgcataaaaattcaaaagtcaagactgttctttcaggttttttttctctatattgcatagatggtttagaaagcgttgatatggagaggaatccaatatgcgatgtcgtgcggtagcgcatcttcgggcggttggatgtcgttcgctggccgtcgtcgcggcgctgttcacggtgatggccgtcatgttcgccccgcaggcgatggccgccgacggttccgcggattacgacacatgggccgacgtcgccgccgcgatggacaagcagctacagcaggggcagaaggaatacgaggacggcaacaccgccggttccacgtccgacttcatggccgcatacaacgagatctatgtggcgtccaacttcacccaggtcgtgaccgacaacatcggctccgacaagcaggcctcccagcagcaggcgttccaagacattcaggacctgtcatatgtgacgggcaacgaggtgaagatcgaacagagcgtgaccgcgctcgtctccgacctcgacagcaccgccaagcagctcgacgcgaacaccaagctcgccaatccccgcgactacgacaaggcgctgcaggagcagatcgccaaggagcgcaaggttctgcagtccaagcagaagaagaaccccggcaagggcgaccgcagctggaccgacgtggccaacgagatgatgccgatcctcgacaaggcctacaagtcgtacgcgggcggcgacggcgcgaagggcgctaccctcgtcaacgacgcctactaccagtactacgagaagctcggcttcgagaagaacgtgatgaacgccatcagcggcgaccgcgtctcgcaggtcgagtaccagttcaagatgtgccgcaagtcgatgaacacaggcgcctcgctcaaagacaccaagaagctcgtcgacgatttgaaggccatgctggtcgaggacgccggcaagctcgacggcggtgccgccgacaaggaaggcagcttcaccaagttcatcaccagctcggtcggccaggcgttcctgattctgattcgtgagggtcttgaggcgctgctggtggtcgcggccgtggtggcgtacctcgtcaagtccggcaacaagcgtttcaccaagtggatctatgtgggcgtgctcgccggtcttgccggcgcaggcgtggtcgcggtcatcttcgtgctcgcgttcggtgggtccggcccgattcaggagatcatggaaggcgtgtgcgccctgattgccatggccatgctgctatggaccagcaattggatgctcaacaagtccagcgtcgaggcatggaaccggtacatcaaggagaagaccgaagccgcggtggcctccgtctcctcacaggtcgatgccggcgaaaaggtcgcgtcccgtacggtgatctcgctcgccatgctgagcttcctcgccgtgttccgtgaaggcgccgagacggtgatcttctaccagtcgatttacacgatgagccgcgatgcgcatggcatggtgattggtgccgtcgccgccgcggtggtgctgctgatcatcttcttcgtgattcgcttcacgtcggtgaagattccgatcggaccgttcttcctggtcacgtcgatcctgatgtcggtgctggtggtcgtgttcgccggcggcggcgtgcactcgctgatcgagggcgacgcactcccggcaacgtatctgcaaggcgttccgacgaacgactggctcggcttctacccgtacgtcgaatgcatcatcgcccaggtgattgcggccatcgcggtgatcgccctgttcgtggtcggcttcatcaagcagcgcaaggcgaaggccaaggctgccgtgacggccggtgccccgaacaatcaacccaacaatctgtgaataccattcactacacaacaaaggaaatagagaaatgatgaagaacaagaagatcgccgccctgctcggcgtgctgctggccggttccatggccttctcgctgtccgcgtgcggttccaccaacaatgcttccgacaacaagtcttcgggcagctcctctcagtccagcgacaagaaggacaactccagctccggcgcaggctttgaagaggtcccggtcggcccgtccggcaccgccgaggagcaggacaaggacgccggcccgctgaccgtcggcgccgtgtacttccagccgattgacatggagcccgcctccatgggcctgaaggccgctgattcgagcttccacctcgaagccgacatccacgccaaccagaagggtaccgagctgggctacggcaagggcgacttcgtccccgagctgaccgtgaactacacgatcatcgacaagtccaccggcaaggaagtcgaaggcggcaaggccacctccggtaccttcatgcagatgaacgcctccgacggcccgcactacggcgccaacgtcaagctcgacaaggccggcacctaccagctgaagctgtcgatcgaatccccggccaagaagggctggatgctgcacgtcgatcccgagaccggcgtcaagggtcgcttctggaccgagccgatcgaggtcaccttcgacaactgggaatacaccccgcgtcagtggtgattgacattgcctgagtgaaatgctcctctctgcccgagaggagctttcgctgtttttatgacggaatgaacggaacataatagacggaacaaggaaagggtgcgaatgctcgaacagttcgtagcggtgatgccgggcacgctggggcccgcgttgctggtcatgtgcatgagtgtgatgctgaccgtcggcgaggggcgtgacaagccgatcagctcccgatggcgtctgtggggaatcctcatcggattggtggcggcgatcgtgttcgccggactgcgtgcatccgcggtgattaatcagcgtacattcatcaactacccggtgctgtggtgctgcgtggtcatcgacctcctgctgatcgtgttggtgttcgtgaaccgactgatcacccgcaattggcgtcggcacgccgcggtgatgcatctcgccaatctggtggcggcgttgggcatcgcgctcaccgtgttctatgcgctgccggacgtgatcctgcagctgaccatctgggtcgagccgggagacccgatcttcacgtccgatatgctgctgcgtgcgctcggctttgtgctgggcatcatcgcgtccgcggtcatcgccgcgatcttccgcacgatgcgttcgacggcggtccgtccggcgttcctgtccgcggtgctggtggtgctggtgatccagctgatgcaacatctgaccggcctgctgcagatcatgcaggcccgcacgctgcggttcccgcacatcgcgttcgtgatgctcgcctggctgatcaacaacaagtccggtttgattatggcccaagcgttcatattcctgattcccgccgtcgcctcggtggtggccggcttgcgtatgccggtttctgcgaagcgactcgcggccgacgtcaatgcggccacggtgcgcaagcacaaggcgttccggcgccgtgcgatcgccgccgccgcatggagcatggtggcgatgatcggcgttaccgcgacgctgaccttgggcgtggccgcaatcagccagcagccgactctctcgccgccggaagcgtattcgctcaaggacggcgtggccacgatcccgttcagccaggtcgaggacggccatttgcaccgcttcgaatacaaggccaaggacggcaccgtgatgcgcttcatcatcatcaagaagaacggcggcgcgtacggcatcggcctcgacgcctgcgagaactgcggcgacgccggatactacgagaaggacggcaagatcatctgcaagaagtgtgaggtggccatcaacctggcgaccatcggcttcaagggcgggtgcaacccgatcccgttcccgtacaagaccggtagcggcaagatcaccattcagaccgccgacctggacgcgctgagcgcccacttccagtaaggcaggaaggggtttagaccatgttctttctgagaatgatcaggcgctcgttcacccgccagttacgcaggcgcctgctgatcgcgctgaccgtgtgcctgtcggccacggtgtcggtgtcgatgctgggcgtcgtgttcgacgtgggcgacaagctcaacgccgagctgagcacgtatggctcgaacatcaccgtgcagccgaagtccgatgcggtggtgtccgacctgtacaacatggagggcggcccgcagtccgacgcggacccgacctcgttcctgaaggagtccgacgcggcgaagatcaagacgattttctgggcgttcaacatcacgaatttcgcgccgcaactcaacgtccacgcgcaggtgaacggcacggcggcggcggtagtcggcacgtggttcaacaagacgctgaagctcgcgtcgggcgagaccaccgtcgtgggcgtcgacggcatgcgctcatggtggaagcttgacggcagctggccgaaggatgacaccgatcagggcgtgatcggcacgacgctcgcgcagcagctcggcgtgggacgcggcgatacggtcaccttgcgcaagaccacggcggccgggaacacgcacgagcagaagattcgcatcaccggcgtctacgattccggcgacgacgacaacagtgccatctacatctcctcgtcggtggcacaggtgctgtcggacctgccggactccgtcgacaagatcgaggtgaaggcgctgacaacgccggagaacgatctggcgcgcaaggcggcccagaaccccgccgcgctcagccaagacgagtgggagacctggtattgcacggcataccccagctcaatcgcctatcagatcgaggaggtcattcccggcgcggtcgccaagcaggtgcggcaggtcgccgcgctgcagggcaacgtgctgcagaagacccaggccgtgatgatcctgatgacggtgctgagcctgctcgccgcggccgtggcagtggccaacctgatggtcgcctcgatcggcgagcggtcgagcgaactggccctgctcaaggcgatcggtgcgaccgatggcgcggtatcgcgcctgatgatggcggagaccgcggcgatctcgcttctgggagccatcgtcggcgccgctttgggctcgggcgtggcgcagatcatcgggcaggtggtgttcggttcgggcatcaccatgcgcccgatggtgttcgtgctggtgttcgtgctgctggcgctgaccgtgctgctggcatcggcgtcgtcgattcgctcgattctgagcctcaagccggcggaggtgctgcatggacgctgatcgtaagacgatgatgaaggaggcgtgctgagatgaccaataccggtatgttcttcaggatgctgttgagtgcggtgttccgcaggcggtctcgcgcggtcatggccgtggtggcgtcgctggtcggcgccgctacgctgtcctgtctggcgatgatctgcatcgccgtgccgcagcagatgaatcaggagatgcgagcctatggcgccaacctgatcgtgacgccgctcgccgattcggagaacggcaagtccggcatcgatgacgcgatggtcgagcacaccacggagatggtgagcgccaagggctcggaaaagcacgccacgtaccgttacgagaacgtgcgcgtcaacgcggccccgtacgtgatggccggcgtcaaccccgcgcaggtcaggaacctcaaccatcattgggtcgtcgacggctcctggccgtccgcgggcaaggtgctggtcggccgggacgtcgccgatgcgatgggcttgaaggtcggcggcagcatcaccatcggctaccgcgcatcagacaacgccgcgtcctcgggacaggcgagccagcccggtactgacggcaccgatggcacggcgcagtccggcactggtggcacgtcagacggccagacctcgtccggctccaccggcgcccagcagacccagaacggccacgtctccagcgacatcatggacacgtccggtaccgagttccgtgtggccggcatcgttgacaccggcggcagcgaggattcgatcatctacgcgctggccggcgacgtggacaagctcaccggctccacgcgcggcgtggacgtcatcgaatactcgtcgggcgcctcggacctcaccgcgctggtcaacagcatcaacgatatgacgtcgatgcatgtcaaggcgcagcaggtcaccaagatcaccgcttccgacacgcgcgtcatcacgatgctgcagacgctgttctggatcgtgtcgctggttgtgctggtgttcacgctggtcggcgtcggcaccacgatcagctccatcgtctcgcagcggcgcaacgagatcggtctgcgcaaggcgctcggcgcgagctcgcatgccatcggcgtcgagttctatgtggaatcggcggtgtatggcctgctcggcggcctgcttggcacggcgacaggctatggcatggctcgctggctgtgcgccaccgtgtttgagcgttccatcggtttcaactggtggctcgccgtcgtgtcggtggtgttcagcgcgctggtcgccgttgtcgcatccatccccccggtgcatcgcgccacgcgcatcgaccccgcggtcgtgctgcgcgaggaatagttggaatagttaaggaataatcatggatatgctgcttgaactcgatcatatttccaagatctacggcgacctgcatgcggtcgatgatctgagcctgaccgttccgcagggcgaatggctggccatcgtcggctcgtcgggttccggcaagacgacgctgatgaacatgatcggctgcatggacacgccgagcaagggctccgtttcgctggagggccgcaagctggaggatctgaacgccggccagctcgccgacgtgcgcaagaacctgatcggcctggtgttccagaagttctatctggtgccgcacctgacggccgtcgagaacgtgatggtcgcgcagtactaccattcggtcgtcgacgagaagcaggcccttgaggcgttgaagaaggtcggtctgaaggaccgcgctcaccatctgccgagccagctgtccggcggcgagcagcagcgcgtgtgcgtcgcgcgtgcgctgatcaacaacccgaagctgattctcgccgatgagcccaccggcaacctggacgagaagaacgagaagatcgtcctcgacctgttccgccagctgcatgaccagggcaccacggtcatcgtggtcacccatgacgctctcgtggcgagttgcgcccagcgtgaaatcatgctcaaccacggcgtgctcgtgggcgagaagtggaatgataaaaatgcacatgatgcgtacgtagcggccggtggcaagcctgcgtccaccggttctgacgccgaaggtgcgcagcatggcgattcttccattgatttcattgatcctaccaaggcggcgaagacaggtggtgaccatgagtgacggcagcgctctgcagcatgacgggcttgcggacggcggttccccgtcgaaatcccgcacgctgaagagcgtgacggtggcggccgcgggactgatcgcggcgaccacgctgctggccggttgcggcgagcccaaggccgcgccgatgaacgacgagtatgccggcaattccggcgagaccgagaagtcgcaggagagcgagtcccagtcatcgagcggctccgacagctcctccaagcgcaagtccacgacctccgacaagaaggacaccggcaactacaaggacggcacctattcgatcaacggccagtacgggccggtcggagaggattccatcgacgtgcacctgaccatcgccgaccagaaggtcgagaaggtcgagatcgtggggcatccgttcacgacgatctccaagaaccaccagaatgacttcgccgaggcaatcaatggcgtggtcgatggcaagccgctcaaggacctaaaggtcgacaaggtggccggagccagctggacgtcggacgccttcaacaaggcgttgggagtcgcgcggcaggaggcctcgattcaataatcgcatgtcggttcgtatggcgcttgggtggcatggcatgtcgcccaagcgccattgtcgtataaggggtgccaggcgcgcacgatattacgattattatgtatgattgtacataacgttattcgaataaccgtgtgttgtgcgataaaatcatgatgtcatgggatgcggcgtctctgccggtgagttccggcagaccgggaagctgcccaccaaggaccagctgattgaggagtaccagaccacgaggtaccgcgtgcgcaatgccatcgcggtgctcgccgacacggtggcgatcggcgacagcgacaatgacctgaccatgatcgaggtggccggcatcggcatcgcgatgggcaacggggagcagtgcgccaaagacgccgccgattgggtcgccgatgcggtggacgcgagcggcctcgcgcacgccttcgagcggctgggcgtggtgtagcagccccagcccgcgcacggcacggctttccggcaaggagcgtaatccatctgactgtattacgatggaacatgattcgtacaccgacgtcggaggtatcgccgttatgacatccaagcagaacaactatctgcgcgagcgtgaaaaagccaatgcgcgctcgccattctccaaacgaacgccggaacgtgtgatcatgtgcgccggtgccgtgtattcggtcggcatggccatcttcttcgcgctgtcgtacttcggcgtgatttccagtacgtccgaggccgcccggacgtcggctcaggccgtgaccgcgctgagccgcaacagcagcaacacggcgctcatcatcctgtacgccatcgtgacggcgggagtcgccgcggtgaccatatatatggccgtgaagcacatgcagcccggtccgcggttcaaatggacggtcggctggatgatcttcgtgatggtcttctcgctgttcaccgctgacatggtggggctgatcgcgttcggcgtggccttcggcatgtacatgacacgcgattggcagctgctgcgtgccgtcaacgccgcgaacgccggcaaacgctcgtcgaagcgctgacgcatggcctctgacacgaccagtcagcgtcgcgacgggcaggagctcgccgcggacgtcgacgcactcgccaaccaggcggtactcgccgacgtcgaacaagaagcgaaaagccactccggcaaggatgccgcggacaggcggctgccgctgatcgcccgcatctacggcgtgctcgtgctgctgcagggcctcatcactctccccgtcatcgtgctgatggcgggatattcggtgcatgagattctcgacggccgtgtgaccgtcgacgtgctgaacctgacattcatcctcacatgcgcccagacggtggtctccagcgccaacgcggcatgcctgaccgtgctgggcgtgctgctgatccgcaaccgacggcggtattccgcctggtggtcgtatatcgtcatgatggtgacgttcgccgagggactgctgtcgctcgcattggacgggttgggcgcgaatctgctcgtgccgtccatccagatgaccatactggtcgcgctcgccataacccttgacccgactctgctggaggaacggcggctgcagcgcgcgctcaagcgcatggatgagcgcgacgaatacgaggcggcgctcgccaagggcatggtcggccgcgacatgagcggcaagggctatatctcgctggatttcttcaacctgttctggattttcgtcatcggctgcatgatcggactggtggtcgagacgatatatcattggtattactacggcgaatatcaggatcgcgctggcatgctgtgggggccgttctcgccgatctacgggttcggcgccggattcatgacgattctgctcaaccggctgtggcgctcgaactgggtgctgatcttcttctccagcgctctgatcggcggcgtgttcgagtactgctccagctggttcatggaggtcgcgttcggtatcaaggcctgggattacacgggcgaatggctgtcgataggcggtcgcacctccggcaagtacatggtgttctgggggattatgggacttgcctggatcaagttcgtgctgccgtacctgctgaagttcatcaacctgattccgtggaaggtgcggtattcgctgaccgccgtggtgttcgtgctgctgttcatcgacggcatgatgacattgatggcgttcgactgctggtacgggcgcatggcggggcatgcgctggattcgccaatcacgcagttcttcgccgaccatttcggcaacgatttcatggcgaaccggttccagaccatgtccatcgacccgtccagggcagggcgcatgtaggtcgtgggccgtacgcgggcggggctgtgccgagccgggccgtgccgggccggggcgggcggagtgcaagaccgcccgaagtcctacactggtgcaccggaagcgcctggagaaggcgcgggaagggtggcaatgtccagcaaactggtgtttctcgatatcgatggcacattggccgacgaacggcatgaagtgccgatctccgcgcaggaggcatgcaaggcagcccggtcgcgcggccacaagctgttcatctgcaccggacgctcgatgccgaagatcgaacgcggcattctcgatctcggattcgacggcgtgatctcggtggccggagcgcaggcggacgtcaacgggcgggtgctgttccggcatgacatcgcgcccgaggcgatcgacgccgcaaccgcgtatttcgaacggcacggcatcgagaactaccagtggcagggcgcggacggcatgtacatctcgcgcgggtatgcgcggcatcttgaatccaaggggtcggccgtgtggaggaacggtcagttcgcgcggtactggcatctgatcgacgacatcgcggtgccggatggttccacgctggggcatgtcatccatgcgagcaagggatcgtatttctccggagcggatcccgatgtgagttttgatgacgtatcgcgtgatttgggggagtggttcacgctggttcacggctcgtacgatgatatttcgcccaacaacggcgagttgctcatcaacggcgtcgacaagggcacggccctgtgcggtgtggcgaaggacctcggctacagcatcgtcgacacaatcgcgattggcgacagcgacaacgacgccgcgatgctcaaggccgcgggcacgtccgtggcgatgggcaacgccactcacggcatcgagtgtttctgcgacatgaccaccaccgacatccacgacgacggtatcgccaacgccttcgtcaccctaggcctgatctgattcagcgcgtcgcggggcgactgctgtcttgcctcccccccccgctggcgggctgagccgttaagcaaacagcggagctgtttgtaggcgaagtcgagctgacaggcgagcagcagaatggtcgtgcgcagcacatccgtagttgcagggcccggagggctgccgcgtagggactgtgccatcttttgccccccccgctggcgggggctgtcgcgtagcgactggggtggtcgtcagtcagcgcgcgcaagatgccgcctgcgcgcaacgccgcactggacattgtccggtgttcgcgtgtatcttggtaatgttgcccctttagctcaacggttagagcagcgtccttttaagtcgtgggttgtgggttcgaatcccacagggggcacggttaagtccttggagatcggcgtttccggggactttttgcttgccattgactttcgaccctagtaggggcctgatgggaggtgcttccttccgttgattcattgctcgtgttgaaatccaacattcggatatcatgaaaattaccaatacccgcctgaagccgtgactgctgctcttacatgtggcggatcttttcatctgcgatatcagagggcagtgtgacgatggcgtccattaccgtacatccagccacgcgctccggtgggccgtcagacagagcggagctgatccggtggctgtagcacatagagatggtcttgccgagcttcctcaatggctaaatgcggatgctccgttggacttgtcttttaccaagctatccacgattggttctgcgttgcagatgccgtttggtgcgttgatgcgttccgtggttcctgaagctcgtgaagacgatctgattagatatcggacgattaacaatcagggagtcgaagcgagccggaatcttcgagatacgattgttacttcaaggatttcatggctccgaacgtaggggatcgccatttccgtgtcttctgggtgccggccagtgtttttcaagtgatggtcggcggcgacgggaaaccgctcgctgatgtccttcatgacgaacgggctccgatggatgcactccatcgccgacccgaaacaacatgctcaaacgctcgacaatgtattaggagcatcagaacacaacggaagacaggccggggccgtaccggtcatggaaccggccccgcgcgtgggagcgagcccgacgattcatgggaacggccgtccgcccgtcgttcctgacggaccgccgagacgatatggggggtggcatccttcagaaatgcggcgtgtcggaaagaaggggcaaaggggagggggtgatgtcgtggctgccgtccgcggcaaaggaatcccggcttcgtacggcggggggggatggcgcgtcgggtggaagacgtccctcgtcgccgttccgcgttattctgccttccgcagtgagggaaccaagccgatccgtccggagggaggtgcgcatgccggcatcgtcgaagaccatcgtccgcggttggggagccgtcctgggcctggaggacgtccggaaggcttgcgacgcacgccgccgggcgtcgttcaggggaaggctgctgtccgtcgtgtccgtcgcgctcgtcgtatcggggttggtggtggtgtccgtgccggtcatgctgcagtcgtggtccgccggggaacagtccgccacgtctgatcgtctggaggagacggtcgcggactggccgtatcagcgggcggagaacgaattgaaggaggcgcgcgcgtacaaccgcaacctcgcctcgcacggacagtacgtcctcggcgaggccaacgacccgttcacgcagacgaagggttccgtctccgacaagagatacctctccatgcttgacgctggcgagggcgtcatggggtcggtcaccatcccgaagattggggtcgacctgcccatctaccacggcacatccgaatccacgctcgagctcggggcaggccacctgtacggcagcagcctacccgtcggaggcaagggcacgcacgcggtcatcaccgggcacaggggcttggtcaaggcattgatgttcaccaggctcgacgagctcaagaagggcgattccttctacatcaaggtgatgggcgagaccctgggctacaaggtcgaccgcgtcagcgtgatcgaaccgtccgacgtgtcgaaactcaggatcgtcgaggacgaggaccgtgtcaccctgatgacatgcacgccgtacggggtgaacacgcaccgtctgctcgtgtccggactgcgcgccgcgatcccggacgagatcccggacgagtcacaggtcatcgacccgcgtccggtccctctgtccgtggtggcggcctacgtgctcgcggcgttgtgcataccgctgttgttcacaagagattctgatccgcggcgtcatagttcgggcgtgaaatccgattccgtccttggaaggaagcactgatgagaatggcggaaaacggaaaaaccaccgggggggggataggttcctcctggccgtgatggtcgccctcgccatggtgctcgcgttgtcggtggccggcaccgcgagcggtgagggcatgccggccggcacgtcctcggcggagacagcggtgaagtccgccggcaagacgggcgagatcacgttccctgccggctcgtacatcgtcgacatgggcgacaccttttctgacgacgcccagctcaaaccatacggcctcatctacgatctcgtcctcaatgccaaggtcccggtgtactgggtcatcaacgggagcaagaccagccagaccggcgtggacctcacctacaacggcaagggctacatctccggcccgttcgtcatatccggcgacgacgtcgattacaacgtcaggtcgatgctgtccaagtggcgcggctacggcgtgtccatcgacgggcccaccgacaccgccgtcacggttgccgacagccggaagatctcctcggtcccccgcgtcgtgctcgacaatcagaacggcaagatagccaaaggctacctcgtcaagtccggcatcctgcggaacgagaataccaccgatgaccgcgtctacaaagaaaaagcgactccggcggacctggactcttcctgcgacgacatctacgtcatgccgcacgccgaaccgaccaccgcgacgcatagcccactcgcctccttcaacaagggcggcggctacatctgggccggatgccacgccgtctcctatctcgaaagcaataccaagggcaagggcgtggatgacggttccatgttcttcctgtccaccaacggcctgctcatcggagacaagcataaaaaagcgtcgggtgtaagcggcgcctaccgggtgacgggcgccgcgtcggacccgatcatgcagttcgtcgggaacacgttcgccgcgcacgccaacggagcggaagagatctacatgcccgcccccggcagcgcgtggcgcgccaccaccagggtgctggagaccgacccgaaccagcggcaagtcctcgccggtatgtctcccggtccggccgtgttcatggccgtgggtcccggatacggcgactacggcaacggcatggtcatgtacgaggccggacacgaattcaaaaaaacaccgacgccgaccgcaacgccatacgagcgttcctgaacttcctcatcctgtccggagtggagaaaagcctcgacgtgaaggccacgatcccgtccgacgccacggccggatcgaccgtgcaggcttccgtgaccgtcaccaaaggcacgccgccatacacgtaccagtggcaatccgactgcaacgcgtcgttctccgacccgaccggatcggccacttccatcacgttcccgaacgaaggcccatgccatgtgaaggtcacggtcaaagaccaatgcggccgcgccacgttcgacacccggctggtcgacgtcaagacccgcaagggaaccgtctcatggcgcaagaccgacaccgaaaacaatccgctggccggatcctcctggactctgaccggcccggacggccagtccaggaccatcacggacaacggcgacggcgacgaggaccggaccgacggatcgttcagggtgacaggcctcgacatgggcgcgtacacgctcaccgactcccaagccccgtccgggttccacaaggatgacagtagccacccgttcacgctcgacaacacgcatcccgactggacgttcaccagtggattcgtcaacagtccgacacccgccacggtcaccgtgaacggctccaaaaccctgaccggccgcgattcgaagaacggcgagacgttcaggttcacgttcatcccatccgaccaggccaccagacaggccgttagggacaagaccatcacggtatccaaaacacggtccgtcggcggtctgcgggacggcgtggccaaggccggcacgtatacgttttacgcggccgaggaccggacggactgcccgggcgaccttgcctgctcgaaggccggataccggatcaccatcacggccaccggcggcaccgcatccagcggcgccctcaccgtccatgcctccatcgcaaagaccaaggacgacgagagaaacacggccgacgtcaccggcatcgcgaaggcggcgttcacgatcacgcgggtcgcacagagcgcgctgccgttgacgggtgcgtccgaggcccggaacaacacgatgctcggcctgtccgtcatcgccgcagcgctcgtgctggccgtcctcggagcgaaacgctccagggcgtagcgacagatttcgcgcgccgcatgcacgccggcgcgcggcccgttcgaccgtccggccgaacggtctttcatgaaagaaggagagttccccatgaaactcactaagatcacggcgatggcggccgccatcgccaccgtcgcgggactgggggccgtcgcggcgtccagcgcgaacgcgcaggtcgtcacggacggtgagaagaccatcacgttgaacgccacgagcgcggaccaattgactggacacacgttcaaggtcgtgaaggtcgcgtcctacgacgtgtacggcaccgccccgaaccagagcgtcaccctcaagaccgaggacggcctcaagaaggatattgccgactacctgaagtatacgggcaccggcgatccgctcgcctgggcgcagcagcaggaccaggccaagctcgacaagtccaccacgagcccgtggctgggcgacggcaccacccgcggcctcgccgacaagctcgcgtccaaggccacgaccacggtcacgtcgaccctgtccaacgaaaacaagcaggccacgttcacgctggacagcccgggcctgtggctgatcgtcgaccaggtcgtgaccggcaagagcagcaaggccctgccgatcctcgccggcaccaagctgaccatcaacaacacggtgtactcctccggttccatcgacatgaagaaccagaccgcgtcggtcagcaagaccgtgaccgaccagaccgtcgcagccgggcaggatgcctcctacacgatcacgaccaaggttccgaactacgtgggctacaaggtcaacggttaccagttcaccgtgtccgataagttcgcgcacaacgcgccactgtcctacaagaccgacaccctgaaggtcacggtcgataacaagcagctgagggccggcaccgactacacggtcgccggcttcgacgccacgtccaagaccttcatcatcgacctgagcggctacatcaaggccaagggcttcaagggcacccccgtcgatgactccaagttcaccgacgccgacctggtcggcaagaacgtgaccgtcgaatacaaggccaccgtgaccggcagcaccggcaacaccggcgccgcgaacaccccgacgatcaagtatccgaacgatccgagcaacaacgagagcaagcaggaagtgccgggcaccccggtcaaggtcttcaacttcgactacaccctggtcaagaaggacaagaccaccggtgctgcgctcgagggcgccaagttcgccatcaagaatgccgccggcaagtacctcgcctacacccccgacaaggacggcaacggcaagtggagcaccctcgacaccaagccggaatccaccgccgacggcaccctctccggcgtgttcaccaccggcaagaacggccaggtgaccttcccggccctcgacgagggcaagtacaccatcgaggagatcgcagccccgaacggctacgtcaacgtgggtgtgttcttcagcttcacgatcgcggccaacctctccggcaccggcgcggaccagaccgcgaaaccgtcctacacgatcgacgccgatagcgtcagcagcgatcgttggggactggtctccgacggcagcaccgccgaagtggtcgtggagaacgtgaagagcatcacccagctgccgctcaccggcggcgcgggcaccgtgctgttcaccgtggttgcggccctcctgatcggcgccggcgtgaccgtcggcgtcaagtcccgcaaggcgagcgccatcgcctgaacggtctgacggatgcccccggcccttcgggtccttctccctcaaggggacgtccgtccgagaggccggcatcccatggaaaccgccatgggatgccggcctttgccgtatatggcgtctcatacggaaaggaacggcgatgagaagggagttcactcctgacgaacctcgtacctgcgcggcctgtgggccgtgtccaacgtcactccgacgcgcatcatctattccgacgagttcaaaagatacttcctccgcgaacacgggaaaggcaggggagtgaccgagatcttccgcaacgccggactgctggcgctgatcatcggcaggaaacgcatcgaacgctgcgccgcccggtgggtccggccggatcattgtcgtcaccaatgagcaagcaatacatcccatccccaacaacccgttgaagaaagagcctaagattcccgatgtggtcgaggcgatgggcgtgcgctccataaacctacgtgagttctatgacgctagcggcgatctcattcccctgccgtatcccattcggccgacactctgatcgtgtgctgtcggcgcggcgtagcggtcatcgtgatcatttgtcgcatcctttgctgttccattcgtgtgcgtcatcggcgtaaccatctcgcgtgtgtcgcccgggacattgagacagaacaaacgcaatggcttcctgagccgtggcttcaatggagggttttaatcgtgtgccggcgctgttgcggcagcgaggcgttccctctggcgcaatcgctgaaatgcctgtatgattgtccttatgtcggacaattcagagaatgccgctgtggggcatggcggcgagagagacatggctcgggatattgaagcgtcatcgatcgcgagtcatatcgatttgttcttcgatgaactgcatcgcattgacgtggcgtattcggattacgctcgccgagccggagtgtcggataatgtgatgtgcattctggactacctcaaggaccatgatggggcgtcgcagcgggcgatctgcgagtacacgctgttgccgcggcagacggtcaacaatgtcatcgcatcgtttgtggcgcatgggttcgtggagcttggggacgccgaaggcgatcgtcgggtcaaaacggtccgtttcacgcctgccgggcgcagatattgcaacagcttgatcgcgccgagtcgcgccgcggagtatcgggcgatgagcgagcttcctgacgagctgcgcagcgcgttgctcaagggcatgggcgtctacgggcgggtgttccgcaaacagatgcatgacatttccgtgtagtttttcccgtctcggacttcgccacgccgtatggctcaattgtcctacttcgggacaatactgagatatgagcgtagacgatttcgcgaggggaaggaagaagcatgcggctggttgcccgtttcatgaagccatactgggcgctgtgcgcggtgacgacggtgctgctgctggtcgacgtcgtcggcgcgctggtcattcccacattcgccgcggagctgctgaacgaaagcgcgacatccgcatcattcaagaagatgaccatcacggcggtcggcatgggcgtggccgcgctgatttccggcatgtgcgccgtggcgggcggatggtgctgctcgcagttgacctctcgcgtcggcaaggacatgcgcatggctctgtaccgcaaatccatggatctgtcgatctatgatttccgcaatttcggtacggcatcgataaccacgcgaacgatcaacgacgtggtcaacatccagatggccatgaccaatgtgctgtgcatgctgatgccggtgccgatcatattcatcatcgcgctgaccctgtcgttccggctcgacgtgaccctgtctctgtggctgctggtggcgatagccttcgtgtgcgtcgtggcgctgttcatcatgcgatccgcggcgccgttgttccgcaaactgcagaaactgcttgaccgcatcggcgccgtgctgctcgaaaaccttaccggcgtccgcgtgatccgcgccttcaacaaggaatcccatgagcggcggcgcatggacggcacgttcgtcgactacgccgatacgtccatcaaggcgaaccggctattcgcgaacctcgacggcctgtcgtacttcggcatgaacgcattcatcgtcgtcgtgtatttcctcgcgggaggacgcatcagcgccggaaacttccaaatcggcgacatcaccgccatcgtggagtatgcgatcatggcgctgttctatctgatgatggcgcagatggtgatcatcaccttgccgagggcgcttgaatgctgcgagcgtgtgcggctggtgctggatcacagtccgcagatcgccgacccggagccgggcgcggcggtggatatgagcggccgcggtccgctcccggacggcgaggtgctggcgttccgcgatgtgacattccgcttcgcggacgcgcaggaggacacgttgcgacatgtcagcttctcctgcaagacgggccagactacggcgatcatcggtggcacgggctcgggcaaatcgacgatcgccatgctcgcactgcggttccatgacgccaattggggagaagtcaccctcgatggcgtggacgtgcgcaagatgacgcagcacgatctgcggcgccgcgtttcctacgtacagcagcaggcgtggttgttctcggggacgattgccgacaatctgcggtacggagaccgagatgcctccgatgagcggctgaatcatgcgatcgatgtcgcgcaggcccgcgagttcgtcgattcgctgccgcaaggactggaatcccgcgtcgcgcaaggtggtacgaacttctccggtgggcagaagcagcgtctgtcgattgcgcgcgcactgaccggagacacccagctggtggtgttcgatgacagtttctcggcgctcgatttcaagaccgacgccgcgttgcgacatgcgctcgccgcagagacgaacgggcgtgcggtgctcatcatcgcgcagcgcgtgagcaccgtccagcatgccgaccagatcgtcgtgctgtcggacggacaagtggcaggcatcggcaaacatgacgaactgatggcggactgcgaggtgtaccgcgaaatcgtcgaatcgcagaccaaggagccggcaatgggagaggaggcgtgacgagaatgacaacgcagaatgacgatatgacggaaaccgttgtgaacgcgggcgacacggtaaagaccgacgacatcgagctcgaagcgccgaagaacgcgatggtcacagcccggcggctgttcgtgcagctgggcaatcagcgggtgcgcctgtgcgtggtcgccgcgtcgattctgctgttcacgtttttccatatcgccgctccgatgtacagcgccgtcgtggtggactcgatatgggatgccgtgcagggcgcatggcgtgacggcgttccattctcagtaagctggaacgccggcggtatcggctggacgatcctgattctggcaatcctgtatctcggcgagtggggcttctactacctgcagtcctatctgatggcgtccgtggccgaaaacctcaacctgacgctgcgcaagcagatcagcgcgaagatccagcggcttccgctgcgcttcttcgaccgcaataagccgggagaagtgctgagcaaggtcaccaacgatcttgaccgtatcagcgaagtcatgcagacggggttgctgcgactcatcactgccatcaccacggtgaccggctcgctggtcatcatggtctactactcgtggctgctcacggtcgtgttcctcgtgttcatggcattgagcatgtgggtaaccaaactggtcgcccgcaagaacctcgagatcgcgtcattgcgtcaggagaccatcggagagctgaccggcctggccgaggaatactacaagggccgcaacatcatcaaggcatacaatcgcgaggaagacagtgcggcagcgatggaggacgccgccgaacgcacccgaaaagccgcgcagctcgccgacttcatcacgatatccgtcaatcctctgatccgcatgatcgcgcggttctcgcagatggcggtgatgctgctcgccggttggatggtacttggcggccgcatgaccgtcggcgtggcgcaggcgttctaccaatacatcaaccaggtgtccgaaccgctgaccgaagccagctacatgatcaactcgctgcagtccgcgctcgcgtccgccgaacgcaccttcgagctgttggacgaggaagaggaacggcccgacccccagccagctgacgcggcgaagatcgctgaggagcctgtgcagggccgtgtggtgttcaaccacgtgaggttcggatacgatccgcaacggccgctgatgaaagacgtcaacttcgtggccgagccagggcagaaggtcgcaatcgtcgggtcaaccggcgcgggcaagaccacgctgatcaacctgctgatgcgattctacgagatcgatggcggcgcgataacgcttgacggcgtatccacagccgccatgacgcgaggcgatctgcgccgcgaattcggcatggtgctgcaggatacgtggctgttcggcggcaccgtggcggagaatctcgcctacgggcggcccgatgcgacccgcgaggagatcatcgcggcggccaaagccgtgcgcgccgactacttcatacgcacgctgccgcacggctacgataccgtactcgacaacgaggccgggaacctgtcggtcggacaacgccagctgctcaccatcgcccgcgtcttccttgcggacccgccgatcctgatactcgacgaggctaccagctccgtcgatacccggaccgaggcggaaatcggcaaagccatgacaagactgatggcaggacgcaccagcttcgtcatcgcgcaccggctgtcgacgatccgtgacgcggacctgattctgtatatggaacatggtgacatcatcgagcacggcaaccatcatgaactgttggaacgcggcggccgttacgccgcactgtacaacagccagttcgcgtgacacgtcaaggctcatcgacgggcgatcgtgccggcgatgagcctatgcctcgcggtcgagcggaggcaacttgtgcagggtccgcacgatgtcgcattggtcgcgcagcgtgccttcggcggcgcacatcgtcgggtaccacatgcgtttgcgcaatgtggaatccgccctcaacagcatgccgtcatcgctggcgtactgaaaatgcagatgactgagcaggccgccgctcgccagcgcagcccgttcgggcatcggatccatcgccaccagcacactgaacgggcagcctgccggcgcgtccgtcgcatgaaacacataacagggtttgccctccaaccccttggcgatggtccggtcaagccgataccggtagcggcccagtgaacgatccggtcccaccagccagtcgatgatgaatccgtcggcctcgccggccgccgtttcgacgccggcgctctcctgccgcggcgccccgtggcgaggcgccatcctccgaatccgcatcggcctgacgatatcggaacgagcaatcgcgcaaccgtatgatcacatcgctcatagtatgccgccgatgctcagtgccagcgggatcgtgcagaccgccatcgccgcccaatcaaaccaacgctgtgaatctccgttatgcaggtatgccggccgggccgtcccaatcccttggtaagtgccgcgaccgacaggtcatgcgagacgatcgtcgcgttcatcaacagcggaaccagcacgaactccagcgactgggccggatgccgcagcagcgcgagtcggccggaggcaagaccgcgaagggccatcgcgtcgcgggttcgccggtagtcccgcccgattgtcggaaagaaccggatgaccaccatgcaggggatggccaccgattcgggcacgcgcatacgacgcagcgcgcacacgaattcgctgacgcgcgtggtggagaacgcgtaggcaccggtgatgaaacagggcatcatcatgcgaagccccacggaaaacagcccgacgacatgtatccaggcgtcggcgtcagagccggaggctgacgcggcgcccgaagccccgccgtgtccagcgtcgccgcgtccgaccacaatccccaccccagcagaaccgcatagcaggccgtcagccgcagtcccatacgccagcgtccggcaaggaacagcggcgtgaggaacagtgccgtcagcagcgcttcggctcgcgcatccgcgtggaagaacaacagcgtgttggcgagcagcatcagatacagtttcgcccgagggccgaggacgacggccgctggcgcgggagcggacttggatctgctcatgccgtctgcgccggctgcatatgcgccggttcgccccgcatggctgctctcgaatgttgcccgtgaattcatgatgtgtcggtgtcgatgttcgcgaacaccacgtagctgatgaggatgccgatcttgctggagtatttgccggctttggcaatcagatcggcgaccagcgcgaagtacagcgcggagaacacgccgatgttgatcagatcggggatgtcagcttgccggagcggctctggcgtgcggtgccggcctcggcggggcttcccgcctgtgcggtcgggcgggcgcgccagacaaactgcgccgattgcgatgccttgcctagatgcgtgggccggggcgccacaatacgggttgaaatagccgaaatccgcaattccccgtgtcaaatcgccgttttgtggcccgaaaacggcgatttgacacggggaattatcaagaacggctatttcaacccgtgttttggtgaagtgcgacaccgcgatggaggggcgcggaaaaagagaaagcccggcggggaagccgggcttgagagagaagagaagaaggggttcagttattgcggccttgcggtcgtgattactatataaacgcatgtttcggggcaagtcatgtggtttacctgaaaaattcgtgtgaaaccctgcgtatttggctgagatgacataatatttggccttccgtagtattttttctgccgcagccgtcccgttgatgcgcgatggtgaggccggctcctacagtggtcggcatgtcatgcaccacattgcttatcggaaaatcagccagctgcagcggcgcgacgatcatcgcccgcaacgatgattccggctccggccgctacgatcccaagcggctcgtggccgtggcgccgacggaccagccgcgccactaccgcagcacgctcagccatgtcgagatcgacctgccggacgacccgtgccgctacaccatcgcgccgaacgtgctgccgaaccgaggcgtgctcgccgaggccggcgcaagcgagcgcaacgtggcgatgagcgccaccgaaaccatcgcggtgaacgagcgcgtgctcgccgccgacccgctggtcgagctcaggccagccgaaggcgtgccgggagaggccggctatcggccggagacccccggcggcatcggtgaggaggacatcatcacgctggtgctgccgtatgtctcttcggcccgcgagggtgtggaacggctcggcgagctgctggaacggtacggcacctatgagtcgaacggcgtgatcatttccgacgtggacgagatctggtatgtcgagacaatcggtgggcatcactggattgcgcgccgtgtgcccgacgactgctatgcgacgatccccaaccagctgggcatcgacgacttcgacttctccgacgcgttcggcgagcggcggttcttcatgtgcagcgcggacctgcgcgaattcatcgatcggcaccatctgggccgtgccatgcggcccgcgcagggcgccggtttcggcgtcgccgccgtgctgccggaccacaccaacccgcgtgtggtgttcggcaccagcaccgtcaaggaccatatctacaacacgccgcgcgcctggtacatgcaacgtcacctgaacccgagcgaggattgggattcgcccgcggcccgctacacgccgacctccgacgacatcccgtggtgccgggcgccggagaacaaggtgacggtcgaggacatcgactttctgatgtcgtcgcatttcgaaggcacgccttttgacccgtacggaacgctcggtacaccggaaagccggcatcgctaccgtccgatcggcatcaaccgcactggtcacatggtcgcgatcgaactgcggcacgacgtgccggccgcagcggcggcggtgatgtggatcgccttcggttccggcccgttcacggcggtcgcacctttttatgcgaacgtggacgacactccggcgtatctgcgcgacaccacgcccgaggtctccaccgacaacctgtactggacgaaccgtctgatcgccgtaattgccgacgcgcactggtacgagacgcgcaacgcgatcgaatactatggcgagcaggtgcgggcgttcgggcgccggcttgtcgaagaaacggatgcggtgctcgccgatgccgaagccggggacatccgcgcggcgctcatggctgcgaacgagacgatggccggtcgtctgcaggatctgacccataagctgctcgataacgtgctgtatacgtcgagcaacctgatgcgcaactcgttcgccatgtccgataggtgggtctgagggcttgctcccttgtcgcagcgaacggttctcaataagaaaggtgcgagtccgtgtgacgggggaaatgaacacgaaaacagcagaaagcccggaattccgggctttctgcgcaatgttcgcttgttcgaaaatgtgcggaatcctcgcacctttcttaatgagaaccgttcgctgctacctcatacgtctgcgcgtggaaatcacacgtcacggcggtgccgtcggcgaagaccgagcgctgcaccagcgggtcgccgccgacaaggtcatgccgcacgagctcctgcatgccgacgcgccggtgcagcccggccacgaccgcacaccgctcgatgtcattctcggtacgggcgcgcagtgcggcattcatatcaccgtccatgccggcatatgcggcgtcacggatcaggtacggcgcaccgccgttgagcagcgcgtacagcatgtagtcgtcgccaccggccacccgatccatcatccacggctggatcacgcagtcatggtagacgaggttgtacaacggcaccgggatgccgtgccgaggcgcgtcgggggagcgcatctggaagtcgtacggcgcgtaatggcagaacaccaggctcggcaccgcccagtcggacacctcctcagacgaggtgagaatgccgtgcgccagcaggtattcgaagcattcggcgcggcgctcgtagcatccgcggcgggtcatgcggtgctcgggatgcgagcattcgtcgccttcattgcaggtgaacacgtccagatacgcgcagtccagcgcgatgccgtgcgtggcgatctcactgaagttgcggcgcacgtaatccggcgcaagctcggcgcacaggtacgtttggcgcccgccggcccacatcgcgtgctcgggcatcgtgccgtccgccagtcggatcgcattgcgcgggtcgaacgtgcgcgcggcgaagtaatagtcgcggtattggtcatgcgtgccgaacaggtctccctgctcatgacaggcgtcgaccagcgatttcatgcccttccagccgccggcctcgcggcatgcgggcagatagtcgggatggccgttgtcgtagccgggctgcgcccagccgtccagatgcaggtacagccgcccggcacccatttcgtgcagcgtgcgcatctgccgctcgcgctgcgcgaacgtgacgagcgaatcattcttgccgggctgcgcgggatcatagaacgacgagtccggctgaaccttcgtcttgatgccgacatgcacccatgaacggccgagcaggtcacgcaccgacgggttgcgcgccgccttctccgccagcgtgcgcagccggccgcgttcgttgacgtaagcgcggtacgtcttgcagacggcggtatggtcggcgtggtcgaggagacgatatcgcacgacacgacggtaatccatgcggccgagacttggctcgaaccacattccgacgtgcgtgtacggtccgccggccggatggtcgatgtcatatcctgcgttccacggcgtctcgcagatggcgatgtacgcatgcccgtcgctgcgcaactgcgcgaaccagggcatgtacccgcccgcagtctcgaaccgcccgccgaaggagaccgtatcagtgccgacctcggtaggccagttattcggtatcatcacgccctgctcgtgggtgatgagcgtcacgtcatgcgcgtccgcacggtcgaaggacagcggcgcaggccaaagcaccctgtcgatgcgcggctcggccccacactcgcgcagtggcacccattcgcatagcacgtcgccgctcgaccgctcgatccagatatacgtctcaaaagcgtaatccgcacccgcgaacccggcgaacacgctgcgcacgccgactccggtgccggtctcgatccgctcatgcgtgacggtagcggcgccggcgaacgagaatgaacgatcctcgcgcgtcaactgcggctctatgccgtcgcagccgctccaggtcgcaccgtcgcggctgaatgagaaccgcagcgtcgtctcatcgaagcgcagcatggttccggacatggtgaattgcatcatggacgttctcctgatcggtgatagaggggcgaatatcagctggcagccccgccgcgcggcacgtcagttgaagccgacgaccttctctgcgacgacatagccgcgtcggatcatccagcgcccgacagacccacgcaggttcagcgcgcgcgacaccagcttgcgccgcacgtcacgcccgatggccggcgacgccttgtcgatgtccgcccacagttcgtccttgagacggtagtttgccttgtctttcgacaggatcaggaacaccgacgtgaccgagctttcgatcgcgaggaaatgaatcatataacggtataggccgtccggcacggttcccggttcgggagtggcctccaccatgcgctggttgacgagccgcagctgcgcgacgcggcggatcatcacgtcggtctgtacgctctgcccctcgcgcccgatgaagtagtggtagaacgggatgtccatgtacagcatcgacttgacccacgggaacggctggtatgcgtagatgaaatcgacgtagaacgtgtgctcgggcagctgcatgccggagtcgcgcaccacctgggtgcggtagatcagcgcgtgcatcagtatgtattcggcgacgccgaagcagccgagatcgtcccagccgagcacggtgttggccgccatcgcatgacggaagttcactgtgtgcttgacgcgcttgcccaccttgtcgtacacgtaattggtgacgatcatgtcgaccggatccgtggcgacgcgctgcacccgcagcgtgcccatgagcgtgtcgatggagggcatgtccacccagtcgtcggcgtccacgaccttgacatacatgccggtcgcgttggcgatgccggtgttgaccgcgccgccgtggcccttgttgacctggtggattgcccgcacgttgccgggccagcgccgctcgtacatgtcggcaagttccggggtgccgtccgaggatccgtcatcgacgatcaacacttcgatgtcgctgttgtccgtcgcggagagcagcgactccacgcagcgctccagatacgtttccatgttgtaggcgggcaccacgaaggtgagtgttttcgacgattgttccatagttcctcgttatacaggtgtcgcggggatgacgtgcgacacgtcgcctcggatgttgcagcgagtctaacctctacaagcaaagctatcactaagcggcgttcaggcaagtcccgtcgtccgttccgccgtttttggggcttccggcttgtgtgcggttctgatgatcagtcggcgctcgcgggcaggtatgccggttcgtccggttcggcggtctcgacaggagcgtccggctcgtccggggccgttgtctcgctccgctctttgtctcgacgttctttgtcttccttggctgcgagctgcttcgccttctggctctcgaaccgcaggatcggcttggaatccagccggctcaggccgtgccatgcgaggtcgacgacgtatgcggcgagctgctccttgttgaccttcggccggtccgcccaatattgaccggtgaatacggtcatgccgaccagcatctgcgcatagtatggcacgcccttggcggagagcttccggcgtttgaacgcggcggtgagcagatcctccacgcgcaggctgatgtcgcccagcagcgagttgaacgatccggccgggtcggtggtcggcgagtcgcgcacgagcacctggaagccttcggagttctcctcgatataggtgagcagggcgagtgccgcgcgctccacgatctggcgggggtgcgccttggtgtcggacagcgcctcgatgagcgcattggtcagctcgcgcatctcacggtcgacgattaccgcgtacagtccctccttgccgccgaaatgctcgtagacgatcggcttgctgaccttcgcgttcgcggcgatctcctcgacactcaccgcctcgaaccccttggatgcgaacaacgctcgccccacgcggatgagctgttcgcggcgttgcagcgccgtcattcttgcagtattggccatgagctccagtgtagtggtcgcggtgcctagcgcctataccccccgaaatgttgtcggggtctacgttttcgcggtaggtcgtgcggctgaggagagtcgatcatgaagacgtatgtggccccgtcgatgatggtgagcgagttcgacaaccatgacatcgtgtcgtgcgtgtcctgtttgatacgtgttttcggtggcggtcgcgagtattaccacgatgagggtggggcaccattgcccgacttgttctatgttgaatatcatgggaccgctggcaatccggtgccgtccggtatgccgctttatgcattggtggcagatttgcctataccagcgtcttccccggttcgatatgtagggacgactcaggggcagcgtctgtgccagcagcccaattagtcgtcgacttggctgcaacaacgcgacgtatgtggtattccggcagctgtccgttgcggtttttaggctggagccatggatacgaatctgattatcggcattgtcgccgcagtggtgattgtcgtcctgctcattgtgtggggcgtagtacgcggcaagtcgcgtaagaacgaagtcgtcggccggccggcggaaaccgcaacatcgccgcgccaggcgggtcgtgcgggtgaagaacccgagacggtcgccgcaacagttgacaggcagctttctgctcccgaaaccgagggcgaaaccgcctcccctcgaagtgagggagagcgtaagccggtcgaaccgacgcaggccgccccggccaagccggcggctcccgcatatgatgtaccggaaaaatccggctcgcgcattcagcggctcaaggcgaaactttccaagtcctcgaatccgttcggcaaggcgttgttcaacatcctcaccaaagacaacctctccgaatccgattgggaggacgtcgaggacacgctgctgctggccgacgtcggtgccgaagcaagcgagcagctagtcggcgaattgcgccgcgatgcgcgcatcaccggcaaggcaagccccgacgaggtgcgcgccacgctgcgcgacaacctgctcgacctggtaggccgcgacaccgaccgccgtctgaacgtcgacaagccggacgcgcacaagcccggcgtcatcatcatggtcggcgtcaacggcaccggcaagaccaccacggccggcaaactggcccgtctgttcgtctccgaagacaagaaggtcgtcatgggcgcggccgatacgttccgtgccgccgcagccgaccagcttgaaacctggggcgcccgcgtcaacgtgcccgtcgtgcgcagtgacaaggacggcgccgacccggcatcggtcgcgttcgaggcggcggcccgcgccaaggaggacgacgccgacgtgctcatcatcgacaccgccggccgcctgcagaataaatcgaacctgatggacgagctcggcaagattcgccgtgtcaccgaaaagaacctgcccgtcgacgaagtgctgctcgtgctcgacgccaccaccggccagaacggcatggcgcaggcgaaggtgttcgccgaggcgatcggcctcaccggcgtcgtgctctccaagctcgatggctctgccaagggcggcattgtcatctccgtgcagaaggagctcggcgtgccggtcaagctcgtcggcctcggcgaaggaccggacgatctcgcgcccttcgacccggaaggattcgtcgacggcattctcgcgtgaggttgttcgcaaaccgtcggacatgaaccctgcaagccggcagtccacaacgtggacagccggcttttgcattccggaaccgttgcctgcgccggaatccggccgaaagccaagacccgcgtcatccgctttacatgagcgtaacgtgccgtaacgtgttgaaaactcagcgagcgttgcatatcgttgtgttgattccccctatcaggggatgtcagatgaagtggtaacgacccgcttcccgcgcggtcaagatgcgcggcggcgggaacgaacaagagaggaaggtaacgatggactccggtaataccgcatggatgctcacatccgcagccttggttttcctcatgacgcctggcgtggcgttcttctatggcggtatggtgcgcgccaaagccgtgctgaacatgctgatgctgtcggcggcggccctgtcggtcaccgcggtcgtatggacgctgtggggctggtcgatcgcatacgccggcagcagcatcggcggcattttcggtgaccctgcgaccgggttcctgctgaaggacacgatggtgttcgacgccggcacccgtcagtacacggccgccggccttgccgcgaacggcaacaagtacccgagcagcgtggacgtgtcgttccaggtcacgttcgcgatgatcaccgtggcgctgatctgcggcgcgatcgccgagcgcgtgaagtacagcacgtggatgctgttcgtggcgctgtgggtcacgttcgactacgcgccgatggcgcacatggtgtggaataacggccttctgagcgcaaagggcccgatctccaccgcgatcggcgccgcggcgcatgatttcgcaggaggcacggtcgttcacatcaacgccgcaatggcggcccttatcatcgtgctgatcatcggcaagcgcaagggtttcggcacgcagccgattcgcccgcacaacgtgccgttcgtcatgctgggcgcgttcctgctgtggttcggctggttcggcttcaacgccggctcggcgttcgcggccaatggcaccgctggctatgcgtggatgagcacgaccgcggcgaccgcggctgccatgctcgcctggggcttcactgagaagatccgcaccggtcattacacggctatcggcgcggcctcgggtatcgtcgccggtctggttgccatcacccccgcggccgatgtggtgtcaccgttgtgggccatggtcatcggcgcgatcgccggcgttctgtgctgcttcgcatgcggcctgaagttcaagctcggctatgacgattcgctcgacgtggtgggcgtgcatggtgtcggcggtttgaccggtaccgtgctcatcggcttcttcggcgagggcactggtctgctcgccggcggcgactggcgccagctggccgtgcaggtcatcatcgccctgtgcgcgatgctgtactccggcgtggtgaccgcgattatcgcgttcgcgctggagaagaccatcggctggcgtgtgaccgaagcccaggaggtcggcggcatcgatctggccgatcagggcgaacgtgcctatgattttgctggtactgccagctcggttctcaaggaggtgaggtgagatgaagctcatcactgccatcattcagccccataagctcgatgacgtcaaggaggcgctcgccgctgcgggcgtgcacggtctgacggtctcggaagccaacggttacggccgccagcgtggccacaccgaggtgtaccgcggggcggaatacacggtcgatctgattccgaagattcgcgtcgaggtgctgtccgatgacgcggacgcggagaccctggtcggcgtgatcgtcaagtctgccggttccggcacgatcggcgacggcaaggtgtgggtcgccccgctcgattccgtgacccgcgtgcgtaccggcgagaccggctccgccgcgatctgaaagcggcccgtggttcggcgctttccgccggacgcgggttatcggtaagacaagtccccgcacgccgtcacctgaccatgcggggactctttatatatatcgacatccttgcctccggtggcggagggcaaggattgaaattgctcccgctggcgggagctggctcgcgtagcgagactgagggtggtcttgtgcacccgggtgggtttgaccacctcccgtcgactccaccgacagcccccgcctgcggggcggaatttggtgaaggtggtgtgtcttgagttcggcggtcgatcatctcaagcaacggttcatggacatgagccagccggatgctgacggcgtgtaccggggtggctccgcgaagcgccgggcgcgaacggagctcgccatggattgcctgcgccgcctgtggagtgacgcggtggccgcggtgccgttcgacgtgccgtccaccggcatcggattcggcgcggtcgggtcgctcgcacgggggcagattggcccgagctccgacctggatctggtcatcatctatgagccacatacgatcaacgaccaacagctcaatgagctgaccaacaaactgtggtatcccctgtgggacagcggccttgacctcgatcagtcggtgcgcacgcggcagcagtgcgaggccgtgaccgattccgatctgccggccgctatgggctggctggatgtcaagccgatcgccggcgatacggcgctgatttcggcgacggccacgtcgattctggaacgctggcgtcgagcggtccgcaagcggctgccggaactgctgaattcggcgcgcaagcgactggacgagttcggacgactcgcctacctgaaccagcccgacatcaaggaggcgcgaggcggtctgcgcgattcggtgctggtctccgcgttgactgtgtcatggcttgccgaccgaccgcacggccggtatgacgacgaggtcgaggcgttgctggacgtgcgcgattgcattcatctggctgccggcaaggacgcgaatcggctgctcgccccatatcaggcgcaggtggcggcgatgcggggtcttgccgacccgacactgccgccgggggagcgggaggcgcgttccatcgaggacttgcagacccggctcgcccgcataggccgacagatcgcgttcgcgctggattccacggcgtcgcgtgccgagcattcgctgacgcatgagcgcccgcgtttctcgttcttccagatgctgtcgccgcgcggtggaggcaggcgagaggccccgaagttcgaacaggtcgcgcccggcgtggccaagcacgagcaggaaatcgtgctggctccgggcgtggaaccggagccggaccggtatctgccgttgcgcgtggccgcggcggctgccgagttcgagctgccgatcagcccggtcaccttgcagaacctgcggcgctgcccgatccgcgattccgtgtgggatgatgagtcgcgccaactgttcgtgcgtctgctggcctccgggccggcgctcatgcgcgtgtgggaggaactggatttcgtggatatacccggtcgatggatgcctgaatggctgggcatacgcaatcgcccgagcgcgtctgcagcgcaccggtataccatcgaccggcacagcgtcgaggtgacgtcacggctcgcgcgggtttcggcggcgcgaggcgagcggtatgacgaccgtcactacacggcgctgctattggccggactgctgcatgatgtcggcaaacgtccgttcgtgaccgatcacgcggcagagggcgcccgtcacgccgcggtgatcatgaagcgcatgggattcgacgcggacatcgcgcgatgggtgcgcatcctggtgcgggagcatctgacgctctctgagttcgcgaccggcaagaacccgaacgatccggccgtgggggagtcgctcgcccgttgcgtggaccgtgatccgatgctgctggacatgctgtatgacctgacccgcgccgacgggtcgtcgctcggggctacggccggtgaggagatatccaagcgatacgggtggagccattggcgcgaaagtctggtgcgtgccatgtacagcgccgcccgtgagagtatccgggtacaggttgaaggtggctatgccgacgttgacttcggttgacacgggattgcccgccgcgtcgagggcgcgtaccacgaccaggtcctgcggcatgtattcctgaccgccgaccacataggtgtcgttgccctctcgcacccagctttcgaacccgcgaccggtcaggcgcgcgctgaactgcttggcggccttctcccgcacgtcgatcatgctttgcttatctgtgagtattcggatgtcatctgattcggggcggaatctccttccgcgtggcgtctcccatcttcgggagccgatgccattatcatatgatgctcagctgaggcaaaggtgatgtcaaggtgggtgttccgcagtgcagcgagggctgtcgcgggccggtcgttagagggcggtctgaccgagccatgattcgccgcgtatgcgcaggccattgaacaggccgcggccgcccatgagcacgatattgaacatcgcccatagcagcactgtcgaggccaggtcgccgggcagcatgggcgcggccgcatccacgcagatcgcggtcaatgcgatatacaccgttgcggtcagtgtgcaggtaatcgccaggtagcggaaatcgcgggcgccgatcagtatgccgtccagcgccatcatccacccctgtagtggcaggaacgcacccatcgtcaccatgccggcggcgaccagcaactggacgtgcgggttgggcgagaacaggcggccgacgaacaggccggccacggcgaatccgcagccgatagcggctccggccgccaatccggctcgtcccgtggcccgggtcagtcgcagtgtgcgtgcgcggtctcctgcgcccatcgccgcgcccaccagggtctgaccggcgatgcctaccgaatccagcatattcatcgcgaaattccaagacgagttcaccgcctggaaccccgccagcactgtcgttcccaatcgggccgccgaggcgaccgtcatcaccatcgcggcgcgaatggcgagtgtgcggatgaatagcggcaggccatcccctccggcggcggcgatgcccgacaggcgtggtcgcagcgcagcgccgtcggccttcgcccatagcaccgccggaaccgtcaggaacagtcccatgaaccattgtgcgatcatcgtcgccgcgcccgatccggcgatgccccagccgaatccgaacacgaacagcacatccagcatggtgttgagcacggcaccgcacaccgcggccaccaacgtgatgcgtaccttctgcaaaccgcggaaaatgccgttcgccgcgtacacgagcagcatgccaggggcgccgagtaccaccgcctgcgtgtacgccaccgcctggtcgagcgtctcgcccgtgcccctgagcgccacgcacagcggccgggcccctgcgaacagagccgccgccagcacgatgccgatgccgagagccagccatagtccgtctatgccggcctgcagcccctctcggcggcggcccgcaccaagcaggtgagccacctgcgcggtggtggagtaggcgaggaagatgcacagtcccaccgcggtgaggatgatggtcgatccgattgacagtccggccagggcggagacgccgatgtgcccgacgatggccgtgtcgatgagcacgaaggtcggctcggcgatgagctggccgaatgtggggagggccagcgcgagtatgcggccgtatgcggctcggttaccggtgcgggccgtgccggcggtcgcaggatcggatgattgtgggtcaggggtgtgcacatgcacactgtagctcatatgggcgggcgcgtatgcggcatcgaagagctgaaagcgcggcggtgagccgaatggggcgccgcttatatcgcatgacgacgtgtttggcaaatcgagtgggggcgtttatggacttatccccatgttatgcacagagttatccccctgatgtggataactgcatatgttatccccagagttatcccctaaatgtggataactcaacttttttgtccacatgacgtcacccgtgcgtgtcgcgcaggtaaacgccggctgaatatgacttgcgagcaagccgtgcgtgacggtgacgaatgtcgcgtccgcttaccgcgacatgccgtccgagagatggccctgtgcatttttcgccagatatcttccaccggaaaagctccgatatatactcaagtcttatggcagcagaagaaacgaattggggagggccgcgcccgcaatcaggtggctcgtatgtgcagggcgacgcggggtcgccgggacgcgacgccgtgttcgaccgcgtgcctccgcacgacgacgaggcggagatggcggtgctcggcggcatgctgctgagcaaggacgccatcggcgaggtcagccagatgatcgacgtcaccgacttctaccagccgaagcaccagacgatatacgaggcgatcatcgacctgttctcgaactcgcagaacgtcgatgtggtgatcgtcgccaaccagctgatgaaggacggaaacctcgacaaagtgggcggcgccgactatctgcacacgctcgtcgcgttcgtgccgactgccgcaaacgccacgtactatgccgagatcgtgcatcagcgggcgatattgcgcaacgtgatcgcggccggcaccaagatcgcgcagctcggctactcggcggagggctcgcaggccgaagacgtggtgaacctcgcgcaggccgaggtctacgagatgagtaccggacgcgtcaagcaggactacgaggccatcggcccggtggtgcacgatgcgctcgaacagctcgacaagctgcagaacggcgacctgaaaaccggcgtgccgacgggtttccgcgatatcgacgacgtgacccagggtctgcagcccggccagatggtggtcgtggcagggcgccccgccatgggcaagtcgacgctgggcatcgatttcgcccgtgcggccgcgctgcatcacaatatgacgtcgatcgtgttctcgctggagatgagcaaggtggagcttgcgcagcgcatcatctccgccgagaccaacattccgctcgcggcgatgcgccgcgccgacgacatcaccgccgaccggtggaacacgctcaacaatttctggaacaagttgcagaacgcgccgctgttcatcgatgattcgccgaacatgtcgctgatggagatccgtgcgaaatgccgccgtctcaagcagaccaacgacctcaagctcgtcgttatcgactacctgcagctgatgtcatccggcaagcaggtggaaagccgacagcaggaggtctcggagttctcgcgagcgctgaagctgctcgccaaggagctggaagtgccggtcgtggcgttgtcccagctgaaccgtgggcccgagatgcgcaacgacaagaagccgcagctgtccgacctgcgcgaatccggctcgatcgagcaggacgccgacgtggtgttgctggttcatcgaccggatttctacgacaaggaggaccggcccggcgaggcggatatcatcatggcgaagcatcgtaacggtccgacggagacgttccatctggcgtttctgggcgcatactcgaagttcaaggacatgccgcaggactacaacagcgatcaaggagtgtgacgatgggtgaggaaaacggatcccagcctcgtgaaacatcgcgtgaaacacggcgcgaggcgctgggcgggcagtcggatgcggcgcgtccatggaccgcgttcgctacgccgctgatcggcaaagccgtacgcggcgcctctcggctgctgcggcacggcggcagcgcgttccctggcaagatcgtcgaacagatcgaccctggtttcctcgcccgcacgctcgccgacctgccgtatggcgtggtgctggtgtcgggcacgaacggcaagaccaccacgacgcgcatggtcgcctcgatgctggagacgctgggactcaaggtgttcaccaatccgaccggctccaacttcacgcgcggcgtcgtctcggcgctgctgaccgaagtgccgttgagcggcaggctggacgccgacgtggccgtgcttgagcttgacgaggcgtatgcggtgaaattcgtgcagcaggtgaagccgcggttcgcgctgttgctcaacgtgatgcgcgatcagctcgaccggttcggcgagatcgacaacaccgcgcgtctgctggagcgtgtcgccgaagcgacgacgggcaccgtggtgctcaaccgtgaggatccgcgaatcgcgcgtttcgcttcggccgtgccggaaggcaccggagtgcgctatttcgggctggcgcccgaactgcgtcggttcttcccctccgacgacgacatgcagaccaccgtcgccgaagaggccgcgagcgtggccggcaatggcaggccgtcggcaaatgaccgcgcgcagcaggagccggcaggcacatcggtttcggctgaggcccccgatgccgatgggcgcgaggcgacggctgatgtcacgctgacccgtgtcggcaaccatgaggccgatttcctgattgacgggcgggccgtccataccgccgtcaagctggaaggcgtgtacaacctgttcaacgcggcggcggcgctcgccaccgtccgcgcggtcatggcgcaggatattgcttcggcgcaggtcgccgagaccgtccccgccgaaaccatgcccggccaggcctcgcatgcgtcagacgcggcgatatctgacgagagcccagtagacagcccagtagaccatgaccggcttctggcggcgctcgccgaggtgacccccgcgttcggccgcggcgaaacgattgcggtcaacggcagcgacgtgcagctgctgctcgtcaagaacccgatgggcttcaggctgtcgctcggctcgttcccgcccgacgggcatgacacgatgattgccatctgcgacctgtacgcggacgggcgcgacatgagctggctgtgggatgtcgatttcaccagcctgcgcccgactggcgtcgcgatggtgtcgggtacgcgagcctgggacatggcgttgcggctcgaatacgatcaggtcagggtggagcagaccggcacggatctggaggcggcggtgcggcagttcgtcaccgcccgtcccggtgtgcccaaacacatctactgcacgtacacgtcgatgctccgcgtgcgtgccgaactcgccaagctgaccaccgtcgccgatgccggcgtcgggcgatgaacggcgcggcgactgacagcatgagcgggaaaggtgaacggatatgggaaaagtgatcgacgtgatgtccctctacccgaaggacatgaacatctacggggattccggcaacgtgctggtggttctgcgccggctggcactgtacgggtatgagccgcgcctgcacgcatacaatcagggcgacgaatggcccgagcgcgtggacatgatcctcggtggcggcggtcaggacaccgggcagaagaaaatcaccggcgacctgttcaagcgggccggccggctgcgcgacctggccgcggacggtacgccgatgctgatgatctgcggcctgttccagctgttcggcgaatacttcgagacctcggaaggcgagcggttggacggcatcaacgtgctcggcgcgtacacggtggggcagagccaccggatgatcggcaatctggtcgagcacagcgacgaattcggcgacgtgatcggctatgagaaccattccgggcagacgttcctgcgcgagggaacgttgccgctggggcatgtcgatcatgatggtaccggcaacaacggcgaggatcatacggaaggcgctcgtgtcggcaatgtcatcggcacgtacatgcatggctcgctgttgccgaagaaccccgcggtcgcggatttcctgattcgggccgcagtgacgagacggtacggggagttcgagccggaccagtccagcgagcagatgttcgaactggcacggttggacgctctggcggacaaggcccgcaaggtcgccgccgcccgcccccggtgaattggacggttccgtgccctcggactctgcgatgcttgacgggtcgatgagcttgatgggccgatgagcggattgccggggcgtggtttccatctcatagcggaaaccacgccacccctatcgcgttatgcgacgggtgggggtaatcttggaaccacaagtaaccaaaggaggtatcatggctgatttcgatttgggtgaaggcctgcgccgggtgtttctcgcgggcgttggggcattggccaccggcgttgagctggggcagcagagctttgagaagagccagcagatcgtcgacggtctggtgaagaagggcgagctcaccgtggaacagggcaaggcgttgaacaccgagctcaagcacaaggcgcaggaggccaaggagaaggccgaggaaaagactgagggcgccaaggagcagagcgatgccggtgccgccgccgaagatccttccccggcggaaggctccgctgcttagcatgccggagcagcacaccatgccgtcctataccgcgggcggccatgccggcgacccacggcatgatccggaacgggggaaatccgcatcggggtcggacggttcggcgaaagacggtgtcgtgacgcgacgtgccggcaaacgccgcgaatgggacgggtctcccaccatcgggctgttcaacaatcatcgcgacaccttctccagccgatatcacctgacgaggcgcgggaaagtcaagcgcctcggacagatcatgcgcattgcgaaccagttcgacgtggtgcacggcctcactccggtgaagatgaggctgatgctggaggcactgggccccacattcgtcaaggtcgggcagatactgtccatgcggtcggagattctgccgcagtcgttctgcgacgagctcgcgaagctgcgcgccgatgccgacccgatgccgtatcagatcgtcgtcgacacgttgacgcaggaatatggccgccccataggcgaggtgttcgcccgcatcgatccgacgccgctcggttccgcatccctcgcgcaagtgcatcgcgccacgctggtcaccggcgaagacgtcgccgtgaaggtgcagcggcctggcgtgcgcgagatcatggcgttggatgtgtccatcatgcgttcgatcgcccggactgccacgaagatgctgcccagtgcgcaggtggtggatcttggcggcgtggtcgaggaactgtgggatacgttcgaatccgagacggattttctggtggaggcgcgtaacctcagcgagttcaagcgcttctgcgaagcctatcggtatatggactgcccgaaaccgtacatggatctgtgcaccgagcacgtggtcgtcatggattacgtcgagggcatcgccgtctcccataccgatcagctgatcgaagccgggtatgacctcaaggaaatcggcaccaagctggtcgacaactatgcgacgcaggtgctggacgacggtttcttccatgcggatccgcaccccggcaacatcatcatctccggtggccagatcgtgcttatcgatctgggcatgaccgggcggctcaacagccaggcccgcagcgtgctccgggagatgatcttcgccgtcgccaaacaggattccgccgcgctggcggacggtctgctgcgtttcgcgggcaccgagtccaatcctgaggattaccccgcgctgctggccgacctggacatggtcgtcaaggagttcggcacggtagacctgggcgacctggacatagcggcgttcctgacgtcgctgacgtcgttggcccaaaggcatggcatcgaggtgccgggcacggtgacgacggtcggcagggcgttggtcacgttggagggcctgctggatgaattcatccccgacgtgaacatgattcagatcatctccgaccatattgccggcagcaagtcgttggatcgagcggcgaaagacgagatcaaggcgctgggcgtcgagggacatcaggcattgcacggcctgctgtccgcggcgagcgagtccagggtcgcgatgcgcatgctcacccgaggccagctgcgcatgaacatggaggtcgttggttccgaggaaccgatgcgcctgctgtcggacatggtcaaccgtctgacgatggcgttgatcgtcgtcggcctgttcgtcggatcgtcgatcgtgtactacgcgggcatgaagccgatcatcttcggcataccggtcgtgggattcatgggatatgtgatagcgttcatcctctccgcatggatcgtgttcgacatctacttcaagggacgcagatcaaagcgccggtagtactcgacggaatgatttgcgccccacggtccggtcggtcttcaggccgggcagttttacgggccggtcagttttccaggaacagctgcggtgccttcatgaagttgttggcgcagtgttccccgcagaagtaataggtcgtgccgtcgtgctcgcgcgtgatggcgtcgttgttgacggcgacggtcatgccgcacacagggtcggtcgcggtctgcgtcgcgtcgttcatgtctgcggaatgcatgtggttcatgtgcatgggttgctccttgttcggctgatggtgatggccctcatcggtgtgatggccatcggcacggggacggtctccggtgtcgagaatgatgttgcgcgcgccgtgttggtcgggtgctctcctgtcggcgtctcttccgcctgcggcggtgaaggagacggtgtcggggctcagtgtgacgcgccgcatgcggttcgcgttcagcaccaggcagacggagctgagcgccatcgccaggcctgcgatcatcgggctgagcagccagccggtgaaggggtacagcacgccggcggcgatggggatgccgatgatgttgtagccgaaggcccaggcgagattctcccggatgttgcgcatcgtggcttgggataggttgagggttttcaccacgcctcgcaggtcgccgctcatgagggtcacgtcggcggattgcatggcgatgtcggttccggtgccgatggctatgcccacgtctgcctgcgccaaggcgggggcgtcgttgatgccgtcgcccaccatggccaccagtccattggggacgtcggcgatggcgggggccaccgacgactgtgccgcggcggcgtcgcgcgatatctgcagctgccttatccagtaggccttgccgtcgggcctgacctgagcgatcaccgtgtcgatgccgacttccgcggcgacgcgttcggcgacctccgccttgtctcccgacagcatcaccgtgcggataccagcggctcgaagcgctgctatcgcctccttggaacccggcttgacgctgtccttcgtatagctcggcttggcgtagtcggcgtcgtcatcgatggctccgacggtgatcgtcccggtcttgtcgaacacgacggttcggatgtcgcgggcctgctccaaggccctggcggatgtgaccagcacgccattcgtggcgccgaggccggtcgccgcggtcaccgatagcggcgtggccagtccgagcgcgcaaggacacgcgatgatcaatacgctgaccgccgtcaccagcgcatgggctagtttgggttgcggcccgaacgttatccatatggcaccggtccacaatgcggcgataatcaccgcggggacgaacacgcgggcgatcctgtcggccagacgctgcacgggcgctttggtcgcctgtgcgcgtgcgaccaaagcgatgatctgggagagcaccgtgtcctcgccggtgcgtgtgaccttcatgaccacattgccctgctgcatgatggtcgcccccgtcaggggctctccgacgccacgccgggccagaacggattcgccggtgatcatggactcgtcgacgctggcctcgccggccaacacgacgccgtccagcggtatgcgctcgccggcgcggatcaccagcagatcgccggtcttcacgcggtcgatgtcgatgtcttgggattgggcagggtcgagccatccgtcgccggatgccttgccggcggccagatccttggccagtggcgttccgacatcgaggatgtgggcgacacgtgggcgcagcttgatcagtgattgcacggcctttccggtgccctcacgggctttcgcctccaacaggcgtccgaccagaacgagcgtgatcactacgccgaccgactcgaagtagggctctctcgacccctcgggcatcagctccgagacgaagcacaaggcaatgctgtacaggtatgcggcggtggtccccaatgccaccaacgagttcatatccggagaacgatgccacagtgccggccatccgacgcggtggatcggcgccccgcagtagaacatgaccggggtgatgagtatggcctgcagccaagggttcatcagccatgaaggaacgagcgagtgactgacgagcatgagcatcatggggacgaacaccgggagcgtgagaacggtgccgatggccaccagcatgccggtatggcgaatctcctgacggcgttcctccgcctcctgccgctcggccagcagcgcatccgcggcggacatcctgggcgtgccggccggtatggcggtcccggtcgatgcagtgccgtcgtccggttttgtggcggagtccgtctccccctcgacgcgaagcaacccatgcaccatgttcatgccgcatgcaaaggggtagtcgccggccggcagcggcggaagcgacatctcggtggtctcgttgcccggcagcatcgtgtccgttccgagatcggggaacacgacatgcgacgtgcattcgccggtctccttccgatcgaacctcagcgtgatcggaatgccggcttgcatcgtgacgatatcgggggagtacccacccctgaccgtgatggtcgcctgttgaacgccgtcatgcagcgtcgcccgggcgcctccccttctgggcgcgaagaagaatcgcaggatgcaccatgtcagcacggcggctatcaccagtgccgccacaccgaggaagatgtcgaattccatcgccgctcctttcccctctctatcataatctcggatattaactataccctatacccctagagggtatataatgcgtgttgtcaggaatattcgcgctgggcggaaggctggttatgcagggttacgacggagacaaggcgaagatcctcgcgcggctgcggcgtgtcgaggggcaggtccatgcggtcgcgcagatggtggaggatgatgtatattgcatcgatgtgctgacccagatctccgccgcgacttcggcattgaaggccgtgtcggtgatgctggttgacgaccatctgaaccattgcgtgcggcaggcggcggccgagggcggcgaggtggccgacgaaaaactgtcggaggtcgagaaggtgatttcccgactggttcgctcataagtgcggcactcgctcgtccgcgggatgatgtgtaataatacacatgttcgatgaagtgcttgatgtggtgatcgttgcggtggtggcgttgttgggtctggccgccggattcgcgctgggcaaaatgcgtggccaagcctccgcccgcatggcgaaggcctccgaggtggacgcgctgaggggatcctgcgaggccatgaaggacgacaatgcgcggcttgccgcccaagtggctcaggccaaggcccagtccgagggacttctgcagcaattgtcgttcgcgaagtcccagcttgctcaggcgcagcaggcggaacaggtgcgggtgcaacgtgagcgcgagcgggccgaggtcgatgggctgcggcgccgggaagagcaggaaaaagcactgacagagcagggcaaggtgctgtcggcgttggctcctttgcagaagaatctcgatgagctgcagcagaaggtctcgaacatcgaggaggggcgcaaacacgagatgggcgtgctgggtgagcagctcaaagggctgggtgagcagcaggcgaggctcgaccgtgagacgagctcgctctcggcggcattgcgcaacaacaaggtccgcggcgcttggggagaggcgcaactgcgcaacattgtggagtccgccggtttgctggagcacgtcgacttcgatacgcaggtggtgatgaccggcgtcgacggtaagacgctccggcctgacatgatcgtccatctgccgggaggcaagacgattcccatcgacgcgaaggtgccgtatgccgattatcagcgggcctgcatgattccggaaaccgcggggcctgaggatctggaacggcgtgacgagctgctgcggtcgcatgcgaaagctttgcgtgaacacgtcagggcattgggtgataaggcgtattggagtgcatgcgacacggcccctgatttcgtgatcgcgttcattcccaacgaggcgttgctgcaggctgcaatggaggccgatccgacattgatggatgacgccttcgcccgcaaggtcgcattgacctcgccggtcaccctgtgggccgtgctgaaatccgtcgcatacgcttggcagcagcagagcctcaccgatgacgccaagaccctgttcgacctgtcgagggaactgtacgagcgtttcgccgtactgggggagcgtgcgaacaaactcggtaccgcgctcacccgcaccgtgacggcgtacaaccaattcgcatcatcgttggaatcccgcgtgctggtcaccgcgcgcaaactgcagaagctcgatcaggccacggtcatcgggtcggtgaacatcatcgatccggacaaatccgatgtccgtgaaatcaccgccccggaaaccacctccgaataaaaccaacgcaagagcatccaaaggaataccagcatgactcggcccccgccagcgaggcaaatacgcaaccgcgcggatatgcatggccattgccggcggtgacttgacggcacgcaacgatatcctgagaaccatgaatgaagagcaaggattccgcaagaccgggacgaccggaaccgctgtgggtacgaacaacattccttccgacgcatcgccgagtcagacggatgacttctccatgctggagccgcgcgaacagctccgacggctgattgccgcggaaatggaaggcaagccgttctgcgagctcgccggcgtcaccttcgaccatcgcggggcggctatcgtcggtcacattcttctggacgcgcttgaggagaacggctattccatcgatgatttcgacgccgtcggtgcgttgaccgccgcggccgttccactggtcggcgcgatgattcaggcggcggcatcgcgcggtgaagacctcgacggattcgtcatggacttcgtatacccgtccatcaaaggcccgtccatcaagggcaagcgcgtggtattgctggattcatggctctcggagaaatcctatgtgcagacctcgtcgctagtgacgctgcgcaacggcaatgagctgagcctcgatttcggcgtggtggagcatgaaggcgcgaaagtggttgccatcgcatcgctgatcggcggcgtcgacatgaccgaacccgtcatcgaggtcgtcaaccccgtgagcggtgaacggcaggagctgccattcatcgaaatctaccacgaatccgaactgcgatagccatgcacaagcccaaccccatctctctggcggcaaaggcttcgggggagccggaatttcgtgaagtcggcgtaggaccatggacgcaggagcaccccggtgagccacgcccggatgaccctaaatcgccgaactacgatcgacgctacgatacgacgctgctggatgaaggcgatcgtcgcaacgtgctcgaccgttaccggtactggaccgtgaacgccattcgcgacgatctggacgcggccggtcgccacggcttcgaagtcgccatcgaaaactggacgcacgatttcaacatcggttccatggtgcgcacggcgaatgcgttcaccgcgaatcgcgtgcacatcgttggcccgcacaaatggaaccgcaagggctcgctgatgaccgagctgtaccagcacgttgagtatcatcccagcatcgacgaactcgtcacctgctggaagctgcgcatcgcgggagaaattgccgccgcccaggcacaggccgccgccgcggcgatgcacgcgcatcaggctcactccgatgcgagtgcgcttctctcggacgatgacgaatccaacggatccccccgattcgcgtccgcaacggatcattcgggctatgatgcggtcgcgcgggccgacgctcgcatcaggacgctggaatcgtcccgcatcatcgcattggatatcattcccggtgccgtaccgatggaaacctaccgttttccggaacggtgtctgatgctgtttggcgcggaaggccccggattgtcgaacaaagctctcgaactcgctgatgacgtggtatacatctcgcaattcggttccgtgcggtccatcaacgccggcgccgcagccgcagtggccatgcacagctggattgcgcagcacgggtgacgcgggtgtgtatgctcgaatcatgataacgatagaggccttaccaaacgcttcgggcgtaagaccgtgcttgataatgccagtttcaccgccgaagacgacaaggtgaccggtttccttgggtcgaacggcgccgggaagtccacgacgatgcgggccgccctcggcttggccacccccaatgcgggccgtgcgctggttgacggagtgccgttcgtcaagacaccatcgccgatgaccgccgtaggagcggttctcgacgccaaatccgcgcataagggtcggtccgcctacacccatctgcgtggcctcgcccttaccaacggcataccgcgatcccgcgtcgatgaggtcatcgaattcaccggccttgcgagcgtggaaaagcgcaatgcaggagcgttctcgccgggcagggccgtgcggtgctgttgagttcgcgcctgatgagcgaggtcgcattgaccgctgacgatctcgtcatcatcggtcgcggccgcattctggagaccacgacggtcgcggcgttcgtcgcagagcattccacccattcgatccgtgtcgcgacgccggaacccgacaaactgcacgcggtgttcgaaaccgcgccgcaggtcaccgtccgcgaggtgccccgcaatgccaacgacccgcagcaaggccgggtgttccgcattgaaggtgccgcattggagccgactgcgcgggcgttcgcgcaggcgcagtacgagacccgcgcgataccggggcaggtgccggcccaatacggcgagcctgccgcaacctacactcagccgaacacgcaggaggtgccgcgatggcgcagcctcatatcccgccgtagcctcagcccgtgccgtcgctcggcgtggcgagactggtgttcctcagccacgaggtcacgccgctggctgccgacgagtggaggattccattgatcggcctgctggtgttcaagaaatccgacatcaaatgacacccattcggccatatcgtcgcgcgctcgggcacagccgcgcgatatggccgctgccgcagggccgccggacaccgcgcaacatcgtgagaatgtaatggtgcgtgtcacatacggctcatatagttaaggccatgcctacattcacacgtgaagaaatcgagcacctgggcgatctcgcccgtatcgcgctcaccgatgaggagatcacccgtctgcagggtgagctgaacgtcatcgcggattccatcaacaaggtgcaggaggtcgccggcgatgacgtgccgccgaccgccaaccccgtcccgctggaggcgtacctgcgccccgacgtcgccgaaacgccgctgacgcaggaagaggcgcttgccggaggcccgaagaccgaagccggcatgttcgtcgcgccgcgcattctgggaagtgaggagtgacgatgagcgacaccactgaactcgtcaagctgtccgcggccgaaatggccgccaaggtcaaggccggtgaggtctccagccgcgaactggtcgaggcccacctcgccgtcatcgacgccgccgaaccgtccatcaaggcgttcctgaaggtctccgccgatcaggcgctcgaccaggccgacgccttcgacgccaagagcgccgacgacaaggccgcgctgcccgaactggccggcgtgccgattgccatcaaggatatgatcgtcaccaagggcatcgagaccaccgccgcctcgaagatcctcgaaggctgggtgccgccgtacgacgccaccgtcatcgagaagctcaaggccgccggcatgccgctgctcggcaagaccaacctcgacgaattcgcgcagggctcctcgaccgagcactccgcctaccagaccacgcacaacccgtgggacaccgagcgtgtgcccggtggctccggtggtggctccgcttccgcggtcgcggcattcgaagccccgatcgccctcggcaccgacaccggtggctcgatccgccagcccggcgccctgaccggcaccgtgggcgtcaagcccacctacggcggcgtgagccgtttcggcgccatcgccatggcctcctcgctcgaccagatcggcccggtctcccgcaccgtgctcgactccgcgctgctgcaggagatcatcggcggtcacgacaagcgtgattcgacgtcgattcccgaaggcccgcgtccgatggccgctgcggcccgcgagggcctcaagcgcgaccttaagggactcaaggtcggcctgatcaaggaactcggcggcgacggctaccagcccggcgtcgaggcccgcttcaacgaggccgtcaagaagctcgaagagatgggcgccgaggtcgtcgaggtctcctgcccgcacttcgagtactcgctgggcgcgtactacatcatcatgccgtccgaggtcagctccaacctggcccgctacgacggcatgcgctacggcctgcgcgtgatgccgccgaccggtgtaccgcagaccgccgccaacatgatggcctacacccgtgaaaccggcttcggcgacgaggtcaagcgccgcatcatcctcggcacctacgcgctgtccgccggctactacgacgcctggtacggttccgcgcagaaggtgcgcacgctcatcatccaggacttccacaacgccttcgagaaggccgacgtgctggtctccccgaccagcccgtccaccgcgttcaagttcggcgagaagatgaacgacccgctggccatgtacatgaacgacatcgccacgattccggcgaacctcgccggtgtcccggccatgtcgattccggccggcctgtccgacgacggcctgcctgtcggattccagttcatcgctccgcagcagcgcgacgaggtcatgtacaagcccgccgccgcgctcgaagccgcacttgaggaaagctggggcggcccgatctggcagtccctgaagaccccgtggttcgacggcctgaacaagtgacgcatcggaaggaaaacaaacatcatggctgaaaaactgatgaagtacgccgatgccaccaagaaatacgacgtggtcttcggtctggaaacgcacgtggagctgtccacgaacaccaagctgttctgcccggcccacatcgagttcggcggcgagccgaacacgcagctgaccccggtctccctcggtctgcccggctccctgccggtcatcaacaagaccgcggtcgactacgcgatcaagctgggtctggccctgcactgcgagatcgcagagtggagccagttcgcccgcaagaactacttctacccggacatgccgcgcgactaccagatctcgcagtacgacaagcccaccaacggcaacggctacctggatgtcgagcttgaggacggcaccgtgttccgcgtgccgatcgagcgcgcccacatcgaggacgacgccggcaagaacacccacgtgggcggtgccgacggccgcatcgaaggcgccgaccattcgctggtcgactacaaccgtgccggcgtgccgctgatcgagatcgtcaccaagccgatcgagggtgcgggcgaccgcgctccggagatcgccggcgcttacatgcgcgctatccgcgacatcgtgcgtgcgctgaacatcagccacgcccgcatggagcagggcaacatgcgcgccgacgtgaacgtctcgctgcgcccctccgccgacgccccgtacggcacccgttcggagaccaagaacgtgaactcgttccgtggcattgagaaaaccgtccagtacgagatccgccgtcaggcggcgcgtctggacgacggcaaggagatcctgcaggagacccgccactgggatgaggccacgcagactaccgccggcggccgtctcaagtccgacgccgacgactaccgctacttcccggatcccgacctcgtcatgctccacatcaccaaggagcacatcgaggagatgaaggcccagatgccggagatgccgcgcgagcgccgcaaccgtctcaaggccgaatggggcctgagcgacctgcagatgcgcgacatcctcaacgccgacgcgctcgacctgatcgaggagaccgtcaaggccggtgccaaggccgccggtgcccgcaagtggtggctgggcgagctgagccgcgaggccaacgccaagggcgtctcgctcgaagagctgccaatcaccccggccgacgtcgccgaggtcgagaagctcatcgccgacggcaagctcaacgacaagctcgccaagcagaccgtcgaaggcgtgctcaagggcgaaggcaccccggatgaggtcgtcaggaagcacggctacaagatcgtcgaggacaacggcgccatcgaggcggccgtcgacgcggcgttcgaggccaacccggatgtcgtcgagaagctcaagagcggcaacatgaagccgatgggtgtcatcatcggagccgtgatgaaggccacgcgcggccaggccgacgcgaaggctgtcaccaaggtcgtgatgggcaagatcaagggctgacgccccacgggttcgccggaatcccgagaccctgaaattccggtttgaagaacggcccttggccgcggtgctgaaccgcgtgtcgagggccgttcgtcatgccgcaggcgctcccacggccggcagacacgtgggcaactccttcacagcaaacggtcagtcgggtaggatatcttctgtaccgacttctaccagcgtcagttgaggaataacgaatgtctgaaaatgccgcattaccgctcgatcaggacgtatcccgtgagctgccctcgcagatcaccataccgccgatcaagggggagatggtgcacctgcgcccggccagcgtcgacgacctgccgcgcatggatgagctggacgcctactatggcgcctccaagatcaccggcaaggacgctcaggcggaacgcgccgtcgtacacacgtgggtgagacgctcggtggcgtgggcgaacgggcagaagcccgacgagtcgggcgtaggcgatccggagtcccgccgcaccatcgcatgggcggtactgaccgacgccgaccatgacgaggacggcgaaatcgacgcgcagtcgacagacaacgtcatcggcatgattttcctgatcgacatcgatggctggtcgcgctccgcccgcatccaggtggtgctgggccgtgactaccgcgggcgcggctactcgcgcgacctgatgccgcgagtcatgacgtacggtttcgcgcctgaaccggccggcctgggcatgcaccgcatctgggtggcggtgcccgagcagaactcgcgttcgtgctccgtctaccagtcgctcggcttcgagccgtccggcgcctcgcgcgacgctctgtgggatgcggagaacaacaaataccaggatctgattgtcatggacacgctggtggacgagtatgatcccatccgctctctcgacgcgttcggcatgcacgtgattgaggacaatcccggtgtgcaggaggcgatgagcgcccgtgagcactcgatcgccatcaggaagaacatcgccgcgcaggccgagcccgcgccggagcccgccgcggtcgaggagagcgcggatgccgaacaggcgccccgaatcgagaaagtcgccgcagaccgagtgccggaagcgcacaatgacgatgaattggccgcgccgggcgaggaaagcacctggccgtatgggcagggcgaacgcaaaccttcgaaggaagcttggtggcgtatcctcggacgtggccgtaaacgtgatatggaggatgacgaatgagtgccgaggatcttgacaattacgaaaccgacgcggaactcgccctgtacaaggagtatcgcgacgtcatcaagctgttcacctacgtggtggagaccgaacggcgtttttatctggcgaacaaggtcgatttcaatgtgcgttccgccggtcaggacgtgtatttcgacgtgcagctcaccgacgcatgggtgtgggatgtgtaccggtcgtcgcgtttcgtcaagaacgtgcgcatcgtcacgttcaaggacgtgaatgtcgaggaagtgcagaaaaccgatatcgacatccccgacgatatgaattgaggcgctgacggtcggaccggctgattacaggccgactgcggtcggccgtccgccgtcatctgccggtgccgtgtgcgccccaaaccggcacgtcgccgtttcccgctctcgttttcgttgcgatacgcggcttctcgtgtatggcgacggaaggattttgtaagcagaacaacaaaatcggcgtgcgtttccagcggttcatatatactgtctctgattcagcgataaggagacctcacgtgacgcagaagcaatccgtggtgatcatcggcggcggcccggctggcctgaccgcagcatgggagttcgtcaacaacggcggctccgacacatacgatgtgaccgtactcgaagaaacgcaggagttcggaggcatctcgcgtaccgtcaagcacaacggcaaccgcatggatatcggcggtcaccgcttcttctccaaggacgaccggatcatggactggtggaaggacgtgctgccgctgcagggcgcccccagctatgacgacaagaaactcggccgtgagcatgacatggagccgggcggtcccgaccccgaaaccaccgaccaggtgatgctcaagcgccaccgcgtctcccgcatctactggaaccgccggttcttcgactacccgatctccctgtccgtcaacaccttcaaggcgatgggcttcaagctcaccatggtcgcgggtttcagctacctcaagtccatgttccataagctgccggagaccagtctggagaacttctacatcaaccggttcggccgcaagctctactccatgttcttcgagggctacaccgagaagctgtgggggcgtcatccctcgcagatctctgccgattggggtgcccagcgcgtcaagggcctcagcatcctcggcgttctcaagaacgccttccgcaagctcagccccaagaagcgcaagggtgaggtcgaaacgtcgctcatcgaggagttctggtaccccaagctcggccccggccagctctgggagaccgtggaacgccggtgcgtcgacgccggtgccaccgtcatcaccgatgccaaggtcgtcgagattcgtcaggcacagggccgtatcgaatccgtggtctacgagtcctcggacggcaagcgcaccgaactgcacgccgaccagttcatctcgtccatgcccgtcaaggacctcgtcaacgccatcgacgcggcgtctcatgacgatgacgccgaagcgtcttcggcgcctgtcccgcaggacatgacccacatcgccaacggtctgccctaccgtgatttcgtcaccgtcggactgctcgtcaagcacatgcgcctcaagaacaccaccgacatccccacgctcggcaatccgcccatcgtgcccgattgctggatctacgtgcaggatcccggttacaaggtcggtcgtctccagatcttcaacaactggagcccctacctcgtcaaggatgtcgacgataccgtctggatcggcctcgaatacttctgcaacgagggtgacgatttctggaacatgaccgacgccgaggccaccaagttcgccatttccgaactgacccgcatgcgtgtcatcaacggcccgcaggatgtcctcgactcccatcgcgaacgtgtcaagaaggcgtatcccgcctacttcgacacctatgcccagatgtccgaactcatcgaatacctcgactccttcggcaacctttactgcgtcggccgcaacggccagcaccgctacaacaacatggaccactccatggccaccgccatcgaggccgttgccaacatcaaatccggcaagacctcgaagcagaacgtgtggtccgtgaacacggataagtcctaccacgaacaaaagtaacccacaccagatatcgcccccgctagcgggggcatttgtttatgtctgcgactcggcgtccgtttttgcattggtctccagcccgttatacagtatggaaagtccgaaacgcatggagtgcgtcgggcgttcaaagcggcaagaccgcaatcattcttagtgcagggaccggtgcaatacggtctgctaaggaaaggcaaacgagtggcaactagccagaatcttgaaggtatgaagctgatcgagctcaaggagctcgccaagcaaatgggtctgcgcggtacgtcgacgatgcgcaagccggaattggtcgccaccctgcaggctgcacgatcaggcggcgaggcgccggcgggcgttaccgtgcgaccggtaaagggcgccgcaagcaagccgacccagcagacgcagcccgctgcacaggccgcgcagactccggaacaggctcccaaggcggagcccaagggaagtgcaccggtgtcagcggcggatgatgcggtggccggactggtcgcgtctctgcccgagctcgatgcagcctcgacccgcacgccgcgtatctcccgccagaaggccgccgaatccgacagcaaggacgaccgcgccgcggctcctcgccgtcgcacccgcgacgatgcaaaggcgggccaggtggctgccgatctgtttgatgaacttgacatcgcgccggcggacgatcagccgcgtcatcgcgatgatgcggctgattccggcatgatgcgtcgtcgtcgccgtaccatcgaaccgcgcgagcgcgaccagcagaacgacaccgtccgcgacctcgacgatattctcgccacgcttccggtgcagaacgccaatgcggacgccgcccgcggcacccgtggtgaccgtgataatcgagatgacgacgagcgcgaattcacccgccgcaaccgtagcgaccgcgctgaccgttccgaccgcggcgaccgcggcggcgatcgcaatgaccgtggcgaccgcggtaacgaccgcaacaacgaccgtcgccagcgccgcatgcgcggccgcgaccgtggcggccgcgactacgatgatcgcgacacccgcgaagtgcgcatctccgaccatcaggacaacggcggcgacgatctcgtgccggtcgccggcatcgtcgacgtgctcgactcctacgccttcgtgcgcacttccggctacctgcccggcccgaacgacgtgtacatctcgatgggtcaggtcaagaagtacggcctgcgcaagggcgacgccgtgaccggatccatccgcgcgccgcgcgagggcgaccgccgcaaccagcgccagaagttcgtgccgctgcagtccgtcgacaccatcaacggcatgagcgtcgaagaggcggccaaccgcccgcagttcgccaagctcaccccgctgtacccgcaggagcgcctcaagcaggagaccacgccgaacaagctcaccggccgcatcatggacatcgtttccccgatcggcaagggccagcgcggcctgatcgtctccccgccgaaggccggcaagacgatcacgctgcagaacatcgccaacgcgatcaccacgaacaaccccgaagtgcacctgatggtcgtgctggtggacgaacgccccgaagaagtcaccgacatggagcgcaccgtggccggcgaggtcatctcctcgaccttcgaccgcccggcctccgaccacaccaccgtcgccgagctcgccatcgagcgcgccaagcgactcgtggagctcggtcaggacgtggtggtgttgcttgactcgatgacccgtctcgcccgcgcctacaacatcgccgcgccggcctccggccgcatcctgtccggtggcgtggacgcccaggcgctctacccgccgaagaagttcttcggcgccgcccgcaacatcgaaaacggcggctcgctgaccatcatctcctccgcgctggtggagaccggctccaagatggacgaggtgatcttcgaggagttcaagggcaccggcaacatggaactgcgtctgagccgcgagctggccgacaagcgcctgttcccggccatcgacgtgaacgcctccggcacccgccgcgaagagctcatcacctcgccgcaggaactgccgattatctatcgtctgcgccgtctgctcggcggcatggagcccgagcaggcataccagacgctggtgccgcgcctgaagaagaccgcgacgaaccgcgacttcctctccgccattatccagcagagcaacagcaacccggtcaacggcaactgatccggcagacggcctgaacgagaggagcccccgcttcggcattgaagcgggggctcccgtctatatccggcctgctttcaggccatgatctgcagatgatggtatccgggcgtatggcggcccagcgcggggtcgacgtgacgttcggcgaacacgcgcatccgtcgcacgccctcgcgcagctcacgcccgtccccggcgtaggaaagcctcacgaatccggccccctcactgccgaaggccgttcccggcaccacggcgacgcgctcctcgtccagcagcatacggctgaacctgtcgcaatccatgccgcaggctcgcacgtccacgaacgcgtagaacgcgccctgcggctcgatcaggcgcagcgcggtgcagccgtcgagctcgtccagcacgatctgccgcttggtgcggtattcctcgcgcatggccgtgacatgctcctgcgggccggtcaacgcggccacggcggcatattgcgccgtcgagttgaccgatgagtgcatcagctcggcgagcttgctggtctgttcaatcagcggctcggggccgagcaggtagccgatgcgccagccggtcatggcgaaggtcttggacaggctttcgacgacgaccgtgcgctcgtgcatgccgtcgacggcggcgatggagggcgcgattgacgcggagccgtcgaagacgaacgggtgatacacctcgtcggagatcgcccagatgtcatgccggatgcagacgtcggcgatgcgctccagctcggatagcggcgtgacggctccggacgggttgccgggggagttgagaagaacagccttcgtgcgcggcgtgattgctgcttcgatatcgtcggcgttcagccgcatctggtgttccggtttgagcgcgacgggcaccggcactccgccgcacatcagggcctccgcatcgtacgaggtgaagtacggcgacggaaggatcacttcgtcgccggcgtcaagcagcgccttcatcgccaggaacagaccgatggtcgcgccgtcgaccgcctgtatctcggtgtcgacgtcgtagcgcagccccttcaccttttcggagtatgccgccacggcctcgcggaacggctcgatgccgagcacgttcgtgtatgtggtgtgtccttcgcggatcgatcggcatgcggcttccacgatatgcggcgccgcggtggcgctgggttcgcccacgcacagcgagattgcgtcaggcacgtgctcgacccggtcgaatacgtcccggatgccggaacgggggacgctgagcgagtgctgcgaaagtgcgggcatggacatggtgtcacctttcaatcatgaacaagaatataaaatatacagtagtacattgaaaaacagtaattattactatatatttcgtaaataacagtaagaaatcaatggaataacactggattgacatcgcgataagctgtcatcagacaagttcgcgccggaaccgctccacatgcaggttgcggcgaaccgtatgacccgggaggacgtgatggcacaggcgaatacgcgcaatgacgaggaaccggacgcggcatcgcgcaaggtggagatcaggccggagggctccgccatgctcgacgccacggacgagtccatcctcgatgcgttggaggaggacgggcgggccacgctggctcagctgtcccggctgtccggcctgtcggtgtccgcggtgcagtcccgcgtgcagaagctggagaagcgaggagtcatcaaggggtatcgcgcggtgctcgactatgagctgcgcggtctgccgatcagcgcgttcgtgtccgtcacgccgctggactactcgcaggaggccgatatccccggcaagctgcatgagctggaaggcgtggtgtcctgctactccatagccggcgcgcccagcttcatgctggtggttcgcgtgtcgtcacccagcaaactggaagagctgctgaaccgcatccatcggacggtgccggtcagcaccgaaagcacggtgatcctgcagacgtatttctgacggatgccattcgccgtaggcgttagacatcccggccggcattgaccatatcgttccatcgttgaggaataaccgacggtctgggttcggcccacgcgctatggtaggcagtatgagtgaacccgagaacagcgattgggcgaagccgtcatcccgcgaggtgggaggcggcggatccgaaaccgtcatcgacgccgacaccgcacggcatgatccgcagaccgcggtcaccgtggccaagatcaaggcgctcaggcagtccatcgacaatgtggacacggccatcgtctccttgctcgcggagcggttcaagtacacgtcccaggtgggtgtactcaaggcgcgggccggattcgcgccggcggattacaagcgcgaggactaccagatcgaacggctgcaccgcatcgccatcgacgccgggctcgatcccgacatcgcggaaatgtaccgggaattcgtggtggccgaggccaagaagcggcatcagcgcatcgccgacgcgggaggggatcccggcgtgctcgacgtgttcgcctgatcggcggagatttgccgctctgcccgcatcgtcggtggcgtgcatatgcatgcctgtattcggcatgcgggccgcgtgatgatgaatgaaagggggagcgacgatggcgcatatgaccggggtgatgacgcgaagcctggcggctgccgccacgctggccctgactctggccccttcggcgggcgggccggtcacggccggtgccaatccggccgaaggagatgccgggtattccaagacgcagaatgtcatgtctctcgccaactcggacggggttccgggacgcctgtacgtcaccaaccagttcacggtctcccgcggcggcgacatcgtcgactacgtggccggcaacagcggtgacggttccatgctcgcggcggaatacaaggctgtggaaaccggcaagaccacacaggagcgggtgaaggccgggcaacgcgtgttgccgtggtcggtcagcatcgcctacggcctgaacggcccgcaggtgaagccgtcccagatcgccggtgccagcggactggtcgatatccgtatcaccgtggagcccaatgcggccgtgtccaacggctacgcggagaacagcattcccgtggtggcgttcaccgtaccgtcttccgtctccgacgatatcaccgtcggagacggcatgacgctgacgatgcaaggatccgacatgcttgtcagcggcgtcggggagcccggcaaacgcacggtgttcgactgctatatgaacgcgaagaacttctcgatgagccaactggcgttcgtgaccgtgcaggccgatgacacggcgtcgttcgtcgacgaggtcacggctgtctccgaccgtgctgacgcactggtcaacacgctggtcgtcaccggttccgcgtcggaccgcaaactaatcgaacagctgaccgccatgcgcgatcgcgagcagaagctcggcgagaaggcgatcaaggagaaaaccgcagcgcacaaggctgcgttctcgtcgtatatggcgcattacgtggggtcgtacacgacccatctgtccggcagcatcggctcatccacgcagatgcaggcgctgatcggcacagccggcgaactgaccggcgacaccccgatggcgcaggcggtcaccgacctcgccaacgcggtcaacgcggtcagtgccgcgcatgagcacgacggcgcagtacatgccatagacgacctgattcagcgcatccgtcagcgcggcacgtcgggactcgccgatgagatcagccagaccatggcccaggagtccaccgagggcgcaacggcgtacaaggccgggcagagccagctgtccaacgcgatgatcccctattcgatggcctacaccgacgtgtacaccaagcatctgagcgagctgaccggaggcacgtcggcgggagccgcgcggtatcagcaacaggcgattgacgccgccaacgaggagttctccaccagcgccgaccttcaggacgacaatcaaaaagtgcagtcggcgatggacgccttggcggcggcatccgaacatacgggcgcggcgaacgcattgcaacagatcagcatacagttcgccggcgcactgaccagcaccgcctccaccggcgatgcgcaaggcggcgatgcggctgcgggccgggtgcgttacggatgggccggttccgacacgacgtcgatggcggcgaaggccgagcgcaagcggctggccgccgtcagcaagcaggagcgtgaggaggccgagcgcaaggcgcaggcgttggccagtggcaagaccgatgacgactcgcagtcaggcatgagtatcggcgatgtgatgggcaacgccagcggcctgggcatgctcggcggcgccgtcaagagcgacggcaaggatggcaacaaggatagcggcgacggcaaggatggcaacgtcagcggcagcggctcgtcttcggcggcgggcacggcatccggttcgaagtcggcgtcggttccgaagttctcgccggtatacggcatcgccggcatgaaccccagatcgccgttgcagagcacgtcgtctgagctcatcgacgagacagtggcgattggtgacgtctccgacatgctggttcaggccgcgcaatcgttggccggcagcggcagtgcgtccgtcgacggcaaaccggtcgcgcgtctcgctgccgcgttgagacggttgtcgtgcgacggtgccaacgcatactccgaccactgcatcgccgacgggcggcacagttacgacgtgctatccgactggaaccggcataccgaggacctgcgtctgctgatcatcatgccagccgtgtgacgggtgcgcggcatacggcgcacggcacgcagccggcatgccgccgtcacgatgccgtggatgcaaaacggccccctcgtggatccgagggggccgtttccgttagtgagaagcaggttacttcttggccttcttcgccggcggctcaccgagctcgctggcatcgatgacgacggtatcgtcgccctcgccttcggccgcggcctcctcggcgtgcttttcggcgagatcgaacttgccgatcacgcggccggcctgcgccacgtcgtccagagcggacttgatggcgtcgatgccgtccttgacggcggccagcgtcaccgacaggatcggggtcttcatcgagaccttggcctcggacttgatcttgcgcagctgctcgacggccttgccggcccaagccagcgtctccggggaggcaccggtggctgctgcggcatagatgtcggccttcggccaagcggcgcggtgcacggacccctcgccggtgtgcatccagctccacacctcttcggtggcgaacggcaggtacggggccagcaggcgcgcgaaggcgtccaggcctaggcccagcgtcgtgcgcgcggacttcacggccgcgtcgctcggcaccttgccgtgcgcgtcggcagtgccgtacgcgcggttcttgaccagttcgatgtagtcgtcgcagaactgccagaagaagctctcgatgacttccagcgccttggaatgctcgtaggcgttcagcgcgtcggtggcctggcggatcaccagcgccagcttcgccatcacggcgcggtcgagcggctcggtcacatcggccgggttccagacggcgtcggccgtctcgcccacatgatggttctcgtcctcgcgaccgatggccagcgcgaacttcgaggcgttgagcagcttgatcgcaagacggcggccgatcttcatctggccttcgtcatacgtggcgtcgaggccgagacgggccgcggcggcccagtagcgcaccgcgtcggcgccgaactgctcgatcggcttgttcggcacgacgacgttgcccttggacttcgacatcttcttgtggtcggggtccaggatccagcccgacagcgtggcatgcgcccacggcaggcacttgttctccagatgggcgcgatccacggtcgagaacagccaggtgcggatgatgtcctgaccctgcggacgcagatccatcgggaacgtggccttgaacagcgccttggaagcctcgtccggctcctcccagcgggtcacgatctgcggggtgagcgaggacgtcgcccacgtgtccatgatgtccggctcggcggtgaagccgccgggcacatcgcgctgggattcgtcgtagccttccggcacgtcattggtcgggtcgatcggcagacggtcctcgctcggagtgatcggatgatcgtaatccggctcgccggaagccttgaccgggtaccacagcgggaacggcacgccgaagaagcgctggcgggagatcagccagtcgccgttgaggccatgcacccagttctcgtagcgcacgcgcatgaaatcggggtggaagttgagctccttgccgcgctcgatcagctcggcgttcagtttggcgtcggtgccgccgttcttcaggtaccactgacgggaggtgacgatctccagcggcttgtcgcccttctcatagaagttcgtcatacgcttggtcggggtcggctcgccgtccaggtcgccggcctcgcgcagcgcgtcgacgatgatcttgcgggcggagaacgtggtcttgccggcggtcgcggcgaacatctcacggccggccgggtcggtgatccaatccggggtgtccatgacgatgcggccgttgcgctggatgatcgggcgggtcggcagcttcaggtcgcgccaccactcgacatcggtcacgtcaccgaaggtgcagcacatcgcgatgccggcgcccttgtccatctcggcggccgggtgcgcgagaatcggcaccttgaccttgaacagcggggagtacacggactggccgaaatactgcttgtaacgctcgtcgttcgggttcgcgatcagcgaggtgcaggccgcgagcagctcgggacgggtggtctcgatgtagatcggcgtgccgtcctcgaaacggaaggcgaccttgtggtagaagccggggtattcgcggctttccagctcggcctgggccacggcggtctggaacgtcacgtcccacaggccgggcgcgtcctgctgatacgcctcgccgcgcgcgaggttgcgcaggaacgccttctgcgccacgcgctgcgggtgctcgccgatggtgtggtaggtctgcgaccagtcgatcgacaggccgagggaacgccatagcgcctcgaactgcttctcgtcctgggcggtgagcttctcgcacagctcgatgaagttcttgcgcgagaccggcacctgatccttggcgtcgatcttcttgccgtcggtgccctcgaacggcggcttgaaatcaggatcgtacttgagcgacgtgtccacgcgcacgccgtagtagttctgcacgcggcgctcggtgggcaggccgttgtcgtcccagcccatcgggtagaacacgtcatagccttgcatgcgcttgaatcgcgcgatcacgtcggtgtgcgtgtagctgaacacgtggccgacatgcagatggccggatacggtgggcggcggggtgtcgatggaatagacggccttgcggtcgcgggttccctggaacttgtagactccgtcctcgtcccattcgccgcgccacttgtcttcgagcccgtcgacgccgaccttgtcgggcaacggggtgaggtgtgccttgatgatgctgttatcctgctcttcggtcataagcgacagtctagaaagcaatcgtgacaacagccgcgcggctgcgtccgccggcgggcgggtccgggcgcatggacccgaatcagtccgtggtggtcatatcggcgagcggcagctgcgtgtaggtcatgttgacgggcactccggtgatgttgctgcggtacgcgctgatcggcttgcgtgtgcagatccagtccaccggcgaatcgtcgtcgagcgtgccgatgaacgactggaagttcttcgcgtagtcgtcgctgctgaaggatttcagcgccttgctccacgcgttctgcgagtcggtgctgacgaagccgatgtacgagttgctgtccatcaggaggtccagatcgtcctcgccgtcggtctcgtagatcgtgaagtcgtattggcggtcctgcgtcacggtcttgctccatgtggcatcgtcgaccatcgacacggacacgtccgaatacgcgggttcggcgtacatcgtctgcttgacctgttcgccgatctgggagccgtattccttcggatagacgaaggtcagcggtcgtctggagacgcggaaacggaagtatttgatcaggtcgttgcccttgccgatgtcgtggccgaacgtctcatccgtcttctgatatccgtcgtcgagcggtgacagcggcccggtcatgaccgtgccgccgcccagcgcctcggtcatcgcgttcttgtcgatgaggtagcgcactgcctgccggaaccgcttgtcggaaaggatggactgcgtgttgttgctgaaggcgagcacgaccttgcggttgctgacgccctgcttcttgacgatgccgtcatctttcaccgcgtcggcggcggactgatccagcgcgacggccgcgtcgatctggccgttgttcagagccttggccagctccgtggtgtcggccgcgaagttgacggtgacggtcttggccttggacttgctgccccaatagtggtcgttgcggctcagcgtcagctgcttgccggattgccattgggagacggtgaacggtccggacccgctggcctgctttgcgtagtcgatgttctcacgctggttgtagacgatgccgatgcgcgtggtgagcttggcgagcagccgcgggtcgggttcgcgaagccgcagcaccagcgtgctgttgccgtccgactccacgttggacagcgcggacagttcgtcgctgccgacatacttcttggtgatgatctgctgcagggaccatacggcgtcggacgaggtgatcgtggtgccgtcggcgaacgtcgcgccgctgcgcaggttgaagcggtaggtggtgccgtcttcggacaccttccacgaggaggcgagcgacggctggatcttgttgttgtcatcgcgcttcagcagcgtctcatagacgttgccgagaaggacgcggtcgagcgaatcgtcgtcggttgtccggatatccaatgattccggggcgccggtgatgccgacgctcactttgacgcttgattgcaggccgctgaaggtgggcagcgtgtatttgcggtgcagcagggaccagcccagccagacggcgcagccgagcacccccgcgacgatgacaaagatgatggcggacttcgccgaactgctgatggaggtatgccgtgcgctgtgctgcatggctccgagtgtaatgcccggggtaaacgggtcgacgggggatccctgatgcgtgggataccggccgggtccgtccgcttggtctatatcagtgagctcgggcaggtgtcatgaagtgggcacacctcgcaatcgggtttgcgcgcgtgacaggtggcgcgtccatgcagaatcagccggtgcgacaggtcggtccactgcgacggctcgaaatacgagcagatctcccgctcgatatgcaccggatcgggactggacgagttccagtcgccgcgccagcgcagccgtcccgtcacgcggatcacatgcgtatcgacggggaatccgggcacgccgaacgcgttgcccagcaccacgttggccgtcttgcggccgacgccaggcaacgtcaccagcgagtccatcgtatcggggacctcgccaccgaaacggtcacgcagcactgcggccaatcccagcagatgcttggtcttggaacggtagaagccgagcgggtggatgatgtcttcgacgtcctgcggattcgctgcggccagggatgcggcatcggggaaacgcgagaacagctcgggcgtgacggtgttcacccgcttgtcggtcgtctgggcgctgagcacggtggctatcagcaattgcaggggagaagtgaaatccaaggcgcatttcgggtgcgggaacgcctcgacgagcaatgcgtactcctcgtgcatccgctggatgcgtgcccgtttggattcgcgtggcatgatgcgccggtcttactgggcgttggcgtcagtgtcgtcggaagccgtcggagccgcgagtgacttgtctccctcgccctcgggcgggtcgaaacggtagccgacgttgcgcacggtaccgatcagatgttcgtattcgccgcccagcttggcgcgcaggcgacggatgtgcacgtcgacggtacgggtgccgccgtaatagtcgtatccccacacctcctgcaggagctgcgcgcgcgtgaacacacggccgggatgctgcaccagatacttcagcagttcgaattccttgtacgccagatcgatgggcctgccgtgcagcgatgccgtgtagccgttggtatccaccacgagatcgccggaacggatctggccatcctcggtgcgctccgaatcgtccgtggtgctggcgcctgtgatcggcgcattgccgcgttccgacaccagtcgcaggcgcccctccacctcggcgggtgaagcggaggccaccaccacatcggcgatgccccactgcgagttgacgacggtgaacccgccctcggtgaggatcagcacgatcggcgtggccaggccggaagcgtgaatcagccggcacagcgtcttcgccgtggcgaggtcatcccgggcgtcgaggaagagcacggtgttctccggcatcttcaccaggcttgcggcgtccatcggcagcacgcgcacgcggtgggacagcagtgcaagtgagggaagcacggtggcagggtcgtccgcgaatgtcatcagcgtcaaatcagtcaaccgcttcccctttcctgaatatggataaccgtagtacccatatggttagtggtcatattgtaggcgcataatgtggacagccgacgctaggctagagttagtggaatggcggtcgcgaggctgccgcggattgcgatttgtggagtgtgatgacgatgggcgacggcgaacagcgtgccggaagctcgattggccgcgtacttgcggttcaggcggtggcatacgtggtgctattcggcgtgacgggcgtgctggagttcacgttcgggaaccagggcggtgtggcgcaaggggttgcgatcgcgctcgccgtggtgctgctcgtgctattccaggttgggtggccgttccgtgccggcattgccgaccgcctgatcggcgcggttgcgggcgtgctgtcgattctgtgcgcgcggacgtcgttggccagccagctgttttaccccgcgtacgagggcgggcgtcttgcggatgatggacgtctggtgatgtatcagctggtgcgttgggcggcgtgcttcgcgatactgctgatcgcggcgacgatcatcgcgttcggccggcagatggtgcgcgcggagcgcagccacctgattcgcgcgctgtcgcactgcatgacgggggccgtggtctccgtcagcgccgcgggatggtgttttgtgcccgatctcatcgacatgggctccgcgtcgccggataacgggctgctgacgagattcatcatcgtggccgcggcgttcgtggtagtggcggtgctgttcgccgtatgctcggtgtcgtggagccgcgaggcggatccggatccggccgctccggcgccgtggctgggtatcgggctgctgccggtgatgctcagcggtctgctcgtgttcgccgcgtcattcgtcatgcagctgatcttctgatatttgacggttttcttcggcggggaatattggtcttcgccagtatgcgatgcggggagtcgggattcggcatcgttgccggggctttcccgcatgtgggtatgaagagggtgtgcgcctgttgggctttgttttcgtcaagaaccaagcagggcaatagggagtccgtacccgtcattcagccaacgcgcttctttcttgcgggcggtggagttcgtcggcgaagggtcgccatcatgagcggtctgatcgagacggtcgccacggaccgccctccggcgaccggctcgcatggaggagcctgggtcgaggacctcggctgcgcgcaatgacgcacacgcggggaagacatgtccccttgggcgctacgacgaaatccgcaccggcaagacgatggcctcatcgtcccggcaatatccaaacacggaaagtcccgaacacggacgctgacagccgcatattttcagtctcgttgcgttaccatgctatgaagccaaggtgctcaagcagcaccttaagaccgatgagcacgagcacggcaccgccggcgatctgcgccggcttctgccagcgtgcgccaaacacgcggccgatatacaggccggcagcggagaacgcgccggtcaccacgccgatgacgatcaccgaaaaccagatgttgacctgcatgaatgcgaagctcacgccgacggcgaacgcatcgatgctacacgccaccgcgagcggcagcatatggcgccagtcgaactgggccgtctcccggctgttctcctcttcctctccgaacgcctcgcggatcatgttgccgccgatgaacgcgagcagcgcgaaaatgatccaatgatcaaccgcggtgacgtatttgctgaacgtgttggccgcgaaaaagcccagaagcgggaacaatgcctggaagccgccgaaccacaatgcggtcttgatgacgtcgaccggccgcacgcgcgtgacggtcaacccctttccgatcgagacggcgaaagcgtccatggcgacggatacggaaataagcagtatctcaatcatagctggaacataaaggttcatcccgccggcttccccgggggatgggcctcgacggataaaccgcctacgcctagggggcacggactttgagaactgccgggccagcaagccggctttgaatccaagcgaatgctgttcgcaagtcgtgaaaactacaaggcactactgtaacacaacatcgccccgctggcgggacgagccgtgaagcaaacagcggaatctgtttgtaggcgagccagaaagctgtggtcgataagataatataatgcccccgctggcgggggctgtcacggagcgactgggggtggtcgtggcacttaagcccccagtcagccgatggctgacagcccccgccagcggaggcggaagcgaagcaaatcacttcgacgcgttcgcgagacgctcgcgcgcctccttgatttccttctcggcaacggtcctgcaattgaggacggccttcggccggctcatggttggctcggtcgctgtcgcgtcctcgcacgttgccgccggacagcttaccgggctgtcctgaagcaaatcacttcgacgcgttcgcgagacgctcgcgcgcctccttgatttccttctcggcaacgtccgcaccggtccagtagtcgccggggaggacttccttgttgggttccagggccttgtactgctcgaagaagtgcttgatctccttgaggtggtactcgttgacgtcgttgacgtccttgatgtcgtcgtagcgcacgtcggcgggcacgcacagcaccttgtcgtcgccgccctcttcgtcttccatgtggtacaggccgacggcgcggcactcgatgacgcagcccgggaacacggagttcttgaccatcaccagcgcgtccagcggatcgccgtcctcgccgagcgtgccttcgatgtagccgtagtcgtccgggtagcccatggcggtgaacagctcacggtccagggtgatgcggccggtctcctggtcgacttcgtacttgttcttggaaccacgcgggatttcaacgagaacgttgaacgtttctgccatgatattgctccttagagtcgattgacataatcacactccacaataccccgtcgtacgccggaagcgccacgatttcgcccaaaaacgcagatggggcccgtcgccgaaacgacgggccccatcaccgaaacggtcagcctgccggccgcgcgtccctcatgcgttctcagtcctcatgcaccacggtgaagatgtgcgccacatcggcccacggtgccaacgagacgaagttgtcccagctccacgcgaagtcgcggccggtcagctcgtcgtgtatgtgcgcaccccacttcggatcgatgccatagtcgggcagctccagatgcaccatggcctgatgcgcctcgtgaccgtccaggttcaccaccacgatcagcgtctccggcttgtcggtgccggtcagttcggccggtgtgtggcgggcgaatgcgaggatgttcgggtcggaggattccagcaccgtcaggttgtggtagctgaacaccttcggatgctcgcggcggacgcggttcaggttggtcagcagctcggcgatgccgtacttgtcggcggccgaccagtcgcgcaccttgacctcgtacttctcgttgtcgatctgctcctcgaaaccggggcgctgcttgttctcgatcagctcgaagccgttgtagatgccccagctcgggctgcccatcgcggcgagcaccgcgcgcacagcgtggccggcgatgccgttgtcgcgcacgtaggcggtgaggatgtccggcgtggtgggccagaacgtgttgtgctggtagtagccgtcgtcgccgttcgtggtctccaggtacttgcccagctcctccttggtgttgcgccacgggaagtagcagtgcgactgcgtgaatccaacgtagctcagcgcgcgcatcatgcccgggcgggtgaacgcctcggccaggaacaggatctccgggtgcttcttggtgaccgccgcgatgacgtcctgccagaagcgcaccggcttggtgtgggggttgtcgatgcggaagatcgtcacgccggcgttgatccacagttcgagaacacgctcgacttccttctcgatgccgggcatgtcggcattgaagtcgatcggatagatgtcctgatacttcttcggcgggttctccgcgaaggcgatggagccgtccggcttgtggcggaaccaatccgggtgctgcttgacccacgggtggtcgggtgagcactgcagcgcgaagtcgagcgcgatttccagacccagctcgtgggccttggcgacgagcgccttgaaatcgtccatgttgccgagcagcgggtcgacggtgtcatgcccgcccagctcggaaccgatgccgaacggcgagcccggatcgtcggggccggcctccagcgcgttgttgcgtcccttgcggttcgtcttgccgatcgggaagatcggcggcaggtacacgatgtcgaagccttcggccttggcgcgttccaggccggacaccgacgtcttgagcgtgccctggacgatcttgccggtctccgggtcgacgtaggcgccctcggaacgcgggaagaactggtaccatgcggcgaagctggattccggacgctgcacgaggaaacgctggggctggctgggcgagacgccgtcgcgcagcgggttggtcagatgcagctgggcgaccggttcgctggtcgccgcggcgagacggtcctcgggcgtaagcgatgtgtccttcatggtggcggcagcggcgacgatcgtcttgcgctgcgcggcgctcagcttggcgtcggcggtcttcgcccagcgttccagcaattgcgcgccggattcgagggcgttctcgacgtcgtcgttgaccttgactttgatggccgcgtcatgcagccaggacttgtaggtgtcctcccatccttcgatggtgacgctccattcgcccagctggcgcttgatggcggcgaattcgggctgccacggcttgacgtcgctgtgctcgccgcaggtgagcatgacctcccagcggtcgaggccggggttggtgcaggtcatcggcagacgctgcatctccttgccgcggtggttgcgcacgatggcggtggcaccgactttggtgcggccttcgatgaagacctgcgcggtgaccttgaacggttcgcccagctcgacacgggcggggaaacggccggattcctcgttcggcgtcacgtccatgacggcgatgcgtccgaactgcgacgggtctgcgacgggaatggactgcgcgggaacctcaccgttggcgacggcggccgcagtggcggctttcgtcgttctggaggcgcgaggcgtcttggccgtcgtgcgcttgcgcggcgaggtggtacgtgatgtggactgcttgcccgacgaagtgcgacgggttgcggatttcgcttcggtcttgtcgtccgaatgcgatgtggctgatcgagatgaactactgctaagcgctgacgcgcctttcttttcttctgccataccgcccattgtatacggctgatggccaatgggcgattgtggataaccctctgtcttatatgccgagaaccgccaaatgtggataactgtcgtggggagttatccacaacacgccgaagggggatagccttcgaccacattgcctgaaatccggtggccgacggcgtccggcatggcatggtgtcatcaaccgcccatcgtggacgcggcgggatttcaggaagggaatatcatgaacatggttgtattcaggcgatgtcaggccgcgctgggggtcgcggccgtcatggctctcgcattggtggcctcgctggtgtttgccgccatgccggccgcggcggtgacgttgagcagggcggatgccggcacgtttctgcgctatgagcatggcggcgagcaggtcatcggcgtcatggcgaaggattcgacgaacaactattactgcatcgaggctgacgaacgcgtcgaataccagctgggggagagcgtcaagctgcgcgacgacgacaccgcgcgccggctcggctggctgatggaccattatcgcgacgggacggccgtggagcatgcggcgatcgcggtgctggcccatgatctgctggacctgaagccggacacgtggaaatcccggcgcgtgtccgtcatgcgcgacaatccgacgctgcggcgcaaggtagagcagatgtgggaggaggcgggatccaacgccccggcgaatgcgacggtgacgcgtacatacgccgaaggcacgcggaccgggcgcgtcacggtgtcggtgaccaatgcgcaggggaagacgatcgccgggatcagatacgccgcgacgctgaacggtccggcggtgttcgcgaacgggagcgcgacggtgaccgggatatccggggcggagccgatcgtgtactcgtggaaggcgaccggcgagggtgaagtgaaggcgagtgtggcatatgaccgcaagcaggtggacgtgttcgcagtcgcgggaggccaggatctggtgcgttacggcggctcttcgcaggtgagcggcaaggcggtgaatttctcggtccgcaaggagttcgtgcccacactgggcaccgccgtcgcggccaaggtggtcgacgccgggcagccggtcgtggataccgtcacgtccggggtggatgacggcgattcctgggcgtccggattggagttgcgggcgtccggatggtatttcgacgggctcggcgtgggcgatctgtccgagccggtcatgcctggtgccgacgagacggcgaaggagttcatcgcgaggctgggcacaatgggattccggccgtccgcttatggcgaggcgtcgttcactgctcccgggcagcgcgtggacgtgagagcaacggccgagccgggcggcgacgcggcgtatgaggcgccgcgaggtggaggattcggcacatgggtgtgggcgttcgaagtcgagaagttgagcgatactgcgcgacaatatataggtaaggatgtggtcagcgggttcctggaatacacggagacgaattcgaaccgtgctcgggtgagtgtggaatccacggtcacggagcataccggcgtggttggttccgaactgagcgacaccattacggtcgacggattccccgatgatcacggatcctttggcggcaatgtcaagcttggcatcggcgctgaccgggcgatggcgcaggtgagcgtgtggtgggcgggcgatccgaatgattccgccggcgacgaggcgtaccggcctcagggggagacgccgccggccgaggacagcaatcaccggttgattggcgtgtgggattatccggcggtcaacgggcgtatccgagtgggtgccggggcgccggacgctcatggcgatccggtgcacatcgtggccgaatcgcacggatggtacgtgttcgtttggagcttcgacggcgatgaccgggtgatgccggcgtccagcgcatacgatgacgcgtgggagcgcgtgcgcatatgggatgtggcacggccacgcaagccggcgctgaccacgcaggtggagccgggcattgtgcgggtcgatgagccgttccgcgatacggcgcggattgtgggcgatgtgcccgaaggggcctatgtgacgttcacggcgtacgaggcggtggaggaaggggcggtgcccggcatgaacggcgtgctgcttgacgaggcccgcgccgaagtggaccatacgctgttcgagcagacgatcgccagtccgcaggtgcgctcgccgaaggcgggactggtgtattggagagcgtcgcttcgctcgcgtgacggtgatgtgctggtttcgcatgagctcggcgtcgaaggggagaccgtaaccgtcgaagcgcctgatgatccacccgctgagccgaaggcggatccagagcccgagaagccggtgctgtctcataccggtgcgggggtcgtcgccatcatcgtcgtcggatccggagccgccgcggccgccatcggtgccctggccttccgccgccgatcccgtcgctgacgctgccgctggcgaaggttgtctagcgagaccgggggatggtttgaggcacttgagaaaggcgcaatagaacaggaaggctaggaatcttgtaattcctagccttctatttggcatggatttgaaccatgggcctcaatggtatatgggtcaggcgtgggcgttttcgcgacgtcgcatggtgcgcaaccggtcggcgacccatgtattgacgacggcgttgcggctgattgccagctcggcggcttcctcgtccagttcactgaccatccatgcgggcatcgtcagcgtgattcgcttctccagcgggggatgatgttcgactacgggattgccgagatcgacatagctgaggatgtcgtcgccgttgtcgaacatctcctcaaactggtcgctggtgatcgccttggcatcattttttggctttcatggcatgcctccttgttcttgcgcgatcggcgcacggatatgatgcggatgcgcttgccgcgtttggttgtaatcgccgtccaatgcctgccgtcgatcatcccgagcacgatgtggcgcacatcgtcgtttccgggattcggggcggtcagcgtcactggaggcgtcgagccggtcgacaagatcgcggccttccgcgtactacgatcagggttttgattctcgactccgtattagttatatacaaatcagttttatgtatggataaaagatatgtgtaacaatatcatggtttgtaaattcctaatccaagacttgaaagtaagtctatgcattgctaatctagttcacatgactgcagtgatggtctcgccggcgttaaaggcgcagaagcaagagctgagccttcaggatcgcgttacatacaacatgaaggttcttatcgctattcgacagacctctcagaaggatctggcgcaggctatgggaattgccgcaccgactctatcccagaagttcagtgggcgcacccgatggaacatggatgatatagaaaaagcctccgatttccttgatgtgaaaccggaggcattggtagcggggcatggatttgaaccatggacctctgggttatgagcccagcgagctaccgagctgctccaccccgcgccggctgttttcaaacagctctatctaagataggggagaatgcgagattgtcaaatcggcgtgtcggatttttgcgctgagtgaaatgccgggattgataaccggtcataactcatggcgataacctgacggcgtatcaatatcccggccattgccataataagaacatgcctatcaagatcccaagcggcctgcccgcgcgtgccatcctcgactcggaacgcatcttcgccctggagaagcccgaggcggagcgccagcgtgtgcgaccgctcaaattggtgatcctgaatctgatgcccaagaaggtcgaaaccgagacgcagctgctgcgcctgatctccaaatcgccgctgcaggtcgaaatcgacttcatgaagacatccacccacgaaccgacccatgtcagtcacgatcacctggtcaagttctatgagacgctggatgccttccgcgacaactactatgacggtttcgtcgtcaccggagccccggtcgagcacctgccgttcgaccaggtcgattactgggacgagttcaagtcgattctcgactgggcgagcacccatgtgttctccaccatgtacctgtgctggggcgcgatgggggcgctcaactaccggtatggcgtgcgcaaggttgacctgccggagaagatattcggggtgttcccgcagtacctgcaggacgagtactgcttcctgaccaatggtttcgacgagatcgcgctgcagccgcactcccgtctggcgggtgtgaacgaggccgacgtggcggcgaatcccgacttgcaagtgctcacttggggtccgcagtccgggcctggcctgatcgccactcgcgatttctccgaagtgttcgctctcggccattgggagtacggcaagacgacgctccaggaggagtacgagcgcgacatggcgagggggatgggcaacgtcccgttcccgcacaactacttcccgcatgacgatccgcaccttgagccgttgttcgcatggcgatcgcacgcgaatctgctgtggcgcaattggctgaactgggtgtatcagaccacgccgtacgatctcaccgaagtgcccggattgcgggcggagcgccggcttggcatcgatcgtttccgccacgcgcccgccggcccgcgcaaggacgatttctcaccgttcgtccatgacgactacggcgtgatacgtggcgaatgatggttctcgcctgcgctgcggtcgtttgacggggatctgggaccatcccggtcggctcccgctgatggtctttcggatctggagggtgcagatgacctcggaatcccgctgtaattgggcggagattcgagatttgttgcattagcacggtttggtgtccacatggcgtacaaaagagggccatcgccgtgctcaataggtggaataccgcctcttttgtccatgccttatgagcggtgtttaaaaaaccgtccaaataatgagacaatgaccaatatgttaacgctcacaaatttggagaagaaacgccgtacagcccttgaaaaataaggcatgttgcgtgttgtccaaggtggtcataggataatcacttagtcattcggagcggaatgtctgggcaggaactccggttggtcggtcttatgcccgggcagcttcgataacggctggacggacgatatccaaacgtcacattcgcctcaaccgttgggctaaactgacagctgataatgagagcaggaggcgcgatatggtagatgcggtcggtacgggcgcactattggcggccgacagcggtcccgaactgccaacggtcaatgattttcttcctcccgagatcctgttccagggaacccccttcgcgatcaatcgcatcatattgatccgcatcgtggcgaccgtggtgcttctcgtggtgctcggtatcacggcgaagcgcgccaagctcatccccggccgctggcaaggcgtggtcgagatgggcatcgacttcgtgcgcgacagcgtcgtatatcaggtcatgggcgagctgcgcggcaagcgctacgtgccgatgatttcgacgttgttcttcacgatcttcgtgttcaacctgtgcggcatcatccccggcatgaacatggcggccaccgccacagtggtcatgccgctggtgttcgcggtctgggtgctcatccagtactggatcaccgcagcacgcgagaagggcctgtggggctacatccgcgacgagtgcttccccaagggagtgccgtggccggtgtacatcctgctggcgccgatccagctgtgcgagctggtgctgatccgccccgcatcgctgaccatccgtctgttcgccaacatgatctccgggcacttgctcgtggcatcctgcctggcgtttgcgcagtactgggtcatcgacgcgaccaataagcttgccggcatccccgtcggcgcgctgtggttcgtcttcggtttggtgctcaccctgttcgaggcgttcgtcgccttcctgcaggcctacgtgttcgccatcctctcgacggtgtacatcagcatgagctacccggaggaatgagccgcacccgcgtgagactcaccacggacaatacgaatactttgcaattcccgagacaactgaagaaattaaccaagtttttttaacggttacgttagaaaggaaacagaaatggacatcattactctcgctcaggtcaccggcagcctttccgtcatcggctacggcctcgcgaccctcggccccggcctcggcctgggcatcctgttcggcaaggcgatggagtccaccgcccgtcagcccgaggtgagcggcaagatccagatgatcatgttcatcggcctcgcactggtcgaggtgctgggtctgctcggcttcgtggccgccctgatcgttaagtgagacgacaggcgacgattcacacgtttattcgacattgaaaggagggcttcatgatgacaatagccgcaagtgacggcctcaagctgttcattccgcaggtctacgacatcgtgtggtccctgatcatccttgtcatcgtcgcgctgttcttccacaagttcttcatgccgaaattcaacgccatcttcgatgagcgtgcggcgaagatcgaaggcaacatcgccaaggcagagcagtccaagaaggatgccgacgccgccaagagcaagtacgaggcccagctgagcaccgctcgcgtcgaagcctccaagattcgtgacgacgcccgtgccgaagcttcccacatcatcgccgacgcacgctcccgcgcggagtccgacgccgcccagatcaccgccaacgcgcagcgctccatcgagtcgcagcagcagcaggcgctggtctccctcaagggcgaagtcggtactcttgccacggccctggccggcaagattctcggtgccaagcttgaaagcgacgacgtgcagtcctcgatgatcgacaagatgatcgacgacctggacacgaacgacaagaagtgattccggcgttccggaaagggaggtgaccaatgcgaggagaggcatcccgcatctcggatcgcgtttcgcgtgacgagttggcgcccaagctgcgctcgaccggcaaggacgcatggcgtatcggcaacgaactgttcacgatcaccaacgtgcttgaccacaccgtgcagctcgaacgcgctctcaccgatccgtcacgtccggtcgacgacaagatcggcgtgctcaaggagctcatcggtgcccaggcccatcccatgaccctggagatcatgagcgatctggtcggtcgcaaatggagccgtgccgcgcacatcgccaacgccgtcgaagacttcggcgttgacgccatgatgtactacgcggatgccgcgggcgtcaccctgcgcgtgtccgtggaactggccgagctgcattccgcgctgctcaacctgccggttctgcgttcgaagctcaatgacgacagcgtacccgccaaggcgcgcatcgatctgctgaacgccgtgctgggcaagaccgagttcaacgaggtcacgctccggctggcggaacacgccgcgtgcaacccgcgcaaccggcgctatctggagaccatccagtggctgatcaacaagttctcgcgccacatgggcgagtcgatgattaccgtgaccaccgcgtcgccgctgaacatcgaccagatcaagcgactgaccgccgtatattccgcgaagctcgaccatccggtgcacatcaactcggtcgtcgaccccacggtcctcggcggcatgcgcatccaggtcggcgacgaggtcacggacaacaccgtggtcgcccagctccagcagctgcaccgcacggtaagggcgaaagcctgacgatacggttccgggccgcgccacacgcggcgacggagtccgacttgaaattttccaacaataaggagtgatcatggcagaacttaccattgatcccgccacgatacgcaaggcgctcgatgatttcgtcgagtcgtacaagccgagtgacacccccacccaggaagtgggctatgtcgcgacggccggcgacggcattgcgcacgtgacgggactgcctggttgcatggccaacgagctgctgaccttcgaggacggcacgctcggcctggcgttcaatcttgatgcccgtgagatcggcgtggttatcctcggcgatttcgcaggtatcgaggaaggccaggaggtccgacgcaccggcgaagtgctctccgtgcccgtcggcgacggctatctcggccgcaccgtggacccgctgggcaacccgatcgatggtctgggtgaaatcaagggcattgaagggcgtcgaatcctcgaagcccaggctcctgacgttatgcaccgtcatcccgtcgacgaaccgctgtccaccggcctgaaggccatcgacgcgatgacgccgatcggccgcggccagcgtcagctcatcatcggagaccgccagaccggcaagaccgcaatcgcgatcgacaccatcatcaaccagaagaagaactgggagacgggcgacccgaagaagcaggtgcgctgcatctacgtggccatcggtcagaagggttcgaccatcgcatccgtgcgccagagcctcgaagaggccggtgccatggagtacaccaccatcgtggcctccccggcttccgattccgcaggcttcaagtacatcgcgccgtacaccggctcggccatcggccagcactggatgtaccacggcaagcacgtgctcatcgtcttcgacgacctgtcgaagcaggctgaagcctaccgttcgatctcgctgctgctgcgccgcccgccggggcgtgaagcgtaccctggcgacgtcttctacctgcattcgcgtctgctcgaacgctgcgcgaaggtctccgacgatctgggtggcggttccatgaccggcctgccgatcgtcgagaccaaggcgaacgacgtgtccgcgtacatcccgaccaacgtgatctccatcaccgacggccagatcttcctgcagtccgatctgttcaacgccaaccagcgtcccgccgtggacgtcggcatctcggtctcccgagtcggtggcgccgcacagaccaaggccctgaagaaggtctccggcacgctgaagatctcgctggcgcagtaccgttcgctggaatccttcgcgatgttcgcgtctgatctggacgccgcgtccaagaaccagctgaaccgtggctcgcacctgaccgagctgctcaagcagccgcagttctcgccgtattcgatggaacaggaagtcgtctccgtgtgggccggcacccatggcaagatggatgatctgccgctgggcgacgtgctgccgttcgagcacgcgctgctcgattacctggagcacagcaccgacatcctcaagaccatccgtgagaccgagaacttcacgcctgacaccgaagccgccttggacgaggccgtcgaagcgttccgcgagacgtacgtgaccaaggccggcaagccgctggtcgtgaagaagtcctcgacgcgcaagcccgtgcccgtggagcaggagaagatcatcgccaaggccgacaagcccgcgcacgatccgaccaagcacccgatggctggagaaaagaagtagcccatgggatcgcaactcgcattgaagggcaggatcgcctctacgggatcgctggagaagattttcaacgcccaggagatgatagcgtcttcgcatatcgccaaggcccgtgacgtggccctgaacgcgaagccgtacgccgatgcgattttcgatgccgttcaggctgtggtagcccacacccgtatcacgcatccgattgtcaagaaggaggaggacaaccccaaggttgccgtcctcgccttgacggcggatcgtggcatggccggcgcatacacctcgtcgatcatccgtgagaccgaggaactgctcacgcgactcgacgacgccggcaagcagccggaactctacgtgtatggccggcgcggcgtgacgtactacaagtaccgcaaccgcgcgatcgccgacacgtgggagggggataccgacaagccgggcgttgaaatcgccgaggccatctccaacgcactgatgaccgcctacatgaagccggccagcgagggcggggtctccgaactctacatcgtctacaccgagttcatcaacatggtggtgcagaaggtgcgcgtgctgcgtatgcttcccgtcgaagtggtcgaggccaaggtcgaatccggcccgggcatgtcgcgcgagagcgagggcgacaacgccgcaagctccaaggtgcgcccgttgtaccgcttcgagcccagcctggacaaggtgatggatgccatcctgccgaagtacatccagtcgcgtattcacgaatgcctgctggaggcggccgcgtccgagaccgcgagcaggcagaacgccatgcacacggcgacggagaacgcgcgtaacctgatcgactcgctgacccgtaagatgaacgcctcccgtcaggcgtccatcacccaggaacttaccgaaatcatcggcagcgccgacgcgctgaacacaaaggaagagtaggaacgcatatggctgacaatcagaccacagcggctcccgagacggctgcagagccgatcaatggacgtgtgacgcgtatccagggttcggttatcgacgtcgaattcccggtgggccacctgcccgatatctacaacgccctgaccgtcgagctgaccaacaccggcgctcacgaggaaggcgagaccgcgcacacgatcacgcttgaggtcgagcagcaccttggcgactccaccgtgcgcgccgtggccctgaagcccaccgacggcctcgtccgcggcgcttcggtgcacgacacaggcagctcgatttccgtgcccgtcggcgacgtgaccctgggccacgtgttcgacgtgaccggtcacgtgctgaacaagaaggccgacgagaccatcaaggtcaccgaacgctggcccatccaccgcaagccgccggcattcgaccagctggagtccaagacccagatgttcgaaaccggcatcaaggtcatcgatctgctgaccccgtacgtgcagggcggcaagatcggtctgttcggtggcgcaggcgtcggcaagaccgtgctgatccaggagatgatccagcgcgtcgcccagaaccacggcggcgtgtccgtgttcgccggcgtcggcgagcgtacccgtgagggcaacgacctcatcggcgagatgggcgaggccggcgttctggagaagaccgcactggtcttcggccagatggatgagcagccgggcacccgtctgcgcgtcccgctgaccgcactgaccatggccgagtacttccgcgacgtgcagaaccaggacgtgctgttgttcatcgacaacatcttccgcttcacgcaggccggctccgaggtctccacgctgctgggccgcatgccctccgccgtgggttaccagccgaacctggccgacgagatgggctccctccaggagcgcatcacctcgacccgaggccactccatcacctcgctgcaggccatctacgtgcccgccgacgattacaccgacccggccccggcgacgactttcgcccacctggacgcgaccaccgagctttctcgtgacatcgcatccaagggcatctacccggccgtcgacccgctgagctccacctcgcgaatccttgatccgcgttacgtcggccaggcccactacgactgcgccaaccgcgtcaaggccattctgcagcgtaacaaggagctgcaggacatcatcgccctgattggtatcgacgagctttcggaagaggacaagaccaccgtcaaccgcgcccgccgcatcgagcagttcctcggccagaacttctacgtggccgagaaattcaccggtcgtccgggctcctacgtgccggccgacgagaccatcgaggccttcacccgcatctgcgacggcgtttacgacgacgtcccggagcaggcgttctccggcatcggcggcatcgacgacctcgaaaagaagtggcacgatctgcagaaggaacttggtgagtgatggctgaatcgtcaaaggccctgatgcaggtcaacatcgtcgccgccgatcacccggtgtggcacggcacggcgaagtccgtcaccatccccgcctccgaaggcgagatgggtattctggccgaccacgagccggtgctcacggtgatcaagggaggcacggtttcggtcgtggatcccgcaggtgagcgccatgcgttcgaggtcagtgacggattcatctccttcgatttcaacaagctcacggttgccgtcgaacgcggccgtgatgtggtccgcactgaaggacccggtatcgaatagcgagctcttcggcacggcagcggctgtgccgttgcgctcgcactgggcgtcgtctgcatcccgcaggcggcgccctttttgtgttatctactcggtgttatcccccgtcaatgcccggcgcactccaccattcccaccaaaatacgggttgaaatagccgaaatccgcaattccccgtgtgaaatcgccgtttttggatcctgaaacggcgatttcacacggggaattgttcaaaacggcgatttcaacccgtattttggcgttcgatacgctcgcgctgtcggcgcggccgtacggttcgtgcctgttactggtccgagaggcgctccctcccttccgcgcgtactgtacactggtgtgacgtgcgcgttattgttgctgattgctctgctgaatattccggtcgcctcagtgcgtcgcttcctcccgcgaagcgcgttctgctcataaaggccgacaacagtctgctgatcttctccgaactcggctcatacaagccgctcaactggatggctgcgccctgcactttgaaggacgtcaccccggactctgttgaggccgcggacgggcctgcccccgagcatatccttcgcgtctgcgccgacaagaccagcgacgtcttggaagtctccctgtaccacgtctactccgacaccacctatgacctcggcatcgatcccggcctcatcaaggacggcgtcgaagaccacctccagcgttatctctccgaacagatcgaccgcatcggccccggctccaagctcatccgccgcgaataccccaccgccatcggccccgtcgacatcatggccctcaacgccgacggcgagcacgtcgccatcgagatcaaacgccacggcggcatcgacggcgtcgagcagctcacccgctactgcgagctcctcaaccgcgaccccctcctcgcccccgtccacggcatcttcgccgcccagaccatcacccctcaggcccgcgtcctcgcccaggaccgcggtttcgaatgcctcatcctcgattatgacgagatgaagggtagggaagatgattcccttcgcctcttctgaacacgcctgaacacaccgcgatggcgcgttacctgcgttgctcctcagtcgcggtacctttgtaccgcttccttcggtgcgtcttggtaccgcgcgcatcgcggcgtgttcaggggtgtgttgtgtggtggcgcgttgccggcgttgctcctcagtcgcggtgcgctcaggcggtatgcatgcggcccagggcgatggcggtgcgtaacacataggcctcgcgcgcgtcggcggcgtcccagccggtggtttcggcggcccgcttcaaacggtaccgcaccgtgttcgggtgtacgctcaattccttggccgtggtctccaacgagccgccgttgcgcaggaacgtggacacggtctccaaagtaggatcgtccggccccgccgtctgcagactggcatataccgtattcaccagctcgtccacggcatcctgatcccccagcagcgcccgctcaggaagcacgtcatcggcacgcatcgggcgcggaacctgcggcaatgcgggagccgccgcaatcgccgaacggaccgcctgcaccgtgcggcaggcaccctcgacaccgcggcgcaaaggtcccaggcacaccggcgccttcgtcgagaacgccgacagtgtattggtacacgtcacatcgggcgtcgccgccgcacgcggcatgatcagcgccacgcacagaccgttcgtcgtccccgtcacgcacggtccgccgcccagatcatgcacggtcctgcggatcgcggcccttgtgcccgccatcgtgtgcaacggcttgccaccgatggcaaagcacagaaaatcatccgaaaaatcaagaatccccagaatcgccgcggtacgctcatccgccaacccattgaccagacacgcgaacgccaccgattccagtcgggaatcggcgtcatcctgagcggaaccactgctcagcaggtcaagaaagtcaacggaaccatgctccgtgtcgaaatcggtcataccgtccagcatagccgaaccgtctgcaagcgtcaccagtcgtcaccggatgtccgcgttgcgccgcgcccgctgcgactcccgccagaacgtgagcaccacgaatccgaacacgaacgccaccggcagcatatgtcgctcgaaattgttcgcgggcgcggtgatcatcacgcccatgagcagcagcagcggcagatgcatgaccagtgtgcgccaccggcgaagcaccacttcggccgcgccgatcagcagcgtcatcatcacatacaggttgccgtgagccacccatcccagcaccggaatctcaccgaactgctttgcgccctcggcgatggactgccgccactcgctgcaccagtatttgatccacgtggtctggtctgtcacataatcgctgttcacgtagtaatccatcgacacgtacggctgatccatcgggttgaaatagccgaagcacttcgccagcagcgcgtcgatggcggtgacgggatcggccttgacgatctgccaccaggcgctattgaaccgggccatgtcctcctgtgtgaccgaccgccagcggtagcttaccttcttcgactggatgccggacgacttcaccgggtcggcatcctgcggctggtaggcgtcggccatctgatcgagattgaagatcggcgcgatctcctccctggcggactgcggtatgctgcccggattgcgcttggcgatgcgggcgatctgctgcagctggacgccgtggctttcgatcggatcgccgctgatgatcgcaccggtgcgggtcagcatcacgacgccgccatgcagcacgatgaccggcagcagcaacgcgacgacgtacgccttccagcggcgatggtcggaaagcagcgcaagaatcagctgcagcacgatgatgtaccaagcgtacttcgcgctcgccagcatcaccacgcaggccaggatcaatgcgataaggctgcggcggcgcagcctgaccaccttgtcgcccttgcctcgccacgtacggaacagctcgtaccacacgccgaacgcccacacgaacgagaacgcgaacagaggcgatttcgtcagcgagatcgtcgagaacaccgcgagcggacagcataggaagaacaggataatcaccagacgcgagaaccatcccgaggcgccttcgggcaggcgtccgttcccggcacatgcccgcgccgcgaagccgggggaggcgtacccgcgctccggatgcgtgaaatcaagcatgaccagtgccatcagcccgcgttcgggatgcgtgaagtcaatgccggcgcggcgcggcagccacggcaagttgaagaaccggttggcggtggcggcgcagcagaacgcggcgaacaggaactgcgcggatgacagcaccacgaatccgacatcgttggaatcggtgaaataccgggagaccgacagcacggcaccatacagtaccgtcagcacgatgttgtgctgatcggtcaggtacgtcggattcgacggccatatgtagtgcgcggtcggatagatgtccatcggcacgaatgagaagaatccgatatacggctgatccaggccggtccattggttccaggcccagctgaactcgcgagcctgagagcggatgtcggcgccgaacgcggacagcagcgtcgtcggcacccaaagccagccgatgaacaggatcagtgcgattttccaccaccggtcggtggcacgtacgcatacccgggcgaggaaccgtccggtccggctgacccacgagccgggagcggatgccaggagccgcgcggccgcgcgacgtgcgcccgccggaatcaggcgccgtggatgcaggccgttcttgccgctggaccagccgaacaccggtatgccgttcgcccagcgagtcattgcgaccacggcggcgaatggtacaaggaatccgacaacggcaaacaaccagttcaccgcgccgaaatccgcgatcgaggagtctgcccagtagagcggccccaccgccacgcacaaggcgatccacaggcaggccgcgacggccagcgtccatcgcgccacggccgcgagacgcgcgagggcgatgccggtggcgcgtcgtgacctgccgccgctgcctccgcgcccgccgcgggccggggtggcgctggagtgatccgtgatgtgagctgtggtcatgtcatggtattctaccgatgcgccttgaacggcggcgatcgtgccattgccggcatttgccgtaggacgatatcgggcataatctgaaggcatgtcggaaacaacaaggggaatcattccaaacatgccacgcaccaccgaggtggctgacaatgtgattgcggtggtggaaaccgcatcgaccaatacgctggcgcggcagatgctgcgcgacggcaccatggcgcctccggccgacgggggtgccggtgtggccgtggtggccactgatgtgcagagcgcgggccgcggccggctggaacgcacatgggtgagtgctcccggcgaatcgatgacctgctcgtacatcgccacgctgccggcgggcgtgatcgccgacggcagcgtaaacggctggctgacggtgatcgccgggtttgccgcgctggatgcgctgcggggcgcgctcgccgaatgtggggtggccagtgaagattgcggtctgcggctcaagtggccgaatgacctgttctgccagggacgcaagctgggtggcatcctcaccgagatggtgccgctgcctgggcgcgatgacagcgcggcgctggtgatcggcatcggcatcaacctcgcgataccggccgaccggttgcccacggagcagtccacgtcactgcaactgcatgtgcaagggctgcccgatgcccggacactgcgtgatatgatcgccgcgcatatcgtgcggtcgctgagttcccgactgagcggtttcgtggcagacccgcatgccgccgccgagcggctgcgcgaggagacctcctgcgtgtgctggacgctgggacgtcgtgttgaggcgcgcttcaccgatggttcggtgctgaccggtacggcgacggcgctgaacgccgatgcgtcgctgagcgtgcgtgacgatgcgggcgaaaaccatgtcgtgcacacggccgacgtcggcgtattgccgctgtagtcgcagcgaacggttctcaataagaaaggtgtgagcctgcatccgtccgaaatgaacaaaaaatatggaagaagcccggaattccgggcttcttccatatgagcgtttgtgcgggaatgttagaaatcctcgcacaaacgctattgagaaccgttcgctgcgacaacagcgacgcgaatcagaacagcttggccagaccggtcgccgcgagcgacgcgacgacggccttgatgacatcgccgatcacgaagcccatcgacgcaatcgccacggtcgtgaacggaacatgcatgaccatggactgaatcgtgatgccgaacaggtacagcaccaccaggttgccggccagtgaggcgccgaagtagcggacggcggtcagcgcggcgtgcggagccgagtcaagacgcgccttgccgcgtagcagggcggtgacgattacggccggcaggaagccgatcaggaagcccgcgctcgggccgaacagggcggcggtggaggcgccgccggcgaacaccggcagtccggccgcgccggcggccagatacagcaccaccgcgctgcctgcctgacgccagctgagcatcagacctgccagcatcatgacgaaggtctgcagcgtgatcggcaccggggtgccagggatcgaaatctcaccagctgccgaagcgagccacatgaggacggcgaacagcaccggcttgccgatggtcgaagccagcatacggccgcgctgggcggtggaaacagtacgttcggacatgaataacccctctcgatgatgaaagaacggacggcgagtgtccccccgttgtcgccaatgatagaaagccctcgccttagacggcctgtcgggaacatacaaaagtcgagacggccttttgtggatgttcgccggttacggtgccggaacttacgtggccgtttgtcttcgctctacaaaatatcgccgccgtttttgtcgaaaacttgactccgcgctcgcgcgcatacggcgatagtggaatatatgggaaatatcgtcaaaaaaatactcgtcgccaaccgcggcgagatcgcgctgcgcgtggtgagaaccgcccgggagatggggatttccacggtggcggtgtactccgaacaggaccgcaacgcccagtacgtccagctggccgacgagtcgtacctgctgtcgggtgacacatacgcgagcacatacctcaacgaggacctgttgatcggcatcctgcaccggtccggcgcgaacgccgtgcaccccggctacggattcctctccgaggtgccgagcttcgccgacaaggtcgagaaagcgggcgcgatctgggtggggccgcatccgcaggcgctgatcgacctcggcgacaagatcaccgcgcgtcgcgtggcgaagtccgcgcaggtgccgccggtgccgggcatcagcgagccggtgcgcgagctgcgcacgctgctggacttctcgcacacgtacggctacccggtgatgatgaagcgcaccgacggcggtggcggccgaggcatcaccgtcgtgcacgacgatgacgagatgcgtcgcttctacatgaaccatgacgcgatgcagggcggcgacctggacgagtacttcatcgagaagttcatcgacaaggcccgccacgtggagacccagtgcggccgcgaccgtttcggcgacttcaccgtgtactcgacgcgtgactgctctgtgcagcggcgcaaccagaagctcgtcgaggaggcccccgctccgttcctgccggacgaggtcatcaaccagctggagacgtattcgcgcagcctgttcaacaaggtcgactacatcggtctgggcacgtgcgagttcatggtgaccccgcatcgcaaggtgtacttcctggaggtcaacccgcgtctgcaggtcgagcacacggtcagcgaggaggtgtgcgggctcgacctggtgcgcgagcagatcgatatcgccgacggcggccacctgacaccggcccccgcgccgcgcggccacagcttcgagctgcgcatcaccagcgaggatccggcgacgaacctgacgccgtcctccggcacgctggagcgcatcgtctggccgtccggccccggcctgcgcatcgataccggcgtggagcagggagacacggtctcgccgaagttcgattcgatgatgggcaaggtcgtgatcaccgcgcagagccgtgaggcggctgtcgcccgcgtgcgccgcgcgctcgacgaactcgtgatcgagggcgtgccgaccccggtcagcctgttcaagcagatcttcaacgacgatgagttcaccgccgagcatggtcatctcttcgacgtgagcacgaagtggctggagcgcaagtacctcaaccatgagccgcagaccgtgcgctcgggacagccggcgtcgctcagcggcgaaggccaggacgccggcgcgaaggccccgacgagcgaaagcttcgtcatcgaggtcgacgaccgccgtgtcaagctcaccgtgccgaccgacatcgtcaacaacctcatgggagcggggcgttcgcgcggagccaagcgcccgtcgcagccgctgcgaggccaggggctgcacgccatcgcggagaagaaggagcacaacgacggcaagtccggcgtcatcgcctcgcccatgcaggcggtggtcacgcgcatcaacgtcgcggaaggccagtccgtcaccaagggcgacctgctggtggtgctggagtcgatgaagatggagaactacgtgtacgcgccggtcaacggcacggtcgcgaagatcttcgtcgcgcccgccaccggcgtcgaggccggcgagacgctggtcgcgatggacgtcgacggcgccaaggcgcgcgacaagtccggcgcggtggatgacggcggcaagtccgcaagcaccgcgaagaacggcaaggagggcaagtgatgaccgatatcatgaactcgccggccgtgaaacaggtcatgaaacaacctgggcacgtctcggcggacggcgccgcacaggcgcagggcgagcagccgatccgcgcagcggtggtacgcgcggcggaactcgcgcgtgacgctgaatccaacgcgcgcacccgccagcacgccaagggcaagatgaccgcccgcgagcggctcggactgctgctcgacaccggctcgttcgaggagatcggccggttccgcggcggcgacatcaacggcggcaaggccggttcggccgtcatcaccggattcggtgacgtgtacggccgcaagatcgccgtctacgcgcaggacttctccgtcaggggaggcacgctgggtcgtgccgaaggcgagaagatctgccacctgatggacatggcgctggacctgaaggtgccgatcgtcgcgatcgtcgactccggcggcgcccgcatccaggaaggcgtcgccgcgctgacgcagtacggccacatcttccgcaagacctgcgacgccagcggcttcgtcccgcagatctcgctgatcctgggtccgtgcgccggcggcgccgtgtactgcccggcgctgaccgacctgatcgtcatgaccaaggagaactccgacatgttcgtcaccggcccggacgtcgtcaaggcggccaccggtgagacgatcagcatgaacgacctcggcggcggactcgtgcacagcacgaaatccggcgttgcgcactacctcggcgaggacgaggccgacgcgatcgactacgcgcgcacggtgcttgcctacctgccgtcgaacagcgacgcccagcccccgatgtacgcctatgcggcgactcgcgcggaccgcgagaccgcgaaacgccttaccgacatcgtgccggacaacgaccgccagccgtatgacgtgctcgacgtgatccgctgcatcgtcgactacggcgaattcgtgcaggtgcacgagctgttcgccacgtccgccgtcgtcggattcgcctgcatcgacggccggccgatcggcgtggtcgccaaccagccgaacgttcgcgccggcatcctcgacgtggacgcctccgaaaaggtggcgcggttcgtgcgtctgtgcgactcgttcaacctgccggtcatcacgctcgtggacacccccggatacaagccgggcgccgatcaggagcacgccggcatcatccgccgcggcgccaaggtgatctacgcttacgcgaacgcgcaggtgccgatggtcaccgtcgtgctgcgcaaggcgttcggcggcgcgtacatcgtgatgggatccaaggcgatcggcgcggacatgaacttcgcgtggcccagctcgcagatcgcggtgctcggcgccaccggcgcggtgaacatcatccaccgcaaggacttcgtcaaggccaaggaggccggcgaggacgtcgacgcgctgcgggccaagctcgccgccgaatacgagcgcaccaccgtcaacgcgaacctgtcgctcgaaatgggcgagatcgacgcgatgatcgatcccgagcagacccgtcaggccatcgccgaatcgctgcgactgctcgccgacaagaagcgcgtgcgccgcaccaccaagcatcacggcaaccagccgctgtagtccatcccgccgcggcggccactccgcggcacaacagattttgagccgataccggcaatggcggctccgcacaatgtccaaataaaagaaggaacaccaacccatgtcagaccccaatttctttctcagtcggctcaacggcgaacctcatgcgctcgctttcggcggacagtccacaccctggccggttgcgctcgctgacctgaccaatgatccggcgctcgaagccacgctgcgcggccatgtcgccgcggcgaacacgatgctcgcccccgtggccgccgacctgcttgccaccaccggacgcgccgtcgacctgttcggcttcaagccgaccccggcacggctcggtgccgccgccgcggcgaccgtcagcgtcgaaggcatcgcactcactcagctcggcgcgctgatcgacgccgccggtctcggccttgacgtggcgaacaccgcccccgtcgccgtgctcggccattcgcagggcgtgcttggcgcgcacatggtcaacgtcatccgcaaggccggctccatcgaggccgcgggccagcagatcgacgagatcctggccatcgccgagctgatcggcgtggccggcacccgcaaggcgcgcgagctcgcgctcaccgcgcagcacgccggcgccactccgatgctgtctgtgcgcggcgccaccaagcgccaggtcgaggtgctcgcatcccgcgtgccgaacccgcgcggcccgatcagcatcgccgtcaccaactccagcaacaaccacgtgctctccggctacccggaggaccttgccgccttcgaggtcgaggccggcaaggagcacaagcgtcagcagacactgcgtgacgagaaggtccgcggcggcgcggtgttcgggcccgtcctcgaatacctggaggtcacgctgccgttccactcgccgctgatggccgatgccgtcgagcaggccgtggcctgggcgcacgcctgcggcttcaaggagacccgtacgcgcgagctggccgccgaagtgctgctcaaccacgtcgattgggcggcccgcgtcaaggcgatgctggaatcctgcgatccgtccaagctgtggatcgtcgacttcggcccgggcaacacgctcggcaagctcatcggcaacctgatccagggcaccggcgtcggcgtggtcgaagccaccacgatggccgagcgttccgcgctgtccaccatggaggacgagcccgtccgcacccagaactggaagacgttcgcgccgaaggtgttgcacactcccgccggcgacaagatccgcaccaagttcaccgacctgaccggcaaaccgccggtgctgctgcccggcatgaccccgaccaccgtggatcccgagatcgtggccgcggccgcgaacgccggctattgggccgagatcggcggcggcggccaggtgaccgccgacgtgttcgaccgtcatgtcgccgagctggagaacctgctcgaagaaggccgcacggtcgaattcaacgcgatgttcatggatcgctacctttggaacctgcagttcggcccctccggcatcgtgccgaagaagcgcgcgtccggcacgccgatcgacggcgtgatcgtctcggccggcatccccgagctcgacgaggccaaggcgctcgtcgcctccctgcaggcggacggcctgccctacgtcggcttcaagcccggcaccgtcgcgcagatccgccaggtcgtggcgattgccaaggccgtggcccccacgacgatcctgatgcaggtcgaaggcggttcggccggcggccaccactcctgggagtcgctggacgacctgctgacctccacctacgccgaggtgcgcgcatgcagcaacctcgtgctggtcgccggcggcggcatcggtacgccggagcgcgcggccgactacatctccggccagtgggcgcgcgcctacgacctgcccgacatgccggtcgacggcgtgctcatcggcaccgccgtcatgaccgccaaggaggcccacaccagccccgcggtcaagcagctgctcgtcaagacacccggcatcaccgacacgtcggccgacgccgacccgttcgcgcccgccggcgagaagtgggtgccgtccggcaagtcagtcggcggagtctcctccggcctgagccaccttcacgccgacatctacgaggtcgagaacgcctccgccgcctgcggtcgtctgctggtgcgcgtcatgaagcaccccgaagagctggaaagccgccgcgacgagatcatcaaggcgctcgacgccaccgccaagccgtacttcggcgacctcgcctcgatgacctacgtcgagtgggccgagcgtttcgtcgacctggtgttccccgtggtcgacccgacgtattcgctgcgcttcctgcacctgctgcagcgcatcgaagcccgtgtgtgcggtcaggaatccggcgagttcacctcgctgttcgccggcgtggacgatgtcgcctccgatccgaaggccgccatcgccaagctggaagccgcctacccgcaggttgccgaaatccacgtgaccccggccgatgtggcttggttcccggtactcgtgagcgaatatcccaagcccatgccgttcgtgccggtcatcgacaatgacctgctgcgccggtggggccaggatcagctgtggcagtccgaggacgcccgctattccgccgattccgtgcgcgtgattcccggcccgatctccgtggccggcatcaccaccgtcgacgagcccgtcgcccacatcctcggccgtttcgaggccgcggccctggagcgcacccgcgaactgcagtccggtgcctccaccgacgcctacagcgagctcggcggcgccgagagcgccgaagcgttcatccgcacctgcccgaatatctcctgggtcggccacctgaccacgaacccggcatacggaacgcaggtcggcgacgccaactatgagatcatcgaccgcggcgcttccgagcagggcgaggaatacgacctcgacatccatctcgacacgtactgggacaacgatccggacggtggcgtctccaagcacgccgtgcgcgacatcgtcatcccgttgacgctgcgcggcaccgaaaccggcctgctgccggtcgtcaaccgcgagcgcctggtcggcaacgtctacgcgatgctcgccgccaccgcaggcatcggcaacaccgccatcaccggcgacaagctgaccgacatgccgaagatcaccccgtccgacgacaaggccgcctacccgttcggcaccgcgtcggccacctacacgctgtccgccaacctcggctacgaccacgaggcggccaccggcggcgcgctgccgcaggacctcgcgccctcgcgcatcgcccccgacgcgctggtcggcccggcatggccggcgatctacgcggcgctcggctccgtgtacgtcaagggctacccggtcatcgagggactgctcaacgcggtgcatctcgaccacctcatcgagcttgaggagaccgaggacgagctgctgaagcacgtcgacgagaccatcacgctcaccagctgggccgaggactacttcgagtccgcgtccggccgcgtcgtgaccatccacgtgctgcacaccgccgccgacggcaccgtgctcgcccgcgagaccgagcgcttcgccattcgcggccgcgtctactccgacgtgctgccggccgacgcccccgaatacggtggcgccctcgaagccaagcaggaggacgactccgccgcagccacggtgcaggccacgcctcgccgtctgctgcgccgcgtcaccgtcaccgcacccgatgacatgactgcattcgcgcgtacctccggcgacttcaatccgatccacacctccacgcgcggcgcccgcatctccgggctcgccgccccgctggtgcacggcatgtggctgtccgccaccgcccagcacgccgtccaggcgctggacgacaagggtgctcactacgagatcgcaggctggacctacaacatgtacggcatggtacagctcgacgacaaggtggagatctccatcgagcgcgtcggcaaggtcgagcacggcggcatggcattcgaagtgacctgccgcatcgacggtcagctggtctcgcgcggcactgcgctggtccgcgcgccgaagtccgcgttcgtctaccccggccagggcatccagaaacagggcatggtgcttgacgagcgtgccaagtcgtccgccgcccgcagcgtgtgggagcgcgccgacaagctgacccgctccaagctgggcttctcgatcctcgcggtcgtgcgcgacaacccgaaggagctcaccgccaacggcgtgacctaccgtcacccggacggcctgctcaacctcacccagttcacgcaggtggcgctcgccacggtggcctacgcccagaccgcgcgtctgcgcgaggccggctccgacatctggccggcgtacttcgcgggccactcgctcggcgagtacaacgcgctgtccgcgttcgccgacatcatcccgctggaaaccgagctggaactggtgttccaccgcggctccaccatgcaccacctgatcgagcgcgacgcccagggccgctcgaactaccgcatgggcgcgctgcgtccgaaccagttcggcgtcaacgacgcgcacgtcaaggaatacgtcgagtccgtcgccaaggcgtccggcgagtttctggagatcgtgaactacaacctcgccggccagcagtacgcgatcgccggcacgatcgccggcctgaagtacctgcaggccgacgcgtcccgccgcgccaaggaatatggcggcaagccgccgttcatgctggtgccgggcatcgacgtgccgttccactccacgctgcttcgcaagggcgtgccggagttccgcgataagctcgacgcgctgctgccgcagtacatcgactaccgtggccgtctggtcgaccgttacatcccgaacctggtggcgtccccgttcgagatgacgaaggaattcgccgccaagatcctcgaagtcgtgccgtccgagcgcatcaaggccgctctggacgacccggcagtgtgggactcctacgccgccgacgaccagaagctcggccgtctgctgctcaccgaactgctgtcgtggcagttcgcgtcccccgtgcgctggatcgagacccaggcgctgctgttcaaccccgccaaccgcggtggtctcggcgtggaggagtacgtggaggttggtctcggcaactcgccgacgctcgccaatctcggctccaagacgctgcgactgcccgatttctcgggttgtgacgtgaccgtgtacaacgtcggccgcgatgagggccgtgtgtacatgaccgactctgattcgctggtgccggacgatgagccggaggagaccgagacctcggcgcccgctgctgctccggctccggctgcgcccgctgccgccgcgcccgccgcggctccggcagtcgtcgccgcgccgtccgccgctcaggtcggttccgccgtcgccgaactcggttccgccgtcagcggcccggtcgacgacctgccgttcaaggcgtccgacgccatcggtgtgctcatggcttactccacaaagatccgcctcgaccaaatcggcgcgaacgacacgaccgacacgctgaccaatggcgtgtcgtcccgccgcaaccagctgctgatggatatcagctccgagctgggtgtggccagtgtggatggcgccgcagaggcgacgctcacccagcttgcacagctcgtcaacaaggtcgccccgaactacaaggcgttcggcccggtactgtctgatgcgatccgtgaccgcctgcgcgcgctgttcggtgccgccggcgtcaagcccgcgcacatccgcgaacgcgtgaccaacgtgtggcagctcggcgaaggctgggttgccgccgtgaccgcggccctgctgctcgacacccgcgagggtgccagctcgcgtggcggtgatctggccaagctgcccaccggcgccgccgccaatgcggccgccgccgatcagctcatcgacgatgcggtggccctggtcgggcagaccaagggcgtggctgtctccaagccgagcgccggcggcgcagccggcggtgccgtggtggattccgcggcgctcgacgccttcgcggagaaggtcaccggtgccaacggcgtgctcgcctccaccgcccgttacgtgctcaacgaactgggcgtgacggctccggccgccgaacccggcgaggacgagaacgcggccgtcgtggccgccgtcgacgccgagctcggctccgactggcccaagcaggtcgagccgcgcttcgactcccgcaaggccatcctcttcgatgaccgctgggcatccgcgcgcgaagacctggctcgcctgttctacaatggcgaccagtctgtcgagtccctgagctttgtcggcgccggcagggacgtcgccgaccaggccaagtggttcgcgtccaagagccatggacagctcgccgacaccttcgaccgcatcgccaccgaggccctcgaatcggtcgccgacgtgcctgacgcatcccgcttcgcgaacgacatcgcagtggtgaccggcgtggctccgaactcgatcgccgcgcaggtcgtcaacggcctgctggccggcggcgcgaccgtcatcgccacctcgcacagcttccgtccgtccgtcaaggcgtgggcgaagcaaacctaccgcgagcacgcggtgggcggcgccaagctgtggctggttcccgcgaacctgtccagctaccgcgacgtggacgaactggtccagtggatcggcaacgtgcagaagaagacctccggcgcgaccaccacgatcctgaagcccgcatacgagccgacgctgttcttcccgttcgccgccccgccggtgcacggcacgttgaccgactccggcgaactgttcgagtcccaggcgcgactgatgctgtggggcgtggaacgcgcgatcgccggcctatccgccatcggcgccgacaccgacgtgcagcacaagctgcatgtggtgctgcccggctccccgaaccgcggcatctttggcggcgacggcgcgtacggcgaggtcaagagcgcgtttgacgcgatcgtcaaccgcgcccatgccgaaaaggtatggtcgtctcgtgtcaccttcgcccacccgaagattggctgggtgcgcggtaccggcctgatgggcggcaacgacccgctggtcgaggtcgtcgaacgccacggcatccacacgtactccaccgaacagatcgccgtgaagctgctcgacctgtgcaccgcggaatcccgcgcggaagcagtcgagcatccgctcgacgtggacctgaccggtgggctcggcaacgccccgatcgatatcaaggcgctgcgcgccgaggcgatggccgacgcagagaaggccgcggcttccgcacagcagtcggacgacgactccacctccgcgaagaccgccgcatccggcctgagcatcaaggcgctgcccagcccgcacgtgccgcagcaggcgccggtcgacctggccgactggcagaacgtcaccgccaagcccgaggacgagatcgtcatcgtctccatcggcgagctgggcccgtggggctccggccgcacccgcttcgaggcggagctcggaatccactccgacggcagcgtcgacctgtccgccggcgcggtgctcgaactcgcgtggaacatgggtctggtcgaatggcaggacagtccgaagccgggttggtacgacaccgacggcaacctcgtgcccgaagaggacatcgccgaacgctaccatgacgaggtcgtggcccgctccggcatccgtccgttcgatgaaggcatgggcaacgactacaaggacggcgccgacgaagaggagaccgaggtcttcctcgaccacgatgtcaccttctccgtgcccaccgaggacatcgccaaggaatacgtcaagatggacgaggcgcacacctccatcgcggccgacccggagtcgggcgaatggaacgtcacccgtcacgccggttcgatgattcgcgtgccgcgtcgcgccacgatgacgcgcacggtcggcggccagttcccgaagggcttcgacccgctcaagtggggcatcccggcctcgatggtcggcgacgtcgacaagatcgcgctgtggaacatcgtcaccaccgtggacgcctacctgtccgccggcttcacgccgaccgaggtgctgcaggccatccatccttcgatggtggcgagcacgcagggaaccggcttcggcggcatgatgtcgatgcgcaagctgtaccttgaccgcttcctcaaccatgagatcccgaccgatatcctgcaggaggccctgccgaacgtggtggccgcgcatgtgatgcagtcctacgtcggcggctacggcaacatgatccagccggtctccgcctgcgccaccgccgcggtgtcgctggaggagggcgccgacaagatcgccctcggcaaggccgacttcgtggtcaccggcgcgattgacgatatcggcgtggaatccgtgatcggcttcggcaacatgaacgccaccgccaactcggaggagatgtacgcgaagggcatcgacgcgcgcttcttctcgcgtgcgaacgaccgtcgccgcggcggcttcctggagtcccagggcggcggcacgatcctgctgacgcgcggtgacatcgcgcttcgcatgggtctgccggtcgccggcgtagtcggcttcatccactcgtacgcggatggcgcgcacacctcgatcccggccccgggcctcggcgccctggcggctggcctcggcggccgcgactcgaagctcgtgcacgatctggccgcgctcggcgtcaccccggacgacatcgccgtggtctccaagcacgacacgtccaccaacgcgaacgacccgaacgagtccgagctgcacaacacgctggcgcacgccatcggccgcacgaacggcaacccgctgttcgtgatctcccagaagacgctcaccggccacgcgaagggcggcgcctgcatcttccaggtcaacggcctgacgcagctgttcaagtccggcgtgatcccggccaacgtctcgctcgactgcgtggacccgaagctggagcgcgacgaccacatggtgtggctcaccaagccgctgcacgtcggccgcgtcaaggccggcctcgccacctcgctcggcttcggccacgtgagcggtttcgccgcgatcgtgaacccgggcgccttcgaggcggccgtggcacacaccgcgggtgaggacgcactgaacgcctggcgcgagcgtgcgaacgcccgtctggctgccggccagcgtcaccttgaggaaggcatgatgggtcgcgcggcgctctacgagccgatcgacaaccgtcgcttccgcgaggacggcaccaagctcgccgacggcaatcgttacaacggccacgaagtcgaaaaggccatgctgttgaatcctgacgcccgcctcggtcagtccggcttcttcgaagcctgatctgccgagtcgttcgtcaggattccctcgcgggcgcaggtagcgcgcccgctcgcttcgcctacggggagttcactggactccccgtttgatggctcagcctgacgcccgcctcggtcagtccggcttcttcgaagcctgatctgccgagtcacgtctgactgctgaatgatgggcccgcacgtttccgcgtgtgggcccattttgcgttcgtaagtgcgcgccgaaacgacgtgtccgcgcacatagcgacgcaaaccagcccatttgcgtccttaagtgcgcacacttgtcgtttcggcgcgcacttaaggacgcaaagcggcccggacccgtcatacactggaacaggtctctcggaaaggtggcgcggtatgtcggttctcggtctcgggcacgatgtcgtcgatgtctcggcgttcgccgaacagcttgcggaaccgggttcgcgcatgcgagggctgttctctgtgcgcgaggtgaggcaggccggcgagcgggccagacgcaagaacgatgacgagtccacccacttggcggcgaagtgggccggcaaggaagcggtgctgaaagcctggtgcgacgcgctcggcgacatgccgaacccgtataccatcgagaatttcccgtggaacggcattgaaatcgtggatgattcgcgcggccgaccgtgcgttgcgttgcggccggacgtcgagcggaagctgcgtgcgtcgctgccccccgcagcctccagaaactccgatgaaatgtcgggcgcgcccgggttggtcaggatggggcctgcggtcatgcgggtgccgatcgtgactccggtgagcacgggttccgagccggctgcggcgtcgagcgcatcggtttccttggtttttcggtggcatgtctcgctgagccatgatggcggtatcgcctcggccgtcgccatgttgaccgtgtgacggcggttttcggcagtcatgacgccgctatacggacagttctcagactctttgaagacgacgctcgaaataagcgtgcgtcataggtatgtatgcaggcggatattcgttggggcgtccgcaggcatcggctggcgagtgtacgccatccatgtcggggcagaatccgacatcgggctcgtcggctgtttacggcccgctggtgcgaggctcgggcaagactcccgggagacgcaccagcgggtcgtatcgtatgcggccgacgcttgtgtgacgatacatccgttttgacgctgccatatcttccggcgtacagtatcatcatgattgccttacacaaagtcgcagcgccgcgacttgaccggactgcgaaagcggcggacgaggtggccgcctatgaacgcatcgattccacccatgcgaaggcacgccgactcatcgagcgggggaggttcgcgcgcaacgatgacggcggcatcgccatcaccgtggtcgccgccggtgccatggacgacgcccgaggacggctcggccggccgtgggcatgcgttcccgggcactcgttcgccatatcgttcatcgtgaccatccccgaatcggtggcgaccgatgacgcagtcaacggctggatgtcgatgattgccggcctggccactctggacgccatcgaaggaaccctggacgagtgcggcgcggtcccgttcgaccccgaatgcgggttccatctcaaatggccgaacgacatttactgccatggactcaagcttggcagcacgttcacccaggtcgcctcgccgcccgaccggcacggtgacgtcgccgtgatcttcagcgtaggcgtcaacctgtcggtgcccgcggatcgtttgccgacgccggaatccacgtcgctgcggatgcacgtcgcaccgctgccgccgaccgcggaactgattgacatgatcgcggcgcgcctggtcgcttcactgcgcacccgtctggaggcgttcgtgcagatgccgctcatccagagttcccggttgcgctccgagatgcaccacgtctgctggatgatggggcggcagatcgacgcgcagctcatcgacggccggacgatcgccggcaaggtggtatcgctcaacgatgacgcttcgatcagcgtgcgcacggcatcaggggagacggagaggctgagcaccggcgatatcggtctcatggtgtgacgcctgttccgacggtcctgttttgacggtcccgttccgcatggacacgggagttgccaaagtgtcggcgatgtgtataatagctcaagtcgccaaaagcgacattttcgcggatgtagctcaatggtagagcctcagtcttccaaactgattacgcgggttcgattcccgtcatccgctccactgccacttcaccggcaaatccggccgtccaatcgcgtttgacgtgattcgatagtaagactagcatgactaatcggaacggttgagagaacgcgtcgtcgatgacgactgccacgagaagctgaaatatggatcgcggcatctggcgaaaacccgcgggaacgcaatcgtttcgccgcacgccagatataccgcagcgacgaggacaggcccaccgggatgtgggcttggtcatgtgatgaggcatatgcgcgggcggtgcacagtatcacaagaacagctaaggaaacaaatgcgagcgaacggtaattccacgcatgagattctaggcaaaatcgtgacggccatcgcgtcgatcgccatgaccgcggcgttcgcggttccggccatggcggccagcgacagcgacacggcggccgactccggcacgacccaacagtcgggccagtacaagatctacccccagccgcagaacaccgagtatggcgacggcagtctgattctgcgcgacaaggcgaacaccgtcgtggaaccgggaatcgattccgccaccaaggcccgtctgaacgaggccctgaagctcaagggcatcgagaccaccgcggccgacgccgtgcccgaaaccgcgtaccagctcaacgtgctggtcggcatcaacggatccaacggcgtggtcgacaagtacgccaagcagctgatcgccgacggcaccctgaaggtggacgacagcacgttctccaagaacgactcctatgtgcttgccgtccgtcagggcaacgcgaagacgcccgacacgatcctcgtgctcggccgcgacaccgattccgcgttctacggcctgactaccctgtaccagatcttccagcagctgccgggccgcgccgtcagcaacctgaccttcagcgactgggccgacgtcaagtcccgcggcttcatcgagggctattacggcagcccgtggagcaccaaggaccgcgtgaacctgatgacctggggcggctactacaagatgaacacctacgtgtacgcccccaaggacgatccgctgcaccgcaacaactggcgcggcctgtacaccgaagaccagatcgagaacgagatcaagccgcaggccgaggccggcaacaagtcgaaggtgcgtttcgtttacgcgctcgcgccgttccataacgacggcgaggctaggggcaagcacttccgcttcgacaccgaggagcactaccaggaggacctcaaggaactcaaggccaagtacatgcagaccattgacgccggcgtacgccagatcgcactgctcgccgacgactccaccgactggggtgcgcagtacggcaacgacaacacctacgtgcgcgtgctgaaggacctgaccgactggatccacgagctgcagcaggagaagaacgacgacggcaccgcgaagtacgagggcctcaaggacacgatcctctactgcccggccctgtacagctacaccggagccggtgacgcctggtacaaggacatcccatccaacgtgcagatcgtcatgaccggcggccgcaccttcggcgtggccagcaaggacttcgccgacacgttcaccaagaacaccggtcgcgccccgttcatgtggatcaactggccgtgctccgacatgaaccgcaacaccgcctaccagtacctggtcatgggaggccagaacaacttcctcaagcccggtgccacatacggcacctacgacggcatcatgctcaacccgatgcagcagtccgagccgagcaagcagggcatcttcatggccgccgactacagctggaacctgtggcagagcgaaaaggacggacaacagtcctgggaggactccttcagctacatcgaccacaactcgccgatcgcgtccaagggctcccgtggcctgcgtgacctcgccatgaacatgcgcatcctcaacgacggcggcatcgacggcgcgcacaaggatgccgagtatgacgccgttaacaagtggtggatcaacaatgagtccgtcgactacaccggcaagctcgacgtcaagggcgtcctgaccgaactcaagggcaagctggacggcggcaccgccaccgcggccgacttcagccaggcgctcaccgtctacaccacgctgcagcgcgccgcgaagaactaccgcgcgaaccccggcgacaagaacatgtttgaccagatcgaaccgtggatcagctactgggacgacctgaccgcctccgccatcgactacatcaccgccgccaagcaggcgctcgcgggtgacaccgaggccgcgaaggcgacctacgcaaccgcgaaggccgctttcgccaagtccgacacgcatacgatcgccgattactaccagcgcaacaagcccgcccgtggcggcctggtcatcgtgcgcccgaccgtgcaggcgctcgattccttcgtcaaggccaagaccagtggcagcgtcaccccgacgccctccgacgccacggtcagcacgaacggcgtgggtgccgcggcatggcatgagaacgtcgatccgaaggccgtcatcgacggtgacgacagcacgttcttctggatgcagtccgccggctgcgactgtgtcaaggccaacgccgccctcaccgtcacctacgccgaggcccgcaaggccaaggagttccgcttcatccaggcggaaaagggcggtgacacgatcgtcaacggcaagatcgaataccaggatgcagatggcaactggaccaagatcggcgacgtgaacggcaaccagaagcagatcttcacgctggactccgccgcgaccgtcaaggccgtgcgcatcaccaacttggcccagacctccaagtggtggaaggtgtacgacctgtccgccaccaagatcgacgaacccggtacggtgaccaaggacgcgctgaacgccaaggtcgccgaagccgagaaggtcgactccgccgactggaccaagtcgagccgcgaggctctcgccggcgcgattgccgccgccaaggccgtcgctgccgaccaggacgccacgcaggccaaggtcgacgccgccgtcgccgcgctcgaatcggcgatgaagggtgtcgaacggtacacggcgaagaccgccgaccagctgaaggccgagcacgtctccaacgacaatgccacctacaccgaggcgagctacaacaagtaccagtccgcgtacgacgacttcgccgccgcgctggccaacgccgacgatctggcgaaggccgacggcgaggcgctggaagcggcctacaccgccgcgaagtccacgctgcgctacgaccagtccgcacgcgactacgcgcagctcgcgctgaacgacgccgagccttacgcgggcaaggcttccgagtacaccaaggacagctatgccaagttcaccgtcgcgtatgaggccctgagcaagcagctgaaggccgacccgaacggcgagggcgatcccgccacctacaccgcgctgcgcgctgcactcgacaaggccatcaagggcctggtcaagagcgacggcaccgagccggagcggcctggcgagaagcccggcgagaacaagcccggcgagaacaagcccggtgagaagccgggtgtcaacaagcccggcgccgacggcaagctgtccaacacgggcgccgacgtcttcggtctcatcgccgcaatgacgatgttggccgcggcgggcgtgacgatggccggcctgcgcaagcggatcggctgattcggcatgagtccgggcggtcgccctcgctcgtgagagccggggcgccggcccggacgacgctggcaattacgggctgaaatggccggaatccaagattccccgtacgaaatggtacgtttcgcggtgccgaaacggcgatattgtacggtgaatcccggattccgtctatttcagcccgtattgtcgtgcatggaagtcagtaaagaacatatggcgagcgaggcgaacatggcggacgaaaccaataacaacgaggcgacggaactggtcggtgaccacgtcgaaaccgttgacgtttccaagcatccggacccatccatcccggtgaccgacctgtctctggccgatatcgagcggcggcagtcgcacccggtgccatgggcggtgttcatcgtggcggtgctggccgccatcatcgcgccgtactggctcggacgctccctggcggtcggccacacgcaatggctgatcacccatctgaacctgttcaccccgcgcggcgtggccttcgtgtcgtggaccgtgacgctgacaacgttcaccggactcggtctcgccgtggtggagtcgcgcaactggctgtggcgcatcgtgttcgtggtcgggctggccgccgaacagttcatcgccggcctgagcctgctcaaactgaatttctggtactccacgtacgtggtgtacggcgactccgcgcagctgccgaatgcggcgaatctgggaatcatcgcggccggggtcggcgtggcggtgtatgcggtcgtgtgggtcggcctgctgatcctcatcaagaaggactctccgctgaacgtgctgacgcgcagctgggcttcgttcatcctgttcttcgccatcgagaccgcggcgctgctcattgtgctgttcggcggattgctgacggcggtgtgagaccctgccgcgaaaggccggaagtagtccgacccattgcctatactatcccattggcgtgtttcgcccgcggatagagagcgcaccggcataaagccgggtgcaccgcgcagcaaccataaggaggatgccgtggcacttacggctgaagaaaagcaggaaatcatcaccaagtacgcgacgcacgaaggcgacacgggttcccccgaggtccaggtcgcgctgctgagcaagcgtatcgccgacctgaccgagcacctgaaggagcacaagcacgatcaccactcccgtcgtggtctgctgctcatggtcggtgaccgtcgtcgtatgcttgattacctcaagcgcgtcgacatcaaccgttaccgttccctgattgagcgtctcggtctccgtcgataagagaacttccgcccgggcattccttgctcgggcgttttgcatatcggcatgtggatgaggatgttgcgaattcgcggatgacatactgtggcccggcggttgagggccgatgatgaagaagaatctggaatgaacgggtgcggtccgggacgggccgcgtcaatgagaaaagccgacaagcttgaacaaatcgggatttcggcgtctcgatgtggattacagatatcagcagacaatagaacaaaaaaaaggaggaaccctatggagggtcccgaaatcaaggccgtggaggccgttattgacaatggttcgttcggaaaacgaaccctgcgcttcgagacgggtcgtctcgcacagcaggcggatggcgcggtggcagcctatcttgacgatgattcgatgattctgtccaccaccaccgccggttccagcccgaaggagaactacgacttcttcccgctgaccgtcgacgtggaggagaagatgtacgccgcgggcaagatcccgggctcgttcttccgccgtgaaggccgcccgagctccgaggcgatcctggcgtgccgtatcatcgaccgtccgctgcgcccgctgttcccgcacacgctgcgcaacgaagtgcaggtcgtggagaccgtgctgtccatcgatcccgacgacgcctacgacgtcatcgccctgaacgcggcctccgcttcgacgatgatctccggcctgccgttcgaaggcccggtctccggcgtgcgtctggcgctgatcgacggccagtgggtcgccttcccgcgctggagcgagcgcgagcgcgctgtgttcgagatcgtggtcgccggccgtgtcatcgagaacggtgacgtcgccatcgccatgatcgaagccggtgccggcaagaacgcctggcacctcatctacgacgagggccagatcaagccggacgaggaagtcgtcgcgcagggtctcgaagccgccaagccgttcatcaaggtgatctgtgaagcccagaacgagctcaaggagaaggcagccaaggagaccaaggacttccagctgttccccgagtacaccgacgagctgtacgcccgcatcgacgagatcgcccacgaggacctcaacgaggcactgtccatcgcggagaagctgccgcgccaggaccgcatccacgagatcaaggagcacgtgcgtgaggtgctcgcgaacgagttcaccgacatggacgatgccgagaaggagaaggaactcggcaacgcgttcaaggagctgcagcgccagatcgtgcgccgccgcatcctcaccgaggactaccgcatcgacggccgtggcctgcgcgacatccgcaccctgtccgccgaggtggacatcgtgccacgcgtgcacggctccgccctgttccagcgcggcgagacccagatcctgggcgtcaccacgctgaacatgctcaagatggagcagcagatcgacgcgctttccggcccgcagtccaagcgctacatgcacaactacgagatgccgccgtactccaccggtgagaccggtcgcgtcggctccccgaagcgccgcgagatcggccacggcgcccttgccgagaaggccatcgtgccggtgctgccaagccgcgaggagttcccgtacgccatccgtcaggtctccgaggccatcggttccaacggttccacctcgatgggctccgtgtgcgcctccacgctgtcgctgctcgccgccggcgtgccgctgaaggccccggtcgcgggtatcgcgatgggtctggtctccggtgacgtcgatggccagcacgtcttcaagacgctcaccgacatcctgggcgccgaggacgcgttcggcgacatggacttcaaggtcgccggcacctccgagttcatcaccgccctgcagctcgacaccaagcttgacggcattccggccgatatcctggctggtgccctgcagcaggctcacgaggcccgcaccacgatcctcgacctcatcaacgagtgcatcgacggcccggccgagatgagcgagtacgccccgcgcatcatcaccaccaccgttccggtcgacaagatcggcgagattatcgggccgaagggcaagatgatcaaccagatccaggaggacaccggcgccgagatcgccatcgaggatgacggtaccgtgttcatctcctctgaaggcggcgaagcggccgagaaggccaaggccatcatcgaccagatcgccaacccgcacgtgccggaggccggcgagacctacaacggcaaggtcgtcaagaccacgtcgttcggcgcgttcgtcaacctcaccccgggcaccgacggcctgctgcacatctcgcagatccgcaacctcgccaacggcgagcgcatcgacgccgtcgaggatgtgctcaaggaaggcgacaccgtcgaggtcgtcgtgcagggcgtggatgaccgcggcaagatctcgctcgccatccccggtttcgaggaccaggagaacaacgccggccgtggtcgtcgtgacgaccgtggcgaccgtggtgaccgccgcggaggcccgcgtcgccgttccgaccgcgatgaccgccgtgacgaccgcgactacgacgaccgtccgcgtcgctcctcccgccgtgacgaccgcgatgacgatttcgatgatcgcccgcgccgtcgtcgttccgaccgcgactacgacgaccgtgacgaccgcggctatgaccgcgatgaccgtccgcgtcgccgttccgaccgtgacgaccgcgattacgatcgcgacgaccgtcgtggcggccgttccgatgatcgccgtggtggccgtcgtggcggttacgatcgcaacccgcgttacgcgaccgacgagaactacgacgagtaccgcgccgaccgcgtggagcgctccgagcgtccgcgccgccgcgtgcgtcgcgacttcgatccgttcgagaactgatctcttgcgacatggccgctcgcgctaacggctcgacgtccgagaaccggcgtcctctgagccaacgcgggtagcctgcgcctcacttacggggagccccatcacggggctccccgtttttgtgttttctgtgccgcgcgcccatcctgcacgtcaaattacgggttgaaattgtcgttattcgcaattccccgtgtcaaatcgccgctttcgggccctaaaacggcgatttcgcacggggaatcacagatatcgacaatttcaacccgtaatttggggatgatccggcctggcggggcattcgccacggtaggtgaggcggcaccgtttccggatgtggcctgcggcaaaggccgcatgccccttgtgcggcctcagcccgcgaatccgagaatcgtggtctcgcggcgggtgaatctcggcggcgtgcgttctacgccgggctcgaattccttgccttcgatctgctcgatggcgacttcgaccgccctcgccgatcagtccgatgtccttgcctggggcgacgccggtgagcagcatcatctgctctatccacgcaagcgtccgcggcgagcgggtgtaaatgcatacgccgttgcccttccactccgggaacttccctgtcagcggctcgaacgattgccagcgcgtgtcctttgcctcgaaccgctccagctgtatcccatgccgttcggcgcatatgacgctctcccggtcgaagatgttgatgaacggaaactcggggtcgccgcgcgggtcctcgacgatcaccgctttcttcgcgccgatggcgtgcatctcccagaacgccatgcccacgatcgccttcgtgtcggagtccacgcaatggtagtggtacggctcgccggggtcgccgtacggcacgatgggcaggccgagtttcattgcggatttcagacgcccgtcatgatgccggatgtccagcatgatgaatgcgtcgacgaggttgcctttgcccagccgacgcatgtcggcgaggtcttcggtcgtgcaggtcgatgacatcaggatgaggtcgtagccgtgttccttcgcggtggcgcggatggcccgcaggatgggaacagctccgcgccttgcgtggtctccgtggtttcggtgagcagaccgatgatgtgcgagcggttgctgatcatggcccgggcgtgcgcgtcgggcacgtagccgagctcccgcatcgccttctcgactttgtcccgcgtcttctgcgagatcggccggttgccgctcatgacatacgacacggtgctctgcgcgacgccggcgagggcggccacgtcctttgatgataccgtgcggagtgaaggacatggacggcgacacggtgacgtatcatttcacatagtcatgcttcaatggcggcaacaacgatacgaaggagtgcacatggggtggatcattctggcgatagtcatcgtcgtcatcatcgcgctggtgctgtgggcggtcggtgcctacaacgcgttggtcgcgctgcgcaatcgcgtgaagaacggctgggcacagatcgacgtgcagctcaagcagcgcgccgacctgatactgaacctggtcgaaacggtcaaggggtacgccgggcatgaatcctccgtgctgacccaggtgacccaggcgcgcgccggagccgctgcggccgcggcgaacccgaacgcgaccaccgtcgagcgtgccaccgccgaaaacgcgctgtcccgcgcgctgttcaacctgcaggcgaccatggaggcgtacccgcagctgcaggcgaaccagaacttcatggatctgcaggcgcagctcaaggacctggagacgaagatcgcctacgcgcggcagttctacaacgatgtggtgctcaagtacaacaccaagatcgagacggtgccgagcaacatcatcgccggcatgttccacttcgagcaggcacagtacttccaggccgacgaggggtcccgccaggtgccgcaggtgcgtttctgacgcccgacgtcaccgaccgccggaaccatcgccgctgctgatcattggagatcgccatgaacctgaaacgtctgctccgctcgctggcaacggcgttggccggcacactcgtcgtcttcgccatcgtcatcggcgccggcctgatgctgagcggaagctcgcccgacctgagctaccgcacgctggactatgacgtcgcggttcaagccgacggcagcctgaaggttacccagcacatcgacatgaagctccgcacgcgcgacggcgacacaccatggcggcagctgtaccagaagtacacgctgcgagaggacggcctgaccaacatcaccgacatcagcgtgcgcaacgtcaccgccggcgaaaactatgagcagggcgcgctggcatcgccggccgaccattccgatacgtcatgggaccgcgaatacgccgggcactggtacatcgcggacgtgaccgacggggccgagaacccccagccgttcgatcccgccaaggacgggtacgagatcagcgacaacacgacctcgcggcggtcgaaagacgtggagatcggctggaacatccccgcgaccaaaaaagccagcagtctcaagttcgacgtgacgatgacgctccacggcggcaccacgctctacaaggacgtggcatcgtggcagtgggagccgttcggtgacagtaacctgatccccatcggcaaggtcaccggaattgtgcgcttccccgacggcatcgacgcctccagcagctgggcatggctgcactacgccggcgtctccgaaacctcccggatggacgacggctcgctgcgtttcagtgcgtccgatgttcgcgccgggcagtatctcgacgtggtggcggcctacgacgcctccgccgtcaagcctccgtccggatggcggcagggcgatgccgcgtgggtgcgccagcagaccggtcgcacgtacctgccgaagctgaagcaatccgaagaccagcaggaaatcgcgtggcggcaacagcaggccggcccggcccgcgtgcgcgtggccttgtggatcgcagtagtcctcgccggattggtgctgttcgccatcggcatggtcgcggcggtgcgcagctatcgcgaatcccaataccacggcgacatcgaatactggcgtgagccgccggacatgagccctgcctcggccgcgaagatggcggatgtcatgggactgtccaagagcagtgtcgactcgctgcagatgacggcgacgatgctgtcgctcgcctcgaagaaggcgatcgccatctatccgggtccgtcgagcctgtaccggggcatcgatatgagcaatgccgacaacgtgcgtctggccggcatgattggcgccgacgagggcaaggcgaagtcgctgggcaagacgatgaccatagtgctgctgccggcgggattcgacaaggacgcgaagcgggagctcaacctgagccagagcgagcgtgccgcgctgagcctgatgcagaaggtctccaagcgcgtcggctctcccgtgttcgatctggacggcatgaagcggcattgcgaggactggaagaacgggtacaaggcgctgaacctgttcaccgaagcgtgctcgtccgagttcgcgatgctcggagcgacgcgcaacggcggcacgctggccagctggatgggcggcctcggcgccgcgctggcgctggtctccggcatcatcgcggtgttcggcggcaatatcgcactggcactgatcatttccgcaccgatcatgatgctgtcgatcgtcgtgtgctcatatgctgcgtccagtgcgctgacgtcttccggccaacggtatgcgggacaggtgcagggactgtaccggtatctgcaggatttcagcaatttcagtgaccgcggggtggccgacatggtgctgtgggaccggtatctggtgtatgccgcggcgttcggcatttcggaccgcgtgatggcggagttcgccaaggcgtacccgcaggtgaccgatccgcaatggctggacgcgcatggcgccggctcgctgctgtactggagctaccgcccgtacgggtatggctatatgggcggtccgaccgccggggcgggtgccggcggcgtcggcggtggtttcgacccggcgtcgttcagcgcgaacttcggtgacttcggcgcgcggctgaatgccggtttctccgagatcggctccgtcatccacgcggcgacgtccggtggtggcggtttcggcggtatctcgggcggttcgttctcgggcggcggcggtttcgggggctcctccggcggcattggcggcggatctttcggaggccgctgaagtcacgctctcaaaactcgcagatagaggggcttttggaccggaaagcccctctatctgcgagttttgagagcgcaacctcagctaagcgcgtggtcgatgtcgcgaatcaggtcgtccgtatcctccagaccgacggcgagacggaagaaaccctgatggaactcggacggatacaggtactgccgttcgtcgtcttcgcccagaaacacgatgaggctttcggcatggccgagcgacaccgccgacgtgatgacgttgagtttgctgacgaaacggttgtgtccgtcatggtcggtgttcagtccgaacgcgagtaccccgccgaaaccggcgtccgggcgggcgagctggctggcggcgaatgcgtgatgcgggtgcgattcgagccccggatacgccacgaaccgcacctgcggcagtgattgcaggtgttcggcgatggcctgggccgaggcgttgtgctgcctcatgcgcagcggcagcgtgactaagccgcggttgatgagccatgcgttgaacggcgagatgaacgtattgtccaccgacagcagcgtgccggccgtgtcggagaagatcgcgtggtcgccgcggttcagcacggtcgtgaacgtggccgtcagcgccgccactccgctggcgaacgcctacgcgcgtaaccggtgcgattccaacggttgatagcccctcatgcaaagaaccgtcgcgctgaggggcgcaggggtaccgctcaaagcgtcactgtgtgaggccaccgtcactgtgtgtgccctctcacagtgacggtgttgctagagcccagtatttgcaacggttttcagggtaccgtcacgctgtgcgccctcgcgcggtgatgcaatttcagccaccgtgcgagggcacacatccgtcagaagtcccagtcctcgtcgtcggtctcctcggccttgcccatcacgtaggacgagccggagccggagaagaagtcgtggttctcgtcggcgttcggcgacagcgccgccagaatcgccgggttcacgtcgcacgcctcggccgggaacagcgccggatacccgaggttcatcagggccttgttgccgttgtagcgcaggaacttctccacgtcgtcggtcagtcccacacgctcgtacagcgactcggtgtattccacctcgttgtcgtacagctcgttgagcaggttgtacgtgtactcgcgcatctcctcgcgcttcgcgtcgctcacccgctcaagcccgcgctgatacttgtagcctatgtaatacccgtgcacggcctcgtcgcggatgatcagacggatcacgtcggccgtgttcgtcagcttcgcgtgcgccgagaaatacatcggcaggtagaagccggagtagaagaggaacgattcgagcagcgtggaggcgaccttgcgcttcagcggactgtcgccctcgtagtagtcgagcacgatttcggccttcttctgcaggaactcgttgcgctcgctccagtcgaacgccgcgtcgatctccttggtggagcacagcgtcgagaagatgctcgaatagcttttggcgtgcacggactccatgaacgcgatgttcgtgtacacggcctcctcgtgcggggtgagcgcgtcgggaatcagcgagaccgcgccgaccgtgccctgaatcgtgtcgagtagcgtgagtccggtgaacacgtgcatggtgagcgtgtgctcgtcgtcactcatcttctgccagctggggatgtcgttggagacgggaaccttctcgggcagccagaagttgccggtcaggcggtcccatacttcgagatccttctcgtcctccagacggttccagttgatcgcggagacgcggtcgatgagcttgagcggtttgcgcggtacggagattggtgccatggttgtctgcctttcgttgttgggggtggtctgttacgttctttcggatgacgtcgatctcgtcgtcggcgggtttgtcttcaaactcctccggcgcggtcagacggagtatgagccggtagatcattggcgacatgtgggttccttgagttgcgggcgtgcgcagggctgtggagcggaattggtggatgacgtgtgtggagaccgccgtctgaggccgaaggcgtacgaaggtacgtcgagcgccgaagaaaggcggtatacgcatacatcatccaccgattcctcagagcgtgcaggagacgcagccttgcacctcggtcccttccagcgcctgctggcggatgcggatgtagtagagggtcttgatgcccttgcgccaggcgtagatctgggccttgttgaggtcgcgggtggtggcggtgtcggggaagaacagcgtgagcgagagtccctggtccacatgctgcgtggcttcggcataggtgtcgacgatggccttccagccgatttcgaaggcgtccttgtagtattcgaggttctcgttggtcatgtaggcggccgggtagtagacgcgcccgagcttgccttccttgcggatctcgatcttggaggcgatcgggtggatcgacgaggtggaatggttgatgtacgagatcgagccggtgggcggcacggcctgcaggttctggttgtagatgccgtcgcgcaggatgtcgtcgcgcagctcggcccagtcggcctcggtcgggatcgcgacgccgaaacgctcgaacagggcgcgcacgagttcggtgcgcggggcgagggagcggcggccgtcggtgtacttgtcgaaataattgccctcgccggccggcttggcgtacgccgaatcggcgaaaccgcgaaacgccgtgccgtgctcgacggccagcgtgtgcgaggcgcggtaggcgtggtaggcgaccgtcatgaaatacatgtcggtgaagtcgagcgcttcctcggaaccatactggatgccctcgcgggcgaggaaaccgtgcaggttcatctgtcccaggccgattgcgtgcccttcatcgttcgcgcggcggatcgagggcaccgcgtcgatgcgcgtgtgttcggacaccgacgtcagggcgcgaatcgccgtctcgacggtgccggccaggcccgcgtccatcgccttggcgatgttcagcgagccgaggttgcaggacacgtcgcgcccgacgtgcgagtaggtcaggtcctcgttgtaggagctcgcctcctgcacctgcaggatttcggagcacaggttcgacatcgtgatgcgcccggcgatcgggttcgcgcggttcaccgtgtcctcgaacacgatgtacgggtagccggattcgaactggatttcggccagcgtcgtgaagaactcgcgcgcgtcgatataggttttcctgatgcggtcgtcggccaccatctcgtcgtaatgctcggtgacggaaatgtcggcgaacggcttgccgtacacgcgctccgcgtcatacgggctgaacagcgccatcttggccttcttcttggccagctcgaacgtgacgtccgggattacgacgcccaacgccagtgatttgatgcgaatcttctcgtcggcgttctcgcgcttcgtgtcgaggaagcgcaggatgtccggatgatgcgcattgaggtacaccgcgccggcgccctgcctcgcgccaagctggttcgcgtacgagaacgagtcctccagcagcttcatgaccgggatcacgccgctcgactggttctcgatgtgcttgatcggggcgccgagctcgcgaagattgctgagcagcagcgccacgccgccgccgcgcttcgacagctgcagggccgcgttgatgccgcgcgagatcgactccatgctgtcttcgatgcgcacgaggaagcagctgaccgcctcgccgcgctgcgccttgccgaggttcaggaacgtcggcgtggccggctggaacgcgccggagagcatctcgtcgaggtattcgacggcccgctgctcgctgccggccgccaattcgagcgcgaccgccgcgcaacgctgcgggaagtcctccagatacagtttgccgtcgaacgtcttcagcgcgtatgacgtgtagaacttgaacgcgcccaggaacgtgccgaactcgaatccggaggattcggcgtgcgcgtagaagtcgtccaggaactcgggggagtagcgttcgaacaccgccggggcgtaatactggtggtcgatcaggtagcgcaggcgctcgccggtggattcgaagcgcttcgtgttcgtggccacgtggccggtgacgtattcgcgttcggcggccttgtccttaccgaactggatgcgcccatcggcgtcgtacaggttcagcatcgcgttgagcgcatggtagtcgtgcgccggatcgtactgctcgacagtggtgtcggtggtgttgtcgagcggcagctcggtgtcggtgaagtcagtcatgagtatagttttcccttggagtaactggaataacggtgattgtggcgcgttcagccgcggtggtcccggaagaagcgcacgagtccatcgcgcaccttgcgcgtgtcttcgcgcgtgcccataagctcgaaacggtagaggaacggcacgcggcatttcgcggcgatgatgtcacctgccgcgcagtatgcggtgccgaaattggtgttgccggacgcgaccacgccgcggatccacgcgcggttcgctggattgttgaggaaacgcttcacttgcggcggcacggcctttttcgcgtcgccgccgccgtaggtcggcaccatcagcacgtacggctcgcgcacgttgagcggcgccgagcccggcttgagggggatgcggtacacggcgatgccgatgccgctcagctggcaggactcgatgaaccgggccgtgttctcggaggcggaggagaagtacacgactgcgccgatgtgctcgaccgtgttgccggccggctgctcgggggtgctgggcgtggtgctgtcggcggcggggatggcgtgcgcggcggtcaggtcgatcggggtgctgcgcggatgaggctggggcgtgccgggggtggcgggggcgcggccgttcatgcggccaccggcgcggtcttcttggccagtttcttggccagctcgcgaatcaggtccgggcggtagccggtccaggatgcatcgggggtgatcacgacgggagcctgctggaagccggcctgctgcagctgtgccagggtctccggattctgctccaggttcacggtctcgaaaatcacgccctgcttggtgagctggcgcttggtggcgtcgcactgcgggcaatacggtttggtgaacacggtgacggtcatgttgctcccttgatgcgctggggtgaacgtgttgactcgctcagactacagcgttgtaatttgcagtcaagaacccctacaagtcgtgtcgcgcgcagtgtgtggtcactatatgtagtgtttcgttgggatgatgccgattttgagcgatggtggatttttggtgtcggtgtgaaatgtggggatagtcacatgagcggtctccgggcggatttgtagcagcgaacggttctcaataagaaaggtgcgagcctgctgtcggccgaaatgaacatcaaaatcggctgagccctggaattccgggactttgcctatttgtgcgattgtgcgaaattgtgcggaatcctcgcacgtttcttattgagaaccgttcgctgctaccggggtcgtatccgccgcggcctcggcgtattgtggagggcgacactatatgaccatcaaggagatgcacatggtactgcaccgcaacctcggtccgttcggcaccaccgccatcggcctcggcgaaatgccgctgaccatcgagaacaacctcggccacgataagggcatcgagaccatccacgccgcactcgacgccggctgccgtcacctcgacacggcttgggcctactactgctccggcggcgaagagcagaccggcgaaaagctgatccgcgaggccatggcctcttggaacggcccgaaggacgaggtcaccatcgccaccaaggtcggtcatttccgcaacttcaccgacggccgccccacctgggacgtggacgggcgccccgaaaacctgatcaagcgcggcaaggagagcgcgctcgcgcttggcgtcgacacgattgacctgctctacttccatcgccccgacccgaaggtgccgtacaacgagtccgtcgaagccatcaagcagctggtggacgagggtgtggcgcaggaggccggcatctccaacgcttccatcgagcagatcgacatcgcgcgcggcatcctcggcgacaagctcatcgccgtgcagaaccagtactcgccgatctacctcgacaccgccgatacgctggaatacacggcgaaagtcggtctgaacttcgtgtgctggagcccgctgggcggcttccgcaagcccaaggacgaaaccaagttcgacccgttccgcgagatcgcggcggctcgtggcgtctcctaccagcaggtcgtgctcgcgtgggagctcgccaagggcgaccatgtcttcgtcatccccggcgcccatcgccccgagaccatcctcgacagcctgcatgccggcgatttggagctcacccccgacgagcttgtgaggctttaaggcgacaggctctcaaaactcgcagatacaccggtggaatagcggttttccttgtctatccgcgagttttgagagtctgcttttgtagtctcactggagtcttgcgactccagggcatggccaccccagtcatgcgttgcatgaggtggattctagtggtggttgcagcacctgaggtttgagcggccttccatggccacgttgtcggttgttgaggctatcacgcggcgtcgagcagttcgatgatcttctcgcttggtttcatgaagccgagggtcttgcgtggccggtcgttgagttcctcggcgaccgcgtcgaggtagtcctcggggtatttggataggtcggtgcccttggggaagtaccggcgcaacaggccgttggtgttctcgttggtgccgcgctgccacggggagtgcgggtcgcagaagtagacccgcatgtccaggctcgcgccgatctgcttgtgcagggcgagttccgaaccctggtcccaggtcagcgagttgcgcaggagcctgggcaggttccgcatcttgcggacgatggcctgctggacctggcctgcgtcgtgcccgtcgggcaggtgcagcaggatcgtgaacctggtggcgcgttcgaccagggtgccgatggcgctcctgttcgccgaaccggtgatcagatcaccctcccaatggccggggacggcccggtcctcgacctcggcgggccggtccgagatcatgaccatgggatcccggaaccggggtctgcgacccgcgccgccacggggtttgcgttgggcgcggccctggcgcatggcccgtttcagctcggctttcagctcgcccttgccctggacgtagatggcctggtagatcgtctcgacgcttgcgtgcatgtcctcattatcggggaagtcatgcctgagccggttgccgatctgctcgggactccaatgccgtccaaggccggcgagtatctcccgccacaggcgcgtgcccggcccggctttcctgggcctggggcgtttgagccggtcggcgctcgattgctgggcgtggtacggctcgtagcatccggtcagggggttcgtgtcgcgtcgtatctcgcggctcacggtggccgggttccggtcaaggaggcgggcgatggcgcgtatgccgtcgcccaggcgcagccggtcggcgatcaggatgcgttcctcctggcccagatagcgggcgtgtatcttcctgggcttgtccatggtggaacgataccagtccaccgatggtctctcgttcctgccggtggcccgggcgcgtccgttcctccaggccttgccggtgcgtttcgacaccccgaccgcatgggcggcctgggtgaagttcacgccctcctcggccagcaggcgcacgtactcggcccgcctggcctcgcacatcgccttcctcgtcggataaccgtgcccctggaacacccagcggccggtccctgtcccgtcgtcatggtggctcgcggtcacctgatcctccctgcggtaggccaggtgttgcaacgatcactagaactcgccgggagcggattttgttaggggggggggtacttgacgcctgatgtcagaggcgcgacattggcaccagattccatgcactacactggtggggtgcttgaatctcaacaacgaatggcccggcgtaagccggaagtgctggctccggcgggcaacctgcgcgggctgaaggctgcggtcgattacggggccgacgccgtatattgcggcggcaaggcgttcggcatgagaagtgctccgaagaacctgagcctggaggacttcgaagagggcgcccgctacgcccatgcgcggggcgcccgcgtatatgtgacctgcaatgtgttgccgcgcaacaacgaggtcagggccatccaggaatacatcagccagctggccggcaccggtgtggatgcgctgatcgtcaccgacatcggcgtgctcatgaccgcgcatagcgtcgcccccgagctggaactgcacgtctccacgcaggcgggcgtcacgaactacggtgccgccaacgcgctgtacgacctcggcgccagacgcgtcgtgctcgcccgcgagatggatctgcaggccgtgcgagacatccgcgccaacattcccgacgacatggacgtcgaatgcttcgtgcacgggtcgatgtgcatggcgttctccggacgctgcctgatctccaactatctgaccggtcgcgacggcaaccacggcgaatgcgcgcagccgtgccgctggaagtactcgctggtcgaggagaagcgtcccggccagtacttcccggtcgaggagaccaaagagggcacgtacctgttcaactcgcaggacatgtgcatgatggagcacctggatgacctgatcgactccggcgccaccagcctcaagatcgagggccgggccaaaagcgcgtactacatcgccgcgatgaccaacgcctacaagaccgccgtcaacgaatacatggtgcagcgcggtttcgaggccgcggacggcaacacgctgcgcccgttccacgaccgcgtgattcgcaccgacgcgcccgcccccgtctggctgaacgatgacccgtacgcggcggaactgtccggtgccgatctcacggaccacatcatggaacaggccgacgtcgccttcgccggcgtccccggcgacgacggcgtcctggaagtcggccagagccccaccgccccagaccgtatctccgatcttgaacaacaggcccgcagcacgcgccgcaaatcgaacacgcgcgacgagtccccgatcgacacgaacggctggcagcatgcggccgtcgcgcccgcgccgcccgtcacactgcccgaatggttgaaagaggaaccctacaaggtcgctcaccgagaatactccaccggcttctactacccggaccgcaaggtcaccgagaacaccaaccgcagcggctacttccgctcatggctggtcgtcggcgaagtgctgtcgtggagcccggacgaaggcggtcgcgtcacgctgatgagccgcaacaagatcgaacccggccaggagatcgaattcctgctgccgggcgacgcgccactcatctacaccgtgcccgaaaacggccttcgcgacgccgacggcaactgggtgcaagccatcaacaatccggcgcacgtgttctccatgccgtgcccgcatgaggtgccggtcaacgccgcgatccgctcccgcaccaagcaccccaccctcaaagccgcctgacgccaatcgccgagccgaagagcacgcaatcacataggataaggaatcatgagcgatacgcagtttgatgatgagattctggacagcaacgccatcagccccaccgacgaggagggcaacccggttccagtgacgatcccgatcgcgctggcgcctggtgtcactgtcgtctacaccacgcgcctgggcggggtgagccacggcgatttcggcgattgcaatctcggcggcaagggcggcgacgacccgcaggcgattctcgccaatcgcgtgtcgctcgcgaaatccatcggctgcgggctctcgctggtcagtcaggtgcattccggacgcgcggtggacgtggatgcatcatggcatctgaacaccccgttcggcttcgatgtgtccggcacgcccggtgaggtgaccgccgacggcgaggcgcaggccgcgaccgtcgtggaggcggacgggcaagtcacgtctcgcgcgggtgtggctctgagcatgttcgctgcggattgcctgccggtgctgatggccgacgcccaggccggcgtgatcggcgccgctcactgcgggcgcaagggcctgcagcgcggcatcatcggtgccacgattgatgcgatggtggccaagggcgctgcgccggagcgcatcgcggccacgctcggaccgtgcatctgcggcgactgctacgaggtcggcgacgccatcgccgacgagttcgacgcgcaattccccggtacgttcaccctgacgcgattcggaggccccggcatcgacatcgccaaggctgcccgcatggagctcgccaaggcgggtgttcccgccgacagcatcgtcgattcgcgcccgcgcgtcaacgccgcctcccaatacctgtatgaagacgaagagcttgcctcgctgtgtgccgccgacggcgaaggcgagcctgcgctcgccgaccgctggagcaccgtgcgccacagcatgtgcacgctggagaatccgctgtggtactcccaccgccgcgcctcgctcgccggcaaggcgcacgagggacgcctgctcgccctgatcatgcgcggctgaccccgatttgcctcggttgtgacgaatcgggccgctatcttcgtttcgtgaggttgattccaccggtcgggaacatctatcttcgtttcgtgaggttgatggccaagtagcccaaggccctaaaccgcatgattccaatggcgtttggcgcttaatactcgcggtatcgtgtttgggcaaccccttgaaacgcagatagatgttcggcggagccgaaatcaacccctcgaaagcgagatagcccgttgcggcggggccgacaccggtgtcggcggcctgttcgtcgtcgaatcagaaaaaattccgtgcagaagagtgtggcttccgtcacaaccggtcagggcggggcatacggtgggcggtatgactcagagagatgacagagaacccgaagcaccggtcgtcgccgtggtattggccgccggcttcggcacgcgcttcgatccggacaaccccaagcagctggtgagcgtcgacgacaagccgatcgtctgctggtccatcgaggcgttcgagcagaacccgcatgtcaccgacaccatcgtcgtcgtcaacccgcaggtgcgcgatgaagtggaacgcctggtcgatgaggccggctacccgaaggtgcgcatgatcatcgacggcggcgccgaacgcgccgacagcactgcggcggctctgcaggcgctgggggcagctggcatcccgccccgcgcgaaactgctgatccacgacgcggtgcgtccgttcgtcgagcagtcctcgatcgacggctgcatcaccgcgctggacgagttcgaggcagccacagtcgcattcgcctccaccgacacgatgctgctcaccgaggatctgggcgaccgcaaggtcgtgcgctccgtcccggaccgcgcgaacatgttccgggcgcagactccgcaggcattccggttcgagaccatccgccgcgcatacgagctagcctcgcgcgaccccgatttccacccgaccgatgatacgcgcgtggtcgtcgactacctgcccgacgtcccggtcgccatcgtggccggctcccggaccaacatgaagatcaccacgcgcgacgacctgccccaggccgagcagatctcgctggagatccgcaagcgtctcgcgcgcgaacggatgcatcaggtgttcgcccaggtccgcgagcaatagcagcggcaggcgttcgcggggtacactggcatcatgcagcagctcaatgtcgtgatttgtgggttcgaccactacgagaacatcgacgtcaacccgtcgtacgaagtgcccgaggcgctcgtccgcgacggcatcggggagccgtccgacgtggacgatccgctgcatgacgccaacgtgtccatcaacaccgtggcgctcccggtcagcttcgccaacgcttggcccacgttgctggagaccttggatgcgacccggccggacatcgtgatcgcgaccggtctcaagcatgcggcgcacagcgtggcgatggaacgctgcgccacgaacctgatgaatgctgcccgccccgacgccgacaacgcgctgccgcggttcgagccgatcatcaaggacggcccggccgcatattggacccgtttgccgttgcgggccatcatcaacgatttcgcgcgcgacggcatacccgccacgctcagttccgacgcgggcacgttcgtatgcaattcgctgttctaccagctgctgcactggacggcgacacaggatcgtgtgctggccggcttcgtcagcttccctccgatcaatggcggcagcaggctgcagaacggcctggatctgcgccagcaggtgcgtgccgggcgcgatgtggtgcgcgagacggtccgttattatctgcagccgtcgtccggggatattctcatcgcctgacgttttgctgggatgcagctggtttcttgccggcatgtgtgtacgttcgcgtatggttcgtcgcgtttctggcgtgggcttgacgccatgcggtacagtcgtgtgtggttgtgctaacgagcaggtgtaatggcgaaaggaaccgaacatggcggaccagttcccgattgtgatacgtggatacgataaagagcaggtggaccgggcgtttgccagcgcgcagcagacgctggccgcgttgcgtgcgcagatcaagcaggacggggatcgtctgctgcagttgcaggcgaagctgcaggaggaacgcaaccgtcagtcgtccaagaaccacacgttcgcctcgctgggcgccaacgcccagcagatgcttgcctccgcggagcagaccagcaccgagctgctggagcgtgccaagcaggatgccgcctcgactcgcgcgtccgccaaggctcaggcggagacgctgatcaacaatgcgaagctggatgcgcagcatcttctcgatgacgctcaggccaaggccgatacgattaccggcaacgccaccaatcaggcgcagaccattacgaccagcgcgcagcaggacgccgcccagctgcgcgccgaaacggcgaagatcgtgaccgagcagcgtcagtccgtcgatctcgaactcaccaattcgcgcgaggagcatgaaaagcgcatggcgtcggagcgcgccaagcaggagcgcgagatcgccgagatgcaggcgaaggcgacccagcagatcgcctcgcagcgcaggagcgcgaacgaggagattgccaagctcaagtccgagtccaacgaccagattcaggcggcgctcgcggaggcgaacaagaaactgtccgacgtgcgcgagcaggtgtccaagatgatggccgacgcgcagcgcagggcgggcgagattatcgatgcggccaaggcgaaggcgcaggagattcgcgacgacgccgaggtccgccacacgcagacgatgagccaggtcaacgccgaggtcgagcagattcgcactgacatcgccgcccagcaggacgaagcgaccaagaaggtgagcgagctgctcgaaaacctcgaagagcgtcgcgtggccgccaagaaggaatccgacgagctgatcggccaggcgaagaccgtgcgcgaggatgccgacacgtatgcggcgagcaagcgcaaggaggccgacgatcaggccgcgcagatcctggaaaaggccggcgaggatgcggcgtcgcagatcgaggatcgccgcaaggccgcgcaggtcgagctggaggatcttcaggggcgcatagccgagctgcaatcgcgtgaggcggccatcacgcagcgcgtgtccgagttgcgttcgatgtttaccaaggcgttcagcggattcgggttcatgaacgagcagggggcggagcagcctggcgccgcgtcgcatcagggagcgcccgatgtgccgctgcacaatgccgtcgcgcaggatgagccggcaccggcgtatgagtcgcatgccgtcgcggagcatgccgacaatcaggatgcggaagcggtcgccgccgagccggtcgccgagcatgtggccgagcacaccgaggccggcgaggccgaaaccgccgaatagcagtcggccgggattccgaagcgtcggatgccgggcttcgccgtccggcccgcaggcggctgcagaagtcgccgggctcctgccgaatcaaggtattgaaccggttcgatggcgggaatccgctgtcgccgctacactcattagagacccgtcgtggcatccggtcaaacgctggatgccacatttcattgcggccacaaaaccggccgcgcacgtcccaagtcaaaggagcagcatgaccgagaacacgtcatcgtctgaaatcacaccgctgtccggcgagcagctgaacgatctggtcgcatcattcgatgccagccagtccaaccgtctggccatgaacgccgtcaccgccgccggtatcgacaaggtcgcgctgaactatgaccgttcccgtctgctgcagcgccgcttctccgtcaccgtcgacaacggcgaggtcacccatcaggaccgttccggtcgctgctggctgttcagctcgctgaatgtggcccgtttcgtcgccaagaagaacctcggcgtcaaggagttcgagttctcccagaactacgcgatgtacttcgacaagctggagcgcgtcaactacttcctgcaggacgtcgccgcgctggttcgtgccggagagccgtccgactcgcgcctgatccagcacctgctcgccgacgtgatgggtgacggaggccagtggacgatggcgctgaacgtgtacaagaagtacggtgccgtgccgaaggacctgttcccggagaccgaatcctcgaagaacacgggcgctatgaacacgcagctgcgccacctgctgcacactgccgtggcacacatgtacgccgaccccgcgtcgatcgacgacgaggtcgccaagaccgtcgccgccggccaccgcatcctgacgattcacctgggcgagccgccgaaaagcttcgactgggagtggaccgactccgagggcatgttccaccgcgacggcgaaatcacgcccgtcgagttctggaagaagtacgtgggcaccgccgaccttgaggattacgtgtgcctcgtggacgatccgcgccgcgagcacgccaagggcaagaagatcggcatcgagcacctgggcaacgtggccggcggcaacccgaccgagtacctgaacgtgccgaaccagttcatgaaggattgcgtgcgcgcgatcctgaccgaaaagggcatcccggtgtggttcggcgcggactgcggtccgttcatggatcgcgagcgcggcgcgtgggcgactgacctgttcgagtacggcaacgtctacgatgtggacttcgacatggacaaggagtcgcgcgtacgcttcggcgactccgcgatgaaccatgcgatggcgttcgtcggcgtggacgtggccgatgacggcaccacgacccgtcgctggcgcgtggagaactcctggggcgacaagattgccgacaagggctacttcacgatgagcgacgactggttcaccgagtacgtgtacgaggtggccgtgcccaaggcgatgctcccggccgagtatcaggccgcgctcgccgagcccgccaccatgctccccgcatgggatccgatgggtgcgctggcctgagcgaggtatcggcccgtgcgtcgagcacgagactgaatgaccgatttcgtcgattccccgtgtcggatggacattttacgaaaggagtgtgccgttcgatgtggggaatcgtcattgacggcggtcttccgctattgttggatgacaatgatgtctctagccagaggaccgcgcatcggttgcggcatagcggaataagcccagagaaagcttcatgatgaagaaagcgtcggccggaagccgcacatcattcaatacattcaatcgaatactgacgtgtcttatcccgatcgcgttcgtgttgaccgtcggcgcatgcggaactcccggctccgatgcggggtcggctgagcgtcagtcgtccggacaatccgaatcggctgagtcgtccgaaccgtcaagctcggcttccgcgtccggcggacagctcgccacgagcgcgctggagacgctgccggtcaagggacgtgcaccgaaaaccggttattcgcgcgaccagttcggcgaggcatgggccgacgtcgaccacaacgggtgcgacacacgcaacgacatcctcaaccgtgacctcaccaacaagactcacaaggccggtacgcacaattgcgtggtgaccagcggtcggctcgtcgacccgtacaccgccgcggtgattgatttcgtgcgcgggcaaagcacctcggcggccgtgcagatcgatcatgtggtggcgctgtcggacgcatggcagaagggcgcgcagcagctgagcgccgaccggcgcaagcagctggcgaatgacccgtacaacctgctcgcggtggacggcccgtcgaaccagcgcaagtccgacggcgacgcggcgacctggctgcccgccaacaaatcgttccgctgctcatacgtggctcggcagatcggcgtgaaggcgaagtactcgctgtgggtgacgcaggccgagcatgatgcgatgtcgcgcgtgctgtcgtcctgcccggcccagaccgttccgaccggcgacggcgcggaatcagtggcgccgcaggaggacgtgtcgcaaggcagctcatcgcaggacggttcatcgggcgaacagtccgagtcgagcacggtggtggagccggccgctccgtctgacggcgacagttccgatgtctactacaagaactgcgccgcggtgcgtgcagccggcaaagcgccgctatacaaagggcagcccggctactcgaccaaactcgatcgcgacggcgacggcgtcgcctgcgaatagcgccccatctccatcccgcgaaagtcccattcgcagccgccggaatgggactttcgccgggtgacggcttcgcagctccgccgtgcccgcattgcagccgttgttttccgtattccgacggcatctactattgtgtgttcggtattggtatgcgacgtgagggcgcgggtcgaaagacaccgggctgcggtgcggaaggagagcagagcgatggcagggcttcgtggtccggacagttccgaggacgagcggcatttgggcgggaatgccgtgttccctgaaacggtggacgtgaacattcgccagctcgacccgattccggcaccgcggtattttctcagggaactgccgctcaccgatgatatgagcgacctggtgctgcaatcgcgtcaggagatccgcgacatcctgcacggtcgcgatgatcgtctgctggtcatcgtcggcccgtgctcgattcacgatccgaaagcggcgcacgagtacgcgcagcgtcttgcgacgctcaagggcgagcttgagggccgactgatgatcgtgatgcgcgtgtatttcgagaagccgcgcacgacgatcggctggaagggtctgatcaacgacccggatctggatggccgcttcgatatccgcaagggcatgtggctggcgcgcaaggtgctgaccgacgtgcttggcctggggctgccgacggcgaccgaatggctggatccgattacaccgcagtacatctgcgatctgatcagctggggggcgatcggcgcgcgcaacacggagtcgcaggtgcatcgtgagttggcgagcggcatgtcgatgccgatcggcttcaagaacgcgaccgacggttcgatcaagccggccgccgactcgtgtttcgcggccgggttcgagcaccatttcctgtcgatcaacctggatggccgcgtgatctccgccgagacgaagggcaacccggactgccatctgatcctgcgcgggtcgaacaccggcccgaactacgatgcggcttccgtggcggccgcgcttgaggcgctgcgcgcgtcgaaggcgagcggtccgagcgaacgcggtctggtcatcgatgcggcgcacggcaattgcggcaaggacgagaacgtcgaggccgaggtcattgagaacatcgcctcgcgtatcgccgatggagagccgggcatcctcggcgtcatgatggagagcttcctcaagggcgggcatcagaaaccggcaccgctcgaccagctggtgtatggccagtcggtcaccgactcctgcgtgccgtgggagcgtaccgaggagctgctgcacacgctcgccgacgccatcgacgcgcgtcgcgcgctctgatccggtgcccggcctaggccgctaggtggggcatgccacaatacatggctgttagcatatacgtaggttcggcgtggccttgtctgttcgagaggccgcgccgaaccgttttttttgcattggcgctgcttcagtgatgcatcgtcacagcgacgcgtcgtcccagtggtcggcggcggggagcgagcggatcgacggcatcagcagcgcgatgaccacattgaccgcaagcacggccaggaacaggccaatcgtggcgccgaacccgatgcgtggcagcagggagccggcgagcgctgagcagaacagcgtgggtatcatcgacagcatgtcgctcgccgactcgacacgtccctgcatctcgctcggcactttggcgaacacgaatcccatcagcagcgagttgatggtggggatgggcagcccgacgatcagcgatgacgccagtatcaccaggtaatcgctgctgaacagcatcggcagcaatgtcagcagcgacgtcaccgacaggacgaccagaccggtgcccatgtgcactcgctcgcatacccgtgcggcgatcaccgcgccgatcagcatgccgactcccatgacggtgttgacgaaaccgagtcgcacggagtccacgtgggtgctcaccagttgcaggttcaccgcggcgaacacgccgttgagcccgaaattcaccagcgcggcgattacgcagatcgccagcagcgtgtgcctgcgcagcgtccagcgccatccttcgatgaaatcctcgaagaacgaggtgtgcgccggctctgctgtcgcatcggcgtcgggcgcgacgacggcatcggacgtgcagcccgcttgcgacgcggtgtcgggacgcttgctcttgcgatctgtcgtcaccatgtcgcggacatgttcgtcgacgcgcagctgggcggcactgacaccgctgatcgcgtacatcagcgaggcgaccgcgaacggcagccacggcgcgaccgcgtacagcacgccgccgagcggggatcccgcgatgctgaccacggaatcgcgcccctgattgaggctttgcgccttcggatattcgcgggtcgggatgatcgtgcgcagcatcgcgttggtcgcgttggcgagtagtccgttgaccgctgacgccgcgaccgtcacgatggcgaatatcgggaatgcgatcgcatgcagggcgatcagcacgaacaccgttccccacagcagcgtgccgaacacggcgttggcgatgatgagccctttgcggttgtgccggtccacgaccgtgccgccgaacacgtcgctgacatgcgtggcaatttggctgaacgtggcgagccatccggcgagcaccaccgattgggtgagcgagaaggcgatcagcgagatcgcgaagcctctcatcgcggctccgatcgtcgaggcggtgtctgcagtgaaccattgacgatatgtggggttgccccacagcgattcactgcgttgcggggaagtgcgttcgcggtgtggcgcggtttgcgcctgcgatgattcgggcatgatgtttcctttgaataagttgaggggtgttgtgcgtcgaggggtgaaattgcgtatgcttgcgctcgcccattgcattgtgggcgcagggcgtggggtgagagggtatgtcaggccgccgttatggcagccatctgaaggcgtcgatgttgagcatgacgggttgcgagccgtccccttcctcgtgtgcgaggtcgcgtgatgtccatgtgttgaagagctcgcgcaactcctgtgacatgcgcgcgtattcctcgcttgtcagccgcagcacgctgctgctcgtcaccgttgggtccgtccactgtttgggcaggttgtcagaggccgacctgtatcgctgccatgcctcttgccgaagcgtggagctgacctgatccattgtcgtcgccattgccgaatcgacggccgcgtccgcgttgatttccagtctgcgttgggcggccagccagcagcttctgcggttgtctccgtcgggtgatggcgtttgcgtgacgaatccggccttttcgagctgtttcaggtgatagctgaccgttccggccgattctccgagctgttcggcgatctggccgaccgtgacgggttcggtgtcgctcatcacggtcagtatgcgcagtcgtgtggggtgcgacagcgccttcaggcggttcgtgtcggtgactgtcgcggggttgtcgcggcggggcggcgtctgcggttgcgccgtgtcggaagcctgtgccatgtccgttccttccgtgcctcatgacacctgtcgcgtgtgatgctgcgctcatgttatgaagcgatatccaattgacaagaaatattgtacaacaactcttgtataaatcaagtgcccccgtttttttcccgtttcatgttaggctcgcataagagttcaagcggtggttcctctccttcaagaaacaccgcggataccggcgcgtgttggcataggtgccagcgcgggcaggggggtattagtgcgcgaccgcagcgtggcgcaagtcaaagaagactgaaagggcatggctcatcatgatgaatgcacggcaactgtgggcgaaggcgtgacgttgttcgcgtcggtgaaggagggcgcgtgatggcggaatcggcacggcactcagggcgcaaaactccctggaagacgatcctggcggtgttgccggtggtcgcgatcgcggccggcgactacaaggacgccgcggccggcgagacggcagcgctccagaacatcgtaatgtccccgtgcccgttcgacgcggggcatggggacgttcgtcatgcgcggcggatacgggctggcgcggcccgtgtatggccaagtacagggccgtgccttatccttgggggagagaacaaggcaaggagacatcacgtcatgcagcagcagaacatgggagagcgtacgccgcagggcacgccgcgtcacgccggcccgaagccgctgaacacgccggaggagctgcgggccatccggcaggccatggacgagggcaagaacccgctgctcgccacgggcgtgccgcgctgggaggatcaggtgggcgtcagccgtatcatcaaccgccgtgtgctggagctcgaaccgctgcccaccccggcccaggtgttggcggaactgcctcttgactccgccgcgcaggagatcgtcgcctactcgcgcgacgagatacgcgcctgcctgtatgggcaggacgaccgtctgctcgtcatcgtcggcccctgctcggtgcacgacccgaacgccgcgctcgactacgcgcaccggctgtcgaaggtgatgaaggagaccgaaggcgaactgctcatcgtgatgcgcgtgtacttcgagaagccgcgaacgacggtcggctggaagggactgatcaacgaccccgacatcgacggcagccacaacatccgcaagggcctgctgctcgcgcgcaagacgctgatcggcgtgctggacgaaggactcgccgccgccacggaattcctggagcccaccagcccccagttcatctccgacgcggtcagctggggcgcgatcggcgcccgcaacaccgaatcgcaggtccaccgccagctcgccagcggcatgtcgatgccgatcggattcaagaacgcgaccgacgggtccgtcaaggccgccgtcaacggctgctacgcctccgcgcagcagcacacgttcttcggcatcgaccacatgggccgggcctgcgcggtggagacgctcggcaacccggactgccacgtggtgctgcgcggctcgatccacgggccgaactacgacaccgcatccgtgcgccgtgcgatggacgacgtgcgcgcgatgatgccggcggaatctgccgccacccacgggctcatcatcgactgctcgcacggcaactccggcaaggacgagcaccggcaggcagaggtcgtgcgagacatcgcccggcgcatagccgatggcgaggaaggcatcaccggcatcatgatggaaagcttcatcgaaagcggcaaccagccggcggccccgctcgaccaactggtctacggcaagtcgatcaccgaccgctgcatcggctgggacgagacggaacggctgctgcacgagctcgccgacgcggtgtccgcccggcgctggcgctgaaacggcgtccattactcttcacgaacaaccacacggaaaggattcccatgaccaccatcgccatcatcggcgcattggacgacgaagtcgcactcatcgccgcatcactgaacgacgtcacccacgaccgccaagccggcctcgacgtgacgcgcggcacgctgggaaccaacgacggaggcaccgtcaccgccgtcgcgaccgtcggcggcatgggactggtcaacgccgccgccaccacccagcacctgatcgacacataccatcccgacgcggtgatcttctccggcatcgccggcaacctcaaccggaacctgcacatcaacgacgtggtgctcggtggcacactgcgctacctcgacaccgacatgcgactcgtcggccaatggaagcccggcaccgagcagcagcccgtcgaggaattccactccgacgaccgtctgctgtccctcgccgaccaggcgctcgcggccatgggcgtcacgcacatcatcggcatcatcgcgtccggcaactacttcgtcgatacgccggcgcagatcgccaaggtcatccacgacaccggcgccgacgccgtcgagatggaaggcgcatccgtggcgcacgtcgccgcccgaaacgaagtacccgcgctggtgatccgcgcgctgagcgacaacgccgacaccgactacgaggagttcaagggcttcgacatctccgaatacgcggataccgcggcccgcatcgtgctcgacatcctgcggcgcatgtgacgccgggcgcggctcgctccgacgggctgcgccgcggaaggacacggcaagttgaacaactggcaaacttacgtagtcgcgctggcggcgggacgtgcggagccgttacgctgaaaccatccgcatccgcatcatcggtgcgggtggatgagagcggtgcagggccgaggaaaggcggggcgggtccgatgacatgggtgcatgtggcgttggcggtgctggtgacgattatcgtgttggtgattgccgtatcgaggtcgtacgcgctggggcgcgagtccggcgaacgcgacacgctggcgggacaggggagcgattccggctcgctgttcggcaccgacgtgccggtgcgcgaggcggaacaggggctcatcgacgtcatgccgtccgaggtgatcgtctgcgacggcaacggttccgtgcggtgctccagcaaaagccaggtgaacgtcgatgtcatcgagaacggctggatcgtcaaggacgagatcctcgacatcctgcacgtcgtggtggagaacgggggcgtgcgggaacgcgagatgtgcgtctcgctcgacctgacccgcatgtcgagcgcgatttccggacgaggtgtcaccgccggcagctccgcgccctccgacagctacctgcgcgtacgcgtcggccatatctgcgacggtctgtacgcggtgttcatcaacgacgtgaccgagcagcgtcggttcgagcggatgcgccgcgacttcgtcaccaatgtctcccacgagctgaagacccccgcaggcgcgatctcgctgctcgccgaaaccgtctccgacgcggcggatgaccctggcgccgtgcggtatttcgccggccgcatcaccaaggagtccgcgcggctgaccgaactggtgacccacctgatcgaactgcagcgcgcgcaggacgcgccggcgatgctcaaggcgcagcgcatatccgccatgtcggtggtgcgcgcggccgtcggcgagaacctggtgcaggccggtgcgaagcacatcgccatacggctgtcgctgcgcggcgagcaggcgccggtcgacgctgacgccgccgcggacgacgaggcgcagcgcgacatcgccatcatggtcgaccgggagaccctcaccatggccgtgaagaacctcgtcgaaaacgccatccgctactcgcccgaatacacgacggtcagcgtgagcgtctcgctgtgcaaggacccaagctccatgacgattcgcgtgatcgaccagggcatcggcatcccctcggcgtcgctggaccgcgtattcgaacggttctaccgggtcgatccggcgcggtcgcgggccacgggcggctcggggcttggcctggccatcaccaagcattgcgtgcaggagtgcggcggtacgatctccgtatggtcgcgcgagggcgaaggctccacgttcaccatcgagctgccggtcgcccccgaaccggatgacgatgacggcgagcgggcggatgacggcgaagcgcccggcgagaccgtcggcgcgccgggaggcggcgacgccgcgacgcaggagtagacccgccgccacggtctccccggcgcgtcggccacccatcgtgaaacccgcggaaaagcaacgtagtcttcggagccgaatgcgggcggtgccggaacacgctacgatggtgacggtacggacattgaacacagtatgtgtgaaaggtaaacatgacacgcattctcatcgtggaagacgaggaatcatatcgtgagcccttggtgtaccagctgacgcgcgagggctacgacgtctccgccgcagccagcggtgaggagggcctggagctgttcaccaagggcggcatcgacctggtgctgctcgacctgatgctgccgggcatcgacggcacggccctgtgccggcgcatccgcgagcagagccgcgtgccgatcatcatgctcaccgccaaaagcgccgagatcgacaaagtcgtcggtctggagatcggcgcggacgattacgtgaccaagccctactcgttccgcgagctgctcgcgcgcatccgcgcggtcctgcggcgcaatcagggcgcggtcgaggccagcggtgtggtcgacgacgacatcccgctggtgtgcggcgacatctccatgcaggttggccagcatcaggtcaccgtgcgcggcgaaagcgtgttcttcccgctcaaggaattcgaactgctcgaatacctcatgcagaacaaggggcgcgtgatgacccgacaccagctcatcgaccgcatctggggctccgattacgtcggcgacacgaagaccctcgacgtgcacgtcaagcgcgtgcgctccaagatcgaggaggatccggcccatccccagtacctgaccaccgtgcgcggcctcggctacaagatcgacagcccgcagcagtgaccggcccgcacccggtataaagcgccctcggcccgcctgaaccacccggtgcaggcgggccgaaccatatcccgcaaaccgcgcattccaactacgtggcaaggtcggcaactattcatcttctgtttaccgattttgtcttccgacccctcgaacagcccataggctagtaactgtcatgaaaaggaatcggctctgaatcgtatgacacgagccgctatgacagttgataagaggaaagaaacaatgcgtaagaatctcttcgttcgttccatcgcggcggtttccggcatcgtgatgctggcgtcgctcgccgcctgtggcgacaacacttcgtccgccggcaacaactccggttccacctcgaccgagaagattaccggcagcttctccggcgctggtgccacctcccagcaggcggccgaggaagcctggatctccgcctacatggcggcgaactccggcgcgaacgtcacctacaacccgaccggttccggcgcgggcgtcaccaccttcctgagcggcgccaccgcgtgggccggctccgacaaggccctctccgatgacgaggtcacccagtcctccgacaaggcgtgcgccaacggcaccaccgcgttcgacgtgccggtctacatctccccgatcgccatcatcttcaacttgaagggcgtttccgacgccggcaagcacatcaacctcgatgccgacaccgccgccaagatcttcgacggcaagatcgtcaagtggaacgatccggccatcgccaaccagaacaaggacctgaccttgcccgacacccagatcaccgtcgtgcaccgctccgacaagtccggcaccacgcagaacttcgtgagctacttcaaggaccaggcccccgactcctggacccatgagctctccgagaactggcctgacatccccggccagcagagcgccaagggcacctcgggcgtcgtcaccgccgtcaagcaggccgacggcaccatcggctacgccgacttctcccaggtcggcgacctgggcaccgcggccatcaaggtcggcgagaactacaacgagatctccgctgacgccggttccaaggtcatcgaggattccgagatcgacacatccgccaagggcgacaaccgcgtggtcgtgaagatcaaccacgccaccaaagccaagggcgcctacccgatcgtgctggtctcctacgacatcgcttgccccgcctacaaggacgccaacaccgccaagttcgtcaagagctggctcacctacgtgaccagcgacgaaggccagaagaccgcctcctccgctgccggctccgccccgctgccgagcaacatcgtcgagaaggtcaccaagtccatcgaggccatcaagaccaagtgatcagcgtgagctgacacgccgtatggcggatgccgcagaacacctgacacaatgaaaggtgtctgcggcttctgtcggttgtacacggccgtgaagccaccattgaaaatgcatacgaaggagaacctgtgagttcgcaagacaaagcggcagacagtccggccagtacaggcaagaccggcgatgtcgtgttcaagacgatcgcctatgctgccggcattctcattctcgtcgcgcttgcggcggtgttcctgttcctgctgtttcaggcgtggccgctgatcggaggcgatcaggccgcgaacaccgccaccatcgaatcattcaccggcaaccgcgcgcacaacttctggcagtacgtgggcccgctggtgttcggcacagtgcttgtctccgcgctgtcgctgatcatcgcgtttttcatctcgatcggcatcgccctgttcatctcgcattacgcacccaagaagctggcgaccgcgctgagctacgtggtcgacctgctcgccgccatcccgtccgtcatctacggcctgtggggcggcctgattctggtgccggccatccagccggtgtggaactggttcgcgaagtacctgaggtggacctacatcttcgatggatcgctcaatgacccgtcggtcgccgacagcccctcgcgaaccgtcgccacggtcgccgtcgtgctggccgtcatgatcctgccgatcatcacctcggtgtcgcgcgacatcttcatgcagaccccgcgtctgcaggaggaggcggccatcggcctgggcgccaccaagtgggagatgatcaagctggccgtgctgccgttcggcaagtccggcatcgtctccgcatccatgctcggcctgggccgcgcactcggcgagaccatggccgtcctcatgattctttcccccggcctaacgtactcgatcaagctgctgcgggcatcccagaaccagaccatcgcggcgaacatcgcggcgcaatacccggaagccgacccgaacatcggcgtgcccgtgctgatcggcaccggcctcgtgctgttcgttatcacgttcctcgtgaacttcgtcgcccgtaagatcaccgagaaagcgagcgcatgatgagtgaagcaactgtaaagagcaccatcagcgtcgacgcgaacgccgtgaagaagacgcccgccgcacgcaacgacaagcaactgcccgacatcgacttcgaccggttcaagaccagccgttccttcgccgcgtcccgcaagcgcaaggacgtcttcatgaagagcctgatctgcctcgccttcatcatcgcgtgcatcccgctgatctcagtgctgtggacgaccgtcgccaacggcatcaagcgactgaacctcaacttcctttcgtacaacatgtccggcgtcgtcggcggcagccagacgccctccggcggatacggcggcgtgctgcacgccatcatcggcacgttggagatcaccttgggcgccatggtcatctccgtgccggtcggcctgatgtgcgcggtctacctgatcgagtacgcggcccgcggcaacaagctcgccaagtccatcggcctgctggtcgacgtgatgagcggcatcccgtccatcgtcgccggtctgttcgcctactcgatgttctcgctcatcggcggccccggcaccatcagcggcttcgaaggctccgtcgcgctttcgctgctgatgatcccgaccgtcgtcaagaccagcgaggagatgctgaaggtcgtgcccggcgacctgcgtgaggcctcgtacgcgctgggcgtttccaagcagcgcaccatctgcaagatcgtgctgcgcaccgccctgcccggcatcgtctccggcgtcatcctggccatcgcgcgagtgatcggcgagaccgcgccgctgctgatgaccgcaggctacgcgacgttcaccaacgtgaacctgttcaacggcgagatgaccacgcttcccgtgttcgtctaccaggaatacagcaagctgcgtgccaactgcccgcccaacgccggctcctcctgcgtcaccacgataccgatggaacgctcctgggccgccgccctggtgctgatcatcatcgtgctgatcctcaacctcatcggccgtgtcgtggctcgcgtcttcgccgtgaagtccgaacggtaagccgccgtacactgtatatacatcaataaaggaattcatatgggacaacgcattgacgtcaaacatctgaacatctactatggcgacttcctggccgtggaggatgtcaacatcaacatcgaacccaacaaggtcaccgcgttcatcggaccgtccggctgcggcaagtccacggtgctgcgcaccctcgaccgcatgcacgagatcatccccggcgcccacgtcaagggtgaggtcgagctcgaaggcaagaacctgtatgccaaggacgtggaccctgtcgccgtgcgccgcgatgtcggcatggtgttccagcgcccgaacccgttccccacgatgacgattcgtgagaacgtgctcgccggcgtgcgcctgaacaaccgccgcatctccaagtccgacgccgacgacctggtcgagtgggcgctcaagggcgccaacctgtgggaagaggtcaaggaccgtctcgacaacccgggcatcggcctgtccggcggtcagcagcagcgtctgtgcatcgcccgcgccgtggccgtgcacccgcaggtgctgctgatggacgagccgtgctccgcgctcgacccgatctcgacgttggccgtcgaggacctgatcaacgagctcaagggcgactacacgatcgtgatcgtgacccacaacatgcagcaggccgcccgtatcgccgattacaccgccttcttcaacctgaaggccgtcggcgagcccggccacctggagtacttcgcggacaccaccacgatgttcaacaacccccagaacgccgaagccgagcgctacatctccggtcgtttcggctgatcggcggcgcgctggcggatcgcatgcgctgcgtccgcccgcgcgtccatcgccacaagaccccgcctccgcgcggggtcttcgcgtttgtgagggggagctccggaatagaagaagcgacggcgatgctggacaactgccgcgttgtgcgattttgcagatgttgtacaacgacattcttgactgtcacgctccgctccacccgagaacgttcgcgttgttcccggtcatagcatgattcgacgcctatcgtcttcggtcataccgatacccgtgcttcctcgccagttcctctaggctgattgcgatgacctcgaattctatcgtcgctccgcgctcggcgagtcgtcttgctatacgcagggccagttccgcaatcgacatctcgtcaatcagattttgagcggtcacgatgattaatatccagccgtgggcccgcagccgttccctttttttcgttgtctcggcgccattggaccttatccgttcgatgatgatcgccgtcatattccactccgaccttgaactcgacccatgcgatgtccagcgaaatggctgctcctgaacgaaaggtgattccaggaaccacgacattgcatcgtccatccggtattccgtggcgttgaacacccagccgtagcgagctttcggcgggagaccatacattggggcgtaccagtgtcatggcttgcctgcaaatgctttttcctcggaacggcggcatctcttttatgaaacgctgcaactccagatacaatttgtccgcgtccggcgcgccattgcgtaccagcatcgcgagaatggaatctccgagcacaaccagatcctctgtcgaaagatatggggacagctgcgcccacacatgaaacacgtgcaatgcgtgcacgccattcgatatgtggatgagtgattgcggagtgcaatggctccagatgtggacaatgaccgggacggatttcaacggtcgaatatgaggcctgccggagcgcgtccgcaccgtgacatgcagcgcggccgtgtcgagattgcagtgggagggcaccggcacgccttgcagttccagagcggtggtcatgccgaagagcagctggcggtcggactgccctaccgtggcggtgcagcgttgcagagtctgccgcctaatctgttccaatgactggaacatggtggctgtcggctcgcccggtatcggttcgtaatcgttcatgggcgcaacgctagcgggtcgggggcccgcgcgccaccgacggcgggatttctgtggatatgtggatggagaacgggttatccacatatatccacaggccgtccgacaccataacatccatgacttatgaagatgttatggtgggcgtgttcgggaaaccgggcgaatagcagtttgtctcgccgaggccggatggcctcgcacattcaaggaagcagagaaagtatggagaagttcttccatttgaaggagaacggcacgaccgtgtccacggagatcgtggccggcctcaccacgttcttcgcgatgagctacatcatcgtcgtcaatccgcagatcctgcaccagaccggcatgccgtggggcggcgtgttcctggcaacgatcatcgcggccatcatcggcacgctcgtcatgggcctgttcgccaatgtgccgtacgcgcaggcggccggcatgggtctcaacgcgttcttcacctacacggtgtgcttcggtctgaagttcacgtggcaggagacactgtgcatggtgttcctgtgcggcctcatcaacatcatcatcaccgtcaccaagatccgcaagatgatcatcgaggcgatcccgcccatgctgcagaacgccatcggtggcggcatcggcatattcgtcgcctacgtcggcatgctcaacgtcaacctcgtcaccttcaccccgaaggacaccaaggccgccggcaagggcctggccaccggcgccacgcctggtctggccacgctgaacaccccgaccctgtggctgttcctgatcggcctgctgttcgccatcgtgttcaccgtgctcaagctcaagggcggcatgctgctgaccatcgtcatcaccgcgatcatcggcatcccgatgggcctgaccagcatgtccaactccgtgtccatctccgacacgttcgcccagctgccgcagaccttcggcgtgatcttcagcgccgatggcttcccggcgctgttctccgacgtatccaaactgccgctcgtgctggtcacgatcttcgcgttctcgatgtccgacacgttcgacacgctcggcacgttcatcggcaccggccgccgcaccggcatcttctccgatgacgacatgaagcacatggaggacggcaagggcttctcctccaagctggatcgcgccctgttcgccgactcgatcgccacctccatcggcgcgatctgcggtacctcgaacaccaccacctacgtcgagtcttccgcgggcatcgcggcgggcggccgcaccggcctgacctccgtggtcgtgtccatctgctttgcgctgtcgatcttcctgtccccggtgatctccgcggtgccgtccgcagcgacggccggcgtgctggtcatcgtcggctgcatgatggcctccagcctcaaggagatcgagtggagcgacatctccgaggcgattccggcgttcttcgccgccgtgttcatggcgctcgcgtactcgatcagctacggcatcgccgccggcttcatcacctactgcatcgtcaagacctgcaagaaggaagccaagagcgttcacccgatcatctggattgtctcgctgctcttcatcctcaacttcatcctgctggcagtgctgtaatggcatctgccctgccttgaatcccggcccccgttggttttccagcgggggccggattcgtatcgtgccgtcttgtgtgtttgctctctcggcaatacgatggatgtaagggacagaacggactgccctgtaccacccgtcgcgacgatggtgttgacggtgggcggcgatccgtccgcagacgacgatcagatcgtggcctgcgagatctacatcagcggccagctgctcgacagccagtaccggcgcggcaaggacgtcacggtgacatgctcctacagctcatggcagcaggagccgttcaacgggcgcgaggtcgacctgccgaggctcggcgaatacggcaacgatctcgccaagcttgtgtcctgataagatcgaggccgttgtctttcataacacatagactgagtggatgctgagcgcaaggtcgcgattggcatactggacaatcagaaacagctggcaaagataaaggctgggacacaatagggtggccgattttcagaggtgaaagaaagcgatgtccataaatgaaccgaagaatatccacgtggttgcgcgggcgtgaccttccatggagacctgccgccgccgtgatcgcgcaggtcaaggccaaggatctgggtgggtatacggatgagtccgtccgggcggtgcgtgatgcgcttgctgcagccgagaaggtcgctgccgatcctgatgcgacgcaggtcgcaagtctgaatgcggccgtcgacgggctgaaggccaaggatgacggtgacaagcccggcgcgggtgatggcaagcccggcgacggcaagccgggcaagggcgacgagaccaagcccgataccggcaagaagggcgggctgagcgccaccggtgccggcatcgttccgatcgccgccgcggccctgacgctcatggccggcgcggcgctcgcactggccaagcgctgagacgccatggggcggtcggcccgtcggacggagatttttcgtccgacgggccgattatttgcagcctccgaccacgacacgcccggagtgcgtagcacaatcgtcgcgcgcgtttgcgggaatcggctccatggcggcgtttcatgaaattcggcatgccgatcttgctgagcactccgggcgtgtcgcgatggaatgccgcctgtttagtcaacattccggaccgatgtgagccgcataggtcttcgctggcaaatcctcacttatggccacgattgccgtgagaaacttatggtattggcagcgtggcgttgataatgcttgacgccgtgaagggatagcgaggtctgcgacatgaggaaccgtgtgattcatcgcaattcgcgcgccggcgattcgccgttccgtctgctcgccgcggcgctcgccgtgctgacgttgaccttattggcggttatggtgccgtgcgagggagaagcgcacgcagccgcgcccatcaagatcgcatgcgtgggcgacagccttacggacggctccaaatccagtggcggcaagaaaggcgacaccgcatatccggcgtggctcggccgcatcctcggcagcagctatgacgtgcgcaatttcggcgccgctggtgacacgctgctgcggggcacgggctggtcatattgggattcggccgaattccggcagagcaaggagttcgcccccgatatcgtcatcatcatgctcggcaccaacgattccaaggacgcctactggaacgagacactgtacaggaccgaggcgaaggagctggtgagggtgtaccgggatctcgccagccgaccggtcgtgtatttcgcgagttcaccgcactcataccggatcgcccccggtaccaaatatgtctccgtcaactccgtgaacaggttacatcccgtacaggagtcgctgatccgtgacgagcgttggaacaccatcgacctgtacgcggcgaccgcgaaccggcggcagctgtatgacgccgacggcgttcacttcaacgacgacgggtaccggttcctcgccgagcagatcgcaggcgtcatgcaccggtcggcgcagatcatcggctccaccggaagggagcgggtcatcgcaaacgagacggagaacggcgccacgaaaagagccggcgtggaattcggccttacctcgcagggtaccgccgccgggaacgccggcgattcgtccgatggcaacgggaaacgggatgccctgcgcggctccgatgccgtcgtggccatcatagccatgctgtcggcgggcattaccggagtggcgctcgtgctgggcggacggtcgcgacacgcccgggttgaaggtgtccgctcgcggccgtattctatatgacttgtaaaccacagaccgttggttggagtgtgcaagcactcacgaagtttggttcgccaagccagcgcaggttgagaaatatgtgcctgtaatacggctcgccggaaacggttgtatgttgctctgcctgtgcgcagggcttttttattgccctggcagggtgcgcgggacttcgcaggatcaatggccgatctaggaaggaacgccatgaagaggcccgaaaaggaagcggtagtcgctcagcttacggaacagttccgtaacgccgacgctgtctacctgaccgagtaccgcgggcttaccgttccgcaggtttccgaactgcgcgaaaagctaggccgcgatacttcctacactgtggctaagaacacgctggcgcgcatcgccgccaaggaagcgggcattgagggtcttgacgacctgctcaagggcccgaccgccatcaccttcgtgaagggcgacttcattgaggctgcgaagacgctgcgtgactttgccaagaccaacaaggctctcgttatctcgggcggttatgccgacggcaccgtctacgacggcgagggtgctaccaagctggcggacatgatgtcccgtccgcagctgctctccaagttcgcaggcgacctcaaggccacgaccgccaaggccgcgtacctgttcgtcgctgtgcctaccaaggccgtgcgtacgatcgacgctctgcgcgagaagcaggaaaaggcagcttgattctcatgcggcttgccgcatgaaccacaatcggaaaacaacacacatcaggcggacggcaatcgctgaaggccgccgccagaatgaaaggaagccatcatggctaagtacaccaacgaagagctgctggaagctttcggtgaaatgaccctcgtcgagctctccgagttcgtcaaggccttcgaagagaagttcgacgtcgaggctgccgctccggccgccgtcgccgttgccgctccggctgccggcgctgccgccgaagaggaagagaagaccgagttcgatgtcgtcctgaccgctgtcggcgacaagaagatccaggtcatcaaggctgtcaaggccatcaccaacgctggcctggctgacgccaaggccatggttgatggcgctccgaaggccatcctggagaaggccaagaaggaagacgccgagaaggccaaggctcagctggaagaggctggcgccaccgtcgagctcaagtaatgatcgcgggagtgaaacccgcacattgcagctttgcacagaccctgctgtcgcacacgcggccgcagggtctgcgcgtatgcggcggtccgcgcaccggagccgagaccgcttctgtgaacgcctgacacggcctgacatgggcgttccgcaccggtgtgcgctacaatccgaaataccggcatcaatgcgataatgttgtcaattcatcggtcatcaatccctgaaaacacagcgggacatgacacaatggcacatagtatgcgaacgagcgtgaaaggaagggcggcacgtgactggcgatcagcggacgatacagcagtggacggtgagaatcggtggcatcgatcagaaaaccgtgaagccgggagacagcatcgaaatcgggcgcaagccgttgcggccgttgcccgatgacggcaccgaacgcctggagatagcggacggcacgcggtccatgtcgaaacgccatgcgaccttcgcggtgagtcagaacggcggcggcaccgtgcgcgatctgggctcgaccaacgggtcatatgtggtgcggggcaatggcgatctcatgcgtctgccgccgaacgtcgatttcctgctgccgacttcaccgatgcgcctgcaattcggcgatgtccccgtcgatttcattcgtgtggagcagccggtgagcgacacgttcgtcgtgcccgacctgttcggatacgctttggagaccgtcaagcaggagccggatgtggccgacatgtcggtggatgacattcttgacctgcgtgccggggaacctaccgccgcgatcagcgctgccaccgtgcgcaagcgtgtcggtgagctgaatgccgccgcatcgcagacgttcccgccgcagaagacgaccacggcggatggattggcggcggattccgcggccggtgccgctgagccggattcggagcttgccgtttcgtcggatgctgccatgcccgttgaggccgcggtgctggccgaaaccgtgtcgccggctgaggccgacgctgccgagagcgatgccgagaccaaggttccggaagccgccgagtcctccgagaatgcggcgcctgcggatgccgttgatgccgcggacgcggccgtatccactgagactgcgacatccgatacggcatcgcctgaaaccgtgacttctggaaccgtggcatccgagtccgccgcggatacggtaccggctgattccgctgtatctgattctgtagtgaccgcggcccaatcgcagaccaacgatgagccgagcgagcccgattccatgccgttgaacgtggccggtgccgatgctaagccggtggtggcgttgccccgcgacctgttcgccgacgcgctcgccgaggacagcgaagaggccgggcagtccaccgcgcccgcagagcaggcggatcagttggcgaacggacagccgtccgacgaccgattccagcaggcgtcatccgatcaggaggcgcacgacgacatccgtcaggcggtgaacgaggtcgcagccaacgcggccggtgtggaagtcaccgccggcgccgtggcaggcgacggcgtcgtgaaagccgatacggacatcgcccacggggagattccggaagagcaccgccggttcgcgcaaccgaacgacgacgaggcggactcgaccggttcgttccgacccgcattcgagccgggatcggtgttcgaactcgtgtcgaaaggcaggcttgccgccgccgaaccgaaaatcgaagtcaacgggtacacctctgaccaggcgaagaccacggaagactacaccgagcagttcgccatcgcgaattgcgaagagctgctgccgttccttgccatgaatccattgctgtacgatgacctctataattggctggaagatcagggcaaagcggacattgacgccgcgctggagaacaatgagggctacaagagttaccgcaaagcggtagggaagtgagtcgggtcatgagcgaaagcatgcaacaggcgccccaatcgctggaacgcatgcgtcaatggcatgaacagtaccgcgccggattggtgccgtccccattggaggacatcaaccagcttggggcgaagctcgatttgacccatgcgcatccctccggcatcgcccagctgttcgcgggaggccgcgcgtcgctggatctgctgttccgcgacaacggcatgctgcgtgcggcgaaccgccgactggagcgggtgcttgacgagaaggccgcgaaactgcgcgtcagcggcgtcgcggaactgtctctcaccgtgggagtcgccacatgggacgacggtgccatgccggtgctgctgtatccggtatccgtgcaaagcgcccaggatgaaggcgatgtggcggtgatccggttcgtcgggcatgtccggctcaaccccgcgttcgtgacggtgatgcgcgagcagcacgtcgaacttgacgagcgggagctgttcaacggcgccaactacgagagcggcacgcccgaaacgtccgcggtgttcgcggcgatcaccaagcgtgcggagaaggtgttccccgatttcaccatcgagcggcagattatcctgggctgcttcatgtcgcccggctcgctgattcttgccgaaagccagcacattatcgatacgctggccgagggggcgaccggcaacacggtgctggacgcgctcgcgggcagcaaggaggccgccgaagcgctcaaggactccggcgcacctgcgttcagcccattcgacgccgatccgcacaacgagttcgaagtcggcgatgtcgacaacgccgtgcggtacgcggccgatatggtcgcagccgggcattcactcggagtcgatgtcgtcaacgggcgtgacaccgccgattacgccgccgccatcgcgtcgcgctgcgtgatgaacggccgcagcgtactgtacgtgccgtgcatcgccgatcagaagcgtcgtttccgtcaggccatcagcgccaatgagctcagcggccaagtgctcgacgtctcggacgagcgctgcaatgacagcatcgaccatcagctgatcgccgcggtcggattccagcccggcgtcgccagctcccggttcgaccagatcgccgatgagctggtcggcgtgcgttcccgtctcacccggtatctgggtgacctgcactgcaccgacaagcagtggggcgtgtccgcgtaccagaccatacagaacctcgccgaaatcgccacgttgcccgcgcatcccgccacccgagtgcggttgcgcaaggagaccgcgcgtgagatcggcggtcatctggacgaatgggcggcgaagctcaggcgtgccggcgagctcggcgaattcacgctcggaccggaggataccgcttggttcaaggcctccattacgtccgaggacgaggctgtgaccgtctaccagcgtgtggtcgatctgctgcgcaagttgctgccgttgacccgtgaacaggtgtcgtccaccgtgcagacatgcgggttcccgataccgaacaccgagcaggagtggggccgtcaggtgcaggtgctgaagaacctgcgccgcgtgctcgacgtgttccagccggagatcttcgagcgcgacatcgacgcgatgatcgagtcgagcaagtccaaggccgaacgcaaggccgaaggcaccactatcggattctgggagcgtcgccgccatatcaaggaggccaagagcctgctgcgcgtgggcgcacaggtcgagaacctgcacgatgcgctgcaggtcgtggccaagcaggccgcgcaatggcgcatgttcgtgcctcacggcgggtggccggtgctgccgaacaaactcgacgacatcatcgccacgcaggaggagctggcccgcgacctgacggcgctggacgccgtactgtccaccaccgtgcagggcggcgatctggaatcgcaggatttcgtcgccgtcgaggaacgtctgaaggcgctgttcgacgaccatctcgcgctggacacactgccggagcgctgccgtctcgaacatgaattccagacggccgggctcaccgaactggtcgaggacctgcacacgcgccgtgtgccggtggaatcggtggatgccgaactgcagctggcatggtggaccacggtgttcgagaacatcgtgcgggcgtccgcgatcatctccaatcaggatgggtcggcgttgcagtccgctgcggatcgtttcgcgcaggtggacaccgaacacgtgcgttcggtcggtccgatggtcgcgcaggaatccatgcgccgcctgtgtgaaatgctgttctcccgcacgcaggaatccaaccagctgcacacggtgctggccggcaagacccgcatcccgctcagccggatacgccgtgaccaccccgagatcctggccgcggccaagcccatcatcgtggcgaccccggccacgcttgccgcgctcaccgatccgacgaccctcgccgacgtggcaatcatcgacgcggccgcgcacattccggccatccagttgctgaccatcgtctgccgcgcgaagcaggtggccgtgctggcccaccggtccaccgtgacctcgccgagcgtgaaggcgctgatggagctgctgccgagcgtgaaggtccgctcccaccccgtgcggcgcgcgcccaggctcgccgcgttcttggaatcccaggggtatggcgaggtgcgctatgacgtcacgaccgagccgtcgcaaggccgggtggccttccacaaggtcgaggcgaacggaacgccggtcatggccaccggattggtcgagagcagccagcaggagatcgatgaggtcgtccgcatcatcaccgaacgcgcggcgagtttcaacgtggtgccagtcggctacacgctgaccgtggtcacgctcaccgacgcgttccgttcgcgactcggtgcggaactgaaatcgctggcgtcgaagaacaagaccatggggcagttcctgcgccacgtgcgcatcgtcgcgctgccggagatcgccggggcccagtcgacggacgtgattctgtcgttgtgctacgcgaagaccgtgcatgggcgtctgctgcagcagttcggcgtgctggagggcgaaggcggacgtgccatgctgctggatgcgctggcgctgtgcgaccgccatctcgatatcgtttcggcgttcgacgagtctgatctggacgatgagcgacttcaccagcccggaccgcagctgctgcatgccatgctgcgctgggtggagcagctggacgaccacgtggtgcgtccggtgaccatcacccggtcgaacaatgtgctgttcaatgatctggcggagcgcgtgcggtcccgcggactgaacgccgccgtcgactacgggttcgaccgcggcctgcacattccgatggtcgtcgggttgcccgacaagccgttcgcgctggccgtgctgaccgacgacgcgcagttcatgagcgtgcagtccacgcgtgaacggcatcgcggcctgatgcaggaccttgcgtcgctgggctggtcggtgatgagcgtgtggagtgtcggcgcattcgtcaacccggacaaggaggtcgatgcgatcgtgtcgcgcatcggcgagatctacggggatgtgcgatgagcggcgatactactggtgacggggatcgtgtggccgcagatgcctcggagccaaggccgtacagtgcctcgcgtcgtacgcggcgcgagcacaaacgcgtcgtgttccacggaaccgagcgcttcgatgcagacggcgtgaaactcgaaccgggcgatatgcgtaccgagcagcagcgcgaggccgacgacgacaaacgcatcctcggcgaactgccaccccactgggccatcttcaacgacaaacgttgagtgtggtgaccaccccagtcgcgcgaacagcgagactggaggtggctgctgcggctgagcaactgcagctattgcgcagtgacggccataatcggaccgagttcctgtgcgttgatgattgatatggcttcgtcgggagtcaaagcgaacgtgatgagcgtgccgccggtcatcgcatcgtcatgggcggcatccatcgccgtggccgatcgcgcgagaacgcatgaccggccgcctgcggattcgtcacgcgatgaagtcgtaccagtcgaagcgtcgcaaggggtgccggataccagatccatgacatcaccggccgcgatgccgtccacagtgccggtgacccgtacatcgatcaccgtctgaccgggttccgccaccggccgccgcgaaactatggcgccgaacagcggctgcccggcggcgatgtccgtctgcgcgatgcctcccgccgcctgattcgccgcatcgagcgccgtatcccaaccatccgatacgggcatctgccggatctccacgtcctccgcgccgatacgcgcgccgcgtgggatgagccgtgccgccaccacgaccggttgcgtgacgatgctcgccgtcacgcattgcagtgtcgcgaatgctgcaatggccgtgcaacaggccgccatcagccgccgtgtgagccgcagcatccgacgttggcgcaacgtggggcgcttcagcttctccaatatagaaaaagtcaccatgcaagcatggtgactgaacgttgttccgatgcgcaagccgtgacgaaaatgtggtcgaaggctcggcagttatccacatcttgggcgtgtcgcacatgcgcgggccgagcactggccgccggaagacggcgaacgcgccaatggcagctgcttatttgccggagccgccgcgcccgtcggtgcggtagaagccgtgccccttgaactcgatcggcacggcggaatacaccttgcgcacctgctcttgcccgcactgggggcacacggtgatcgggtcgtcctcgaacgactgctgctcggtgaaatcgtatccgcagttcttacaacggtaatgataggttggcacggttcctccctggtcgaagctcattatatgattccggcacgtatgcgatgcccggcatacgcatcaagtccgttcatatcctagtcgtcacgcggacaccgcgccgctcgacgtctcgttttgttccctccgcgaacttgcgcggatggcgaactacaggcgttgggctccctgcggcgtgaccacccagtcgaccgggatatcgtgagactggcggggcaggtcgtctgccatgcattcccacggccagcagacggcgacgaccggcacgcctccgcgtcggtatgtcagcgcgcggtcataccagccgccgccgcgcccaagccggacgccatgcgcatccacggccagcgcgggcacgatgatcaggtcggcatcgccaagggccgccgggccaagcgtctgcgtatccggctcatccggccgttgtgccatgccggttccctcgcaggtcacgccatgcaatgaggccatgtcgggcagcagagcccatcccacgtccagaccggagcccaagcgcggcacaaggacgcgcagcccgcggtcgagcagcagggacagcagcggccgcatggggatttcgctgcccatcgacacgtaggcggccacggtcggcggccggtgtccgcggccgtgtggcgcggacatgacgccagacgtgccggcctgcacgccgaccaagtccagcaacggcacaatgtgttcggccagtgccgccgcggccgcgtcccgttcctgccgcgtcacggtcttacgccgcgcgatggcgtcccgtctcagctgtctcttgcgcagatcgtccgacatatcggcatcggtcgtctgccggcgttggcaaaggttcatggttacgttctatcacggacgaatgtccgtcatcggcggacggtgcgccgtgtcggagacgcgacgatggcacaatgggtgcgtgtccgttttgcaatcgatatgcgccgtgttccggcagccggcagcgccatccatccgcgtgccgcggtggatcggcattccgcagtgcccgataaagctgcggccgatcacggcggacgacgaagaggagtggaacgaggtgcggtggcgcaacgatgcgtggttgcatccatgggagtcaggcgatcccatgcacggctcgccgatgacctacaaccagtggatgcagcagatgcgtcacaacgagcagaccggccgcggagtggtgttcgctatcgattatcatgagcatatcgtcggccagatttcgctgggagcgatagatctgggatccatgcgcaccggtgtgatcgggtattgggtcgatcagcggtacgcggggcatggcttcgcaccgatggcggtggcgctgctcgccgactgggcgttctgtgatccgaccggccctcggctgcaccgcatggaaatcgcattactgccggaaaacgagcgctcccgcagggtggcgtgtaaagtggggtgtcattatgagggcgtgcggccccggtacatgttcgtcaacgggcagtggcgcgatcatgagacctacagcctgttcgccgaggacgccggcgacgggttcatccatcgtctgatagctcgacacgccatgccggaatcagtgcaatcgtaaggggagtctcctattcttaaggacatgggttatgagtcgctgagcaccgtggtggtgctggtgattctgatggttatcgcggttggctggctgcccaggcggacggtcaacagcatgaaaaaggtggccgagcaccgtcaggacaggtactcgtcgtcgttgcatctggtggatgccgacagcggtactcgattctccgacgagcatacgccgcagccgaaaggggctattatgcagcgggcgcaaacgagcaccacgacgccgaccacggcgaaagtggcgcatattcgcgagcttcggcgtgcggcggtccgtcgtcggcgcatattggcgctatcgctgctgctgatcacggtgctggtactggtgctgtcgatggtcctgcctttcagcgccctgttcgcgctgattccgggcgtgctgctggcggtcgtgttggcgttgggcgtgcgggcctccagtcaggcccgtcgctgggagcatgcgctggccgaggcgcggcgcagggaacgtctggcgaaacgggccggggcgagtgcccgcccgcgagcaaagtccccgtctcaggcaaagtccacgtccccagacaagtctgcggcgaaggcaatcgctgatacggccggtgaccaggtaaccgccaccgcgaatccctctgccgagaccgaagtgaagaccgacgtgatggaacgccgggagattcgtcaggcgcttcaccgcgcacgtatcgagcaggatcgcgcgttggccgcccgtgaggcgaggcagaaggctcatgcgatggctgcgtccgaaaacggccggcatgatgtggatgcggcatcggaacagccggaagcggccgtaacgtcggccgtgcagcctgagccgcggcaggatgccgtcgcgcagccgtccgcggacgagtccgcgacgaatgtcgtggagcccgcggactcccatgccgaagtggtcgtcgaggaggggagcgccccctcgggcggcgacatgaccacggaactggatcgggtgcacccggccgcggccttggacgccttcgaagtggccgcgtctcaggatctgatttcgttctcgctgggtgagccgcgcaatggcgtcgaccgccatgcgcccgcgccggagagcctggagatcaaatcgacgaagcaggtcgcgaaggccgttcctgcactggttgccgagcagcccaccatcgtggacggcggcgatgcagggcagtcggatgcggatgccaccgtcgccgcggtcatggatgacgcctcggtgaacgataccgacgcgttccatcagacggaggtgcggtcaagcgtggatgccccggatgcgtcctccgactcgctgggaaccggccttgaggcgattcttgcgcgccgctcgtcgtgattgcgtgtgattttctctcagagcgttagcagtcgagttggcagagtgctaacaatcgcgctacgatgagtgctagcgcgaagggatgatgcccgaagtgatcgtcagcctctgaatggcggcattccatcgcgggaccatacgattggatttcaagaatacgaggtgacccacagtgtcgatcaagctcacaccgttggaagacaagatcatcgtcaagcaggccgctgccgagacccagaccgcgtccggtctgttcatcccggacaatgccaaggagaagccgcagcagggtgaagtcctggccgtcggccccggccgtcgtgacgacaagggcgagcgcatccccatggacgtcaaggtcggcgacaaggtgctgtactccaagtacggtggcaccgaagtgcactacgagggcgaggactacctgatcgtctcctctcgtgacgtgctcgccattcttggctgagtgaacgctgcacgacagcgccgtcagcacggaaccccggatcgcatgatatgcgccggggttttcctatgtctggccgcactcgtttggtagactgtgcggaagggaagacgatacaagggaattccgatgaggcaggcaatcatgatggtatgtccgaattgcggcaagccgatcagcgcgggaggtcacggccgtgcccgcgcccgcagcgccgaaagaacccgacccgagtgagacgcgtgtcgctgccgtcaaacaggtgctcgataccaagctcgcgcagtacggcggcacatggtcggcgccctacatcgatctggaaagaggccgcgacgtcacagtcaacgacgagaaactcgtggcggcgtcactggtcaagctctacatcatgctggccgtgttcgacggcatcgagcatgacaccatcaccgatgacgcgaacgtggacgccctgctgaagcagatgatcaccgtcagctcgaacgaagctgcgaacgggctgctgtcgcgcatcggcaacggcgacggcaaagccgccatcgccaccgtcaccgcgaccgcgcaacgatacggcttcacctccagcgaggagctgcgcacattgaccggcatggcctcgggcaacgcggtggagaactggacctcgacgcgcgactgcggctcgttcctctctcaggtgtacgccgggacgctggtgtcgaaaaacgccagcgaacgcatgatgcagctgctgctcggccagacgcggcgcaccaagattcccgcgggcgtgccgtccggtgtgaaggtcgccaacaagaccggcgagctggcggccgttcagaacgacgtggcgatcgtgttcggtacccatccgtatgtgctcgcggtgatgagcagcgacatctcctcagccgtggccccaagccagatcaccgaactgtcccgcgccgtatgggacgccgcacaatagccgcacccgctgacggggactgtcggcggggccgactggggtggtacgcgcaacgggtatcgaaagcaacggcggagctgacgaagacatcgcgatcgacactcccgccatgtcggcggcggtcatcggcgacatcatcgacgcgcttgccggtgtgctgtcgtgctcccgcgaggtgattgagctcgcggtaatgacgctggtcgcgggagggcatctgctgccgagcgatctgaccggtgtcagcatgtattcgcaggccaccggttcgttcggtttccatccgggaccgttgttcgccaatatcgtcatcgccgacgaggtcaaccgtgcgaatccgaaggcgcagcccgccatgctggaggccatgggtgaggggcagatcagcgtggacgggcatacccacgggctgcggcagattcgctcgatcgaaagggtccgtgatatccgtgcggcatgccgcagggtgacgttggcgcctgagatggcgtcgtatatcgtggcgctgtccgcggcgacccgtgacgcgcagggcgtgcggttcggagtgtcgccgcgaggccgcctcaacgtggcggcgatggcccgtgcgcgggcgctgatgcagggtcgtgatttcgtgatggcggatgacgtgcgctcggtggtggtcccggtgctcgcccatcgagggtgcgccagcgtcgacgccggatgcggttcggcctgatggaggcggtcggagagaccggatcgccggacgcgacgaacggcatggggtgggcgtggcgtgcggcgtggcgcgaggcgtgcgattcggcatgggacgcgggcgtgagatggtcgcctgtcgacactgagcgcggtattgccggtcgcatcgccgaatgtctggaagccgtgacgccggaaggggagtccgatttcggcgcgtatctggccgaactcgcggaccatgtgacagccggcgcgtccgacgtccgtcgcgccgtcgccggaaccgttgcgcgggttgtgcgcccggtgcgccgtcgccgcgaaacgacgcggcaatgcggtctggcggatgttcagatggctgttcccggcgtcattgcgcagaaaaacatgatgcgagtatcgaaggtgagatgccgtgataccttggaaatacttgcgacatgccgtgtgcgacacgcgagttgcaaaagtcggcgacttgtgtttagatagccaagttgccggttgaggccacagcctcgacaagcagccatggcggatttcccaagcggtcaaagggagctgactgtaaatcagccgcttcgtgcttcagtggttcgaatccactatccgccacgccccgatagctcagtggtagagcacttccttggtaaggaagaggtcgtgagtccaattctcactcggggctctctggcgggatagctcagctggctagagcgtacgactcataatcgtaaggtcaagagttcgagtctctttctcgctacaaaggccggtaagccaccggtaaacaacgaccacagaggtgaaccacatggcaagcaaaagcgccgatatccgtccgggcatcacgctggcatgcactgagtgcaaggagcgtaactacatcacgacgaagaaccgtcgtaatacgcccgaccgtcttgagctgaagaagttctgcccgcgttgcggcaagcagaccgtgcaccgcgagacccgctgagcttcatcaagtctttgtcgtaaaagcccgaccttcaccggtcgggcttttgtcgtttcatcgccccggctgtcgcacggccgccgctcgcgggacgggcgcgtgtaccctagagggcatgacgagttttgcagatctgaccactatcggcgtcggcggccatatcgcccgattcatcgaaccgacctcgcgcgtcggggtgattgaagcggtggaggacgcggactccaaagggctgccgctatgcgtgattggcggcggatccaatctgctggtcgctgatgggccgttcaatggcgtcgtcgtgcgcgacgcccgccggcagatcaccgtgcccgacgaggccgcgccggtcgagaacggcgagcgaatcgtgcacgtcaacgccgaagccggctgcaactgggatgatttcgtcgcgttcaccgtcgagctcgggctggagggcgtggaaggtctgtccggcatccccggcacagtcggcgcctcggtggtgcagaacatcggcgcgtacggacaggaagtcgcaggcgcggtcgaatccgtggaggcgtgggaccgtcgagacaagcggacgctggacatcgcggctgccgacatgggattcggataccgtatgagcgctctcaagacgagcatgtatcaggctccggcggtgccggccggcgagttcttcccgacgccgcgatacgtggtgctgtcggtgacattcgcgctgcggcacagcgccaccggcacggtcggttacggacagctcgccaaggcgctgggagtcgaggtcggtgaccgcatggagaccgcggccatccgcaacgccgtgctcaaggtccgtgcggccaaggggatgctggaggatgccgcgcgttatcttcagccggcgatggccggcaccaagcgcgacgtcaacgtgcgcatcgcgctcgaagcgcagcgtcgccagctggccgcaggcgcggacacgcccgtcgtgcgcgatcccgaccggcacagctgcggcagcttcttcatgaatccggtgcttcccgccgatgcggccgataggctgccgcaggacgccccgcgtttccccgcgacgctgccggatggcacggcgggcgtgaagacctccgccgcctggctgatcgatcatgcaggattccataaggggttcaaggtcgacgaatcctcgccggccggcctgtccacgctgcacacgctggcactgaccaaccgcggagatgcggccgcctccgacatcgcggcgctggcgcatgccgtgcaggacggcgtggaggcggcgttcggcgtccgcctcgtccccgagccggtcgtcgtcggcatggacctgcgttagccgcccaaagtcccatctcgtgcgcgttagatgggactttcgcggggtggagcaaggcgggggcgtgaccgtgcgtccccgttgccgcgtactgtggtaagtcaagctaagccaaggaggagtcatgccatacgttatcgcccagccgtgcgtggacgtcaaggacaaggcttgcgtggacgagtgcccggtcgattgcatctacgagggttcgcgttccctgtacatcaatccgaacgagtgcgtcgattgtggcgcgtgcgagccggtgtgcccgaccgaagccatcttctacgaggatgacctgcccgacgagtgggcttggtacaaggatgccgcggtgagtttcttcgccgaggtcggtgatttcggcggtgcttccgcacacggcccgatcggccacgatcccgagcaggtggccgcgttgccgcctcagaatcaggactgatccgcccggtatcattctgcaggccgtcgccttgtgcggcggccgctttcatagagcacggttccttcgccgggtgacacgccacggccggccggaggacgtcgaggaaaggaccagcatgggctttcacgcttattcatcgccatacgattggtctcgcatcgccccgtacaagacaaaggcggcacaggtgccgggcggcatcgtcgacctgtcggtgggctctcccgtcgacccggtgccgcaatccgtgcgtgaggcgcttgccgtggcctcggacgcgaagaacgcgcacggttatccggtgacggccggatccggtgatctgcgcgacgccatcttcgaatggttccgtgccgtgcgcggcgtggacctgcaatccatcaatgccgacgtcgtgcccacggtcggctccaaggaggccgtcgcgctgatggcctcgctgttgcacctcggcgagggcgatgtcgtggtccagccgaaggtctcgtaccccacgtacgagatcggcacgcagctggccggtgcgagcgtgctgaaggtcgatgacgtctcggacgtcgactcatggtgccatgtgccgggtgtgaaggcggtatgggtcaattcgccgtgtaatcccaccggcggcgtgctgtccggcggctggctgtccgatatcgtcgcggcggcgcgtcgcatcggcgcggtggtgctgtccgacgagtgctatgccctgatgtgctggtcgtcgaattcgcgtgatttccacgtggacggtgccgaggccggcgcgtcgacgccggtgtcgttggcgacgtccccgtgcgcgttgaacaccgccgtctgcgatggtaccgcagaccggatcctggtgctgtactcgctcagcaagcagtcgaacatggcgggataccggaccgcgttcatcgcgggagacgccggcctggtgcgtgagatgtcggcgtaccgcaagcagatcgggcagatcatccccggtccgatgcagtccgcgatggccgcgggattgcgtgatttcgatgcggcgaaaacccaatggacacgctatcgccgccgtctgaagacgctggtcggcgcgctgcggtccgccggatacgacgcccgcatgccgcagggggcgctgtacgtgtgggtgcgggcgaagtcgggcgactgctggcgcgacatggacgatctggccgcgctcggcatcatagcgagccccggggagttctacggagcgccggaatgcctgcgcttctccgccaccgcgagtgacgatgccgtcgccgacgcggcgaggcgtctctcgcgctgacgtcggtcggctcacccaccggctcacaatcccagcgacgccgcgcccttgccgtatttgcggcgtatcgcgtccagcgcctgctccgcgtcgcgctgccgcgccgaccgcgtgacggttccggcggactgtgcctcggtctcctccagcacgtcatccaacgtcggctgcacggtcgaaccagccgacctcgccaatccgctcgcgctcatgccggcgagccggatgtctcgcggcaggggagtgccggggctccgcatggcggcgacgccaccctcgatccccagcatccggcacagtagctctacggattgcggatacagcgcggcggccgtgtcctcggcgcgttccatggtgtgtgacatcgacttgtagctcagatcggcgaaccgcagtttcaccgtcaccgtccgcgccaccagaccgcgtctgcgtagcgagctcgccacttcgtcgcagcaccggcgcagcaggtcgcatacccgtcgcatgtcgcgcgtgtcctcggggaacgtgctctcggagccgatcgacttctccggagtgtacggcgtcaccgcacgcccatccatgccacgcgcggccatatacaggccgtgggccatggtctgcgagccgacggccgtggccagcgtctgctcgctcatcttcgccaggtcggccacggtcttcacgccccactccgccagccgccgctccagcgaaggcccgatgccgggtatgccccgcagcggcatcatctgtacgaactcggcgtgacgggcgacgggaatcagcagcatgccatcaggcttcgcattcgtcgacgccattttcgcgaccagcttgttcgcggcgacgcccaccgaacaggtcacatggaaccgcgaggcgacctcctgccgtatccaggcgccgatccgggtcggccgttgccaggcgagcagcgcccccgacacgtccatatacgcctcatccaccgaaacctgctcgaaccggtcagtgacctggctgaacaccccttcgacgatgcgccgagacatcatccggtagtagtgcatgtccaccggcaggaacacgccgtccgggcacagctgacgggcgcgggcgctcgccatcgccgaattgacgccgtaacgccgtgcctcatagctcgccgccgacaccaccgagcgcgtcccggtgccgatgatcaccggcttgcctttgagttcgggatgacgtgccacttccagcgaggcgtagaaggcgtccatgtcgatgtgcagcaccgtgcagccggtctcgtcatgcccccaatcgcgtttggcggcggccagtctaggtgcggtactcatatcccttatcgtaccgtgccgggccgggatggagcgggccttgccgtaccggttggggagcggccgtcgcaatctctttgccgcccgcgcgtggcctggcctgccggagcgcagggcgccgcgaaattgctggcgtcgcgctgctgatcgtcgcggtgatcgtcacgttcacgggcgactcgaatccggcgcgttgacccgtcgtcaggccccgtatgacgccgcgtgcggcacaccgtgttgctgaagtccgggggacgatggtaagatgccatgttgttgcgccaatgtgcaacatggagacatgcctgagtggccgataggggcaccctgctaaggtgttagtcgtgtttagcggctcgagggttcgaatccctctgtctccgccgactaggctccggacgtttgcccggggctttttgctttttccgggtctttctcgagggacgtcaagaacgactattgcagcccgtattatggcagcaggctggagccgccggcgcgtgggtcgatgctgtgtgactggtagggaatcggtaagccgcgaaaagctgaatgtccgctgggattcgtgtggtcatgatatgagaaagccggtcgtgcataatccgcgcgaccggtcatccgggcaaggcgtatcgtcccttgtagcgaagcaggggggcggaggtacgccattgtccgtccgtctccaagcagtcattctacccccttcgtttaccgtggcataatgatgtcatcgttcacatagtaagaaagatgccgccgcaatgtgattgcatatgccggtttcccgcgcgtgtcgcacgtccgtgcttgtgtcgtatgggagattcgcccgcgcgtgtcgtgtccgcttactggacagtagctgacgggcgttagactgagaaccatcaggacgagatgagcgaggagcgtacgatggggcacatccggggaaaagggcatcacaggacgacggcatcgcattcgcccgtcagggcgctcgtcgtcgtgctggtcatcgtggcggtgctcgtcggcggcggatggctggtcgtgcggcatatgcaggccgccgctcccgtcgcgaaaccggataaggccgcgacggtgacccgggtcgatctcgacaacaagcaggccgtacccgaaccggttgtggagcaccatggcaattcgcccgactgcccggacaccgactgcatctccatgctggtcaacggcgacctgctgttccatccgaacctgtggaagcatttcgccggtgcgaacaccgccgccaccgacggcacggcgttcgatttcacgccgctgttcgaaaccatgaagccatacatccaggcgtccgacatcgccgtgtgcgagttcgagacgccgatcgccaaacgcggcggtccctacaccggctatccggtattcaacgtgccgccggaggtcgccgatgccgcggcctcggtcggctacaccgcctgcacgcacgccaccaaccattcatgggatcagggtgccgacggcatcgcccgcctgtgggatacgctcgcgtccaagggcatcgcgcagaccggttcgtacaagaccgaggaggactccaccaagccgctggtcatcgactcgcccacgggcggcggcaagctcggcctggtcaccggcacggtgtcgctcaacggcatgaccgccgaccatgactggcaggtcgaccgcctgcgcgaagccggcgacccccagcatcagtccgacatcgaccgtgccgtcgccaaggccaaggccgcccgtgaacagggcgccgacgtggtggccatggccatgcattcggtgcaggaatacatcgactacgccgattcgtggcaggtctccgaggcgcatgagctcgcggacaccggcgcgttcgacgtgatctacggcgccggatgccattgtgcgcagcccatcgagaactacaacggcacgtggatcatctacgggcttggcaacacggtgacggtcagcgcccccgccagcagaatcgtcaacaatcagggtgtgaccgcccgcatccagttcgccggccgcaagggcgtggccggggcatggcgcgtcagccgcatcgactgggtgccgaccgcgaacatgcggcagggctcataccagtggtgcccgatctccagcgaccatcccaacggcacatgctggtccgaatcgcaggatgcgcaggtgcgccagcgcatatggaacgtcatctattcgatgggcgccgacaagaacatcgtgaaggagtggaacatcaccgatgaaaaccgttcttgacacgtccgaccggccggcgcatgacgcactggtggagaagaagtccgagttcatcgccgatgtgtgccatgtggatgcgttggacgaggcgctgctgttcgtcgattccgttcgccagctgcaccccaaggcccggcatgtggcgtacgccgcgatatgcgtcgacggcgatggtcgcgtgcgggagaggatgagcgatgatggcgaaccatccggcaccgccggcaagcccattctcgacgtgctgcggcagggagatctgatgaactgcgcagtgacggtcacccggtatttcggtggtatcctgctggggtcgggcgggctgattcgcgcgtattcgtccgccgcctcgctgggcgtcaaggtggccagactggcgtccatcgagacgtgccgcagatacacgacagcgctgcagtacccgcaatttgacgtgttccgtcaactcgcctcggattgcggggccgcgctggagaatgagcggtacagtgaccgtgtcgtactggacacggtggtgccggtggagcgtgagcgggaatttctccggcgcgtgcgtgagacgttcagcgcgacggtgacgcccgaatccggtgaactgataagccgtcccgtcgcaatctaaacaggcgcgctgttatgcgcagcatgtccacctcctaatcgcccccgctggcgggggctgtcatgcgtagcatgactgggggtggtttttgcggtactcagctcacccgtcagcaggaacgcaatactttgcggaagatatggttcggttcggcgacccctcgggtatggtgatgactatgagcgagatgcaacgacatgatgacgaggccacggtgcgcgaggccacagcgcagactgcagcgcagtctcagcccgacagcgccactgactccacgcccttcgagcctctgaccgccacgtatgagcggctgcggcactccaccgatagcgcggaactgtccgagttcgcgcgccgtccgttgccggatcgttccgatcaggcggcgttctcccgtgcgacggcactgctggaggccgtcgccggcaaccggcacacgccgttggaagatcgcatcatgctggcggagacgatgccgttcccgaacatcctggtcaagctgtcgacggacccgagtccggacgtgcgcagggccgtggcggccaacgaggacgacaagaactggctggtggggcgcctgaccaaggacgaggtccccgaggtgcgcgacgcggcgctgcgcaacaagcgcacatcatggaagatgcggctggagggagcgcagaacaccgatcttgacgccgacaccctggacgtgctgtcaaggctcggagtatcggaggaatccggtgccccggcgattctcgcgacgatggtgcggcgcgcggtggcgttgaaccccggcacttcgcaggagacgctcgaccggttgcgcgacgacccttcgcccgaagtggcgaaagccgcggcgagccggacctcggacgcctcgtgacgcatcattgcgcgacactctccctgcgctccctcctgccacccccgtactgaccccgtttcgttccgacccgtccgtcgccggcggatcaggcgataatcgcgggtaaaatctggcgcaattcgcggtatacgtaagcgtgccgcgcaaaagcgggcttacactaaggaatatgacagagagtacagaaagtgcggagcgtctcgcgcgtccgctgatccatctggcgcgtctggttggattggccacgagctacatcggcatgagcgacgactatcacgagatcgatgatgatgtcctgaaggcgttgctgggtgcgttgggcgtggacgcccatgacgatgacgccatcgatgattccgttgtccgtatccttcgcgagcgccacgggcgtctcgtcgccccgaccgtgttgcatgtcgtcggcaaggaagatcgtgtgctgctcaacaccggtatcatgcagattccctccgcaaccatcacgctggaaaacggcgacgaataccagggtgcgctggagccgggagccggagacggatcgcaggcgtacgaggtcgacggcaagttcgtggcgacggcatccatcaccatacccgcggatctgccgatgggataccatacgctgcatgtcagcgtgggtgaccgcacgcaggacgccacgctgatcagcgcccccgagcgtattccgatgctgccggccatggaacatgaccagctgtggggctggatggcccagctgtattccatccggtccgccggatcctggggcgtgggcgatttcgaggacctcaagaccctcatggtcgattcgcacagcaagaccggcgccgatttcatgctggtcaacccgctgcacgcgtgcgagccggtagcgccgctcaccccgtcgccgtacctgccgatttcccgccgcttcatcaacttcacgtacattcgtcccgaggcgatcgaggaatatgccggcctcggcgatgacctgaaatcgcagatcggcgagctgcacgcgcaggccgaaccgctgaacggggacgcgcagattatcgaccgtgattcgatgtggcgcgtgaagatgcacgccctgtggctgatttttaaggccgggcgcagcgaggagcgtcagaaggcgttcgacgactacaagagcacgtccgccgaagggcttgaggcctatgccacgtggtgcctgtgctacgacaagtggggcgcgccgaccggcgaggccgacagctgggagaagcgcctcgacaagaacagcgacgaggtgcaggggctgcgtcgacagttccccgacacattggacttctaccgctggttggaatggatcgccgacgaacagctgggagccgctcagcaggccgcgaaggacgccggcatgcagatcggcctcatggccgacatggcggtcggcgtgcatccgtccggctccgacgtgtggtggaacccggagtgtttcgccaagggcgccacggtcggcgcgccgccggattacttcaaccagcaggggcaggactggagccagccgccactcaacccgatcgagctggagaacaccggctacctcacgtatcgtcacatggtgcagggcatgttcgcccatgcaggcgcggtgcgcatcgaccacatcctcggcctgttccgcctatggtggatcccctccgggcacacgcccaaggacggcgcctatgtgcagtacgattccgagatcatgctcggcatcctggcacttgaggcgtcacgcgcccacggcgtggtcgtcggcgaggatctgggcgtcgtgccggaccacgtctcgacgtcgctgtccgcgcatcaggtgctgggttgcgccgtcgaatggttcgagcagatggacggcaagttccgcgccccgaaggattggcgcgagttctcgctcgcctcggtgaacacgcacgacctgccgcccgcagccggatatctcgcgtacgagcacgtcgaactgcgcgagcgcctgggactgatcgaaggatcggtcgaggacttcgagcagaacgcgcgcgccgagcacaaggccatgatggtcatgctgatcgtcaacggctatctcgaccccgacctgctgaaggacgagaaagcccacgagcaggagatcgtcgaggcgctgtaccgcggcctgcgcggctccccgtgcaagctgctcgcggcgtccatcgtggacggcgtaggagagcgccgcgcccagaaccagcccggcaccaacaacgaatatccgaactggcgcatcccgctggccgacggcaagggcaatgtcgtgccgctggaggagctgttctccaacacgcgtctgctctcgctcgccaaggtcatgcaggggcgctgagggtgcgatatgggcatgccatccggccgtacatgtcgttcggccggatgatgaagtgtgtcgtgtggcgttgtgaaatgtcaaaggtggcgttatcatagaggattgttgtgtttccctaaggggtccttcaaagcgctttcccactcgccatcgaggactttcagggagcccacggataatgaggccgaaaccgccaagcctgaccagcgcggcagtccaagcccggaacacaataagcaagaaaaggtacaccagtgaaaactttcactccgaaaccagccgatttgactcatgactggtacatcatcgacgccaccgacgtggtgctcggtcgtctggccactcaggtcgccacgctgctgcgcggcaagaacaagccgacctacgcgcctcacgccgattccggtaaccacgtgatcatcatcaatgccgacaagatcgctctgaccggcaacaagatgggcaaggaactgtactcgcactccggtcgtcccggtggcctgcgtcgcgatagctacgccgagctgctggcgaacaagccggagcgcatcatcaaggctgccgtcaagggcatgctgccgaagaaccgtctgtccaaggtgcagctggaccgtctccgcatcttccgtggtgccgagcatccgcacaccccgcagcagccgcaggttttcgagatcgctcaggtctcgcagcaggccaagtgaaccgaagggagatagagaatcatggctgaaaacaccaacgactccgcggttcaggcaaccgaagaggagctcaccagctacaccaccgagaccaacgcgggtgccggcaccggcacttccgcgattgctccgggctacggcaccggccgccgcaaggaagccgtcgcccgcgtgcgtctggttcccggcaccggcaagtggaccatcaacaagcgcaccctggaggagtacttcccctccaagctgctgcagcgtgaggtcaactccccgatcgtgctgctcaagctcgaaggcaagttcgacgcgatcgtcctcgttgacggcggcggcaccaccggtcaggccggtgccatccgtctcggcgttgcccgcgctctgaacgccatcgaccgtgacgccaaccgcgccgccctgaagaaggccggcatgctgacccgcgactcccgtgtcgtggaacgcaagaaggctggtctgcacaaggcacgtcgcgctccgcagttctcgaagcgttaatatacgccagttctggctatcgcgaggccctttcggaaacatcgtttcccgaaagggcctcgttcgttatgagcacctctactgcagcctgcgcatcacgctgatgctgagtgcgggcatcgtccataccaccgacccgttaaccgtagcgttgccgccatcacgggccgacgcggaagcgccatgcacggtactggccgcagacatggtcgccgaaacatccgcgccaacgcccggggtctgctcgtcatcctcgaacagcacatcggcatgctctgtggtggcgccaagcagatccagcttgtcctgctcggccagcgacgcctgaacggtcttcaacagctgatggatgttgtccttctcgctgacggacatgatccagttgctgcgcagcgcctggttcttgccgatacgctgcagccgatcgcccggcgtcggccgcagtccgaccgcggtcgcggaactccagtcgcactgccaggagcagtcgctcggcagggtgaaccggcgtacctcgtcgacgccgttgatcacgatgagcacatcgacctcatcctgcgagagcagtcgcatcgcgaagctgcgtatcgtcgtgtcgaaccagtcccgatccatcggcgtggtgccgtcgggcagataccattgcacgcggctcgacggcttgaacaggccgagctgcgtgagccgcgtgaagaactcctcgtgatggtacagtcccagcgacttgcgtatcgacagcagtcgggacaccgtctccaggcggtgcatctgcatggttttgcgggtctggtatatccagtcccagttcagccaggtgatgtcgttgtcctgcgcataggcgttgttgttgccgctctgcgagttgccgaattcgtcgcccgccagcatcatcggtgtgcccagcgacagcatcagcgtgccgagcatgttcatggcggcctgctcgcgtttgcggatgatcgccgggtcgtcggacggcccctcgacaccgaagttcgcggagtggttcacgttcgatccgtcgatattgttctcgccgttggcctcgttgtgcttgaccgcgtatcgggtcaggtcggtgagcgtgaatccgtcgtggcacgagacgtagttgatcgaggacacgcatccgcgcccgggctccgtggcgaacaggtcggatgaaccgcacagtcgcgtggccatctcctgcatgccgataccgctgggcgcccccggttgggtgtcagtgatccagaatcggcgcaccgtgtcgcggaaccggtcgttccactcgctgaacggcatgccgaatccgccggtcctccatccctgcggccccaggtcccaaggctccatgatgagtttcaggttgccgagcagcaggtcggaacgcaacgcatacaggaacgggtgatgcttggtgaagtccccgtccagccgcgccagcgacacgccgagatcgaatcggaacccgtcgatgccgatgcgcttggcccaataccgcagcgagtccacggcgaacgtcaccacgtgcgtgttggtgaagtcgaaggtgttgccgcagccggtggtgtcctcaagccgcccgatattgcccttctgacgccggtaatacaagagcgcgtccagaccgcgccagcatgtcgtcggcccttccacgccgccttcgcaggtgtggttgtacaccacgtccatgatgacctcgaacccggcctcatgcagcgcgcgcaccatgccgatgacctcgtcgcggatcgcccgggcccccttgcgctgggcttcggcagtggcgtacgaaggctcgggggagaagtagctgagtggcgagtacccccagtagttgtgccgcccgcgctcctgcaggaacagctcgtcctgcttggcctggatgggcagcagttcgatggaggtgacgcccagggattgcaggtacgagagcgtggtcgggtgggcgagacccgcgtacgtgccgcgcagttccttgggcagccagggtgcgttcgcggtgaatcccttgatgtgcagctcgtacagcacggtcttgctccacggcacgtgcgggtgcgaggggtcggcgtcgtgcttggtcttgtcccggtcgtcgatggccaccgacacgggcatgttgcccagtgcgtcgacggtgctcatcggcccgaacgcggagccgcgcaccttgccgtcctcgctgacgtcgcactggtatgagaacgcggccggcgacagcttcatgcggccgtcgatccccttgccatacgggtcgagcagcagcttgtacgggttgaaccgcagccccttgctcggatcccacgcgccgtccactcggtaggcgtagcgcatgccgtcccacgccttgggaagatgcacgtaccacaggccgtagttcggcccatccatgcggaacagcgtctcgcgcacgtacatgggctcgatgatgcgcgtgcagacggcgtgctcgtgtatttcgttgatgaacggcgttgctgaatcatcgaagatgcggatggcgtcgttgaagaaggcggtgggttgatcgaccttctcgtagatgcagagccacacctgatcggctgtttcggaacggacgatgacatcggcgccgccgtcttccgtgaagtacaggcccggtcgtgtcgcatagcgatgagggattgcataccgctgaggtatcgcgtgtttcatacacccattgtagcggtgtcgattttcgtccgtgtcggagcgggcgaggacgggtgcgggcccgtgtcccagccgcacagcgcgtccatgtaggggtcggtgaactgcatggccgcgccgatggcgccgctgttctcgtcgctgcggctcagccgaagggtgaaatggtcggtgccgaatacgctgagggccgtgacccgccgctgcaggtcggcgatgttgtcgtggtcgaggtacagcgccgcctccccgccgatgacgacgtcggcgcagatgacgcaccgcacgttggcgatggccagcgccacgtggtcgagccagtcgttcatgcgctcgcggtgatgggtctcgccttgctccagcacgctgaagaagccggggatgctctcgtagtcctccggcaggttttcgggagagcagtaggcggccatgcagccgcgcctgccgcagtggcacggtttgccgcctgggatgagcgtcatgtgttcgatggcgccatcgcacaggttcgggccgcggtgcaggcggccgttcatgatgagcgcgccgctgggtctgcggttcaggtacaggcatatggcgtcgctgatggcggcgtcgtgcagcgtttcggtcatggcgatggccgcggcctcgcggattagttgacgcgggtagcgcaccgactgggcgatggtgtcgatggtgacgccggtcgctccggtcgagtcgttgaaggtgatgacggtgccgtcggccgagatggcaccggggatggcgaaggatacgccgagcacggggccgtgggccttctcgatctccgcggcgaaatcgttgatcgccgaacccatccgctggtagtaggcgttggtgttggcataggggagcgtgcgtgagagggtggcgatggggcgcccctgcaggtcgatggcgcataggcgcagggtgttgcggtgcatggtgacgccgattgcggtgcgatgactcgggttgaaccggtagctttgggatttgcggccgcccgtggagtcggtcagggggccgggggcgatgatgccgtcgtgttcgagcgcgcggatgttgccggtgatggtcggcaggctcagctgcagatcgagctgcagctggcgcttggtgacgttgccgtgcgttgcgaggtggcggatgatggcctgcctgttgcgcgtcttggtgatgtttcgggttgcggcgatgtcggtgtccgtggtcgtcattggagcctcgttgctgggtcgattccgtgtggtgccggacgcatgacaccgcttttaataaataattttataaaagtttgtcgacgagtgcaacttttataaacatactttatataagttgtgtcgcggaaattcgtttgatggtgtgcgatgtcgcaaaaagcgaacaaaagatatcatttcgtggaatatcagcggcaaaacagggttaaatgtaacaaatagcaacaaataaataccaaaaacaaacacgaaacgccgttgtttttgttcgtgtgcgtttgcgcagtgtatcacgtagattgtgacgtaggccacagatgcgcaatagcgagcatgtggatggatgatccgccaggtgatggcggcaacgacaacggaatgaaaccacagctagtcgaggagtattcatggcagaagcaacacaggtcgaggcgcccgccaagccgagccccgaggagaagcgcgcggcggccgaagccgaggtcgacgcccttgtcaagaagggtctcaaggcccttgacgagttcgagaagctcgatcagaagcaggtcgaccgcatcgtcgccaaggcgtccgtcgcggccctgaacaagcatctggtgctcgcgaagatggccgtcgatgagaccggccgtggtctcgtcgaagacaaggccaccaagaacatcttcgcctgcgagcacgtcacccactacatggccgggcagaagaccgtcggcctgatccgcgaggacgaggtcatgggcatagacgaggtcgccgagccggtcggcgttgtcgccggtgtcaccccggtcaccaacccgacctccaccgccatcttcaagtcgctgctggcactcaagacccgctgtccgatcgtgttcggcttccacccgggcgcccagaagtcgtccgtggccgccgcgaagatcgtccgcgacgccgcgatcgaagcaggcgcacccgagaactgcgtgcagtggatcgaacacccgtccatcgaggcgaccggcgcgctgatgaagcacccgggcgtcgccaccatcctggccaccggcggccccggcatggtcaaggccgcgtactcctccggcaagcccgccctcggcgtcggcgccggcaacgctccggcctacatcgataccgatgtggacatcgaacgtgcggcgaacgacctgatcctctccaagcacttcgattacggcatgatctgcgccaccgagcaggccatcatcgcccacaaggacgtctacgcgccgctcgtcaaggagctcaagcgccgcaaggcatacttcgtcaacgcggacgagaaggcgaagctggagcagtacatgttcggctgcaccgccggctccggccagaagccggtcctcaactccgtggtgccgggcaagtccccgcagttcatcgccaaggccgccggcttcgagatccccgccgacgcgacgatcctcgccgccgaatgcaaggaggtctccgacgacgagccgctgacccacgagaagctcgccccggtgcaggccgtgctcaaggccgacgacaaggagcaggccttcgagatgtgcgagaagatgctcaagctcggtgccggccacaccgccgccatccacacgaacaacgaggcgctggtgcgcgagtacggcctgcgcatgcacgcctgccgcatcatctggaaccagccgagctcgctcggcggcatcggcgacatctacaacgcgattgccccgtcgctgaccctgggctgcggctcctacggcggcaactcggtgtccggcaacgtccaggccgtgaacctgatcaacatcaagcgcatcgctcggaggaacaataacatgcagtggttcaagattccggccaagacgtacttcgagccgaacgccatcaagtacctgcgcgacatgcacggcatcgagaaggccgtcatcgtgtgcgacaaggtgatggagcagctcggcatcgtcgacaaggtcatcgaccagctgcgcgcccgtgacaatcgcgtcaccttccgaatcatcgactacgtcgagccggagccctccgtcgagaccgtcgagcgcggcgccgagatgatgcgcgaggagttcgagcccgacacgatcatcgcggtcggtggcggctccccgatggacgcggccaagatcatgtggctgctctacgagcacccggaaatctccttctccgacgtgcgtgagaagttcttcgacatccgcaagcgcgcgttccgtatcccgccgctgggcgagaaggccaagctcgtgtgcatcccgacctcgtcgggcactggttcggaggtgacgccgttcgccgtgatcaccgaccacaagaccggatacaagtacccgatcaccgactacgcgctgaccccgtccgtggccatcgtggacccggtgctggcccgcacccagccgcgcaagctggcctccgacgccggcttcgacgccctgacccattccatggaagcctacgtgtccgtgtacgcgaacgacttcaccgacggcatggccctgcacgcggccaagctcatctgggacaacctggccgagtccgtcaacggcgagccggggctcgccaagaccgacgcgcaggagaagatgcacaacgccgccaccatggccggcatggcgttcggctccgcgttcctcggcatgtgccacggcatggcccacaccatcggcgccctgtgccacatcgcccacggccgcaccaactccatcctgctgccgtacgtgatccgctacaacggtgccgtcccggaggagccgaccagctggccgaagtacaacaagtacgtcgccgacaagcgctaccaggacatcgcccgcatcatcggcatcgacccgggcaagaccccggccgaaggcgtcgagaatctggcgaaggccgtcgaggactaccgcgacaacaagctcggcatgaacaagtccttccaggactgcggcgtggaagaggactacttctggagcgtgctcgaccagatcggcatgcgcgcttacgaggaccagtgcaccccggccaacccgcgcatcccgatgatcgaggacatgaaggacatcgccgtggccgcatactacggcgtgccgcaggccgaaggccacaagattcgcgtcgagcgcgagggtgtggccgccaccgaagaggcgtccgagcgcgtctgacgatggcatgacattacccatcccaggtgattgaaccaatgtgggggtcttcctatgcggaaggcccccacaattatttcaggccattcctgcctcccgctggcgggaggtgacacgtagtgccggtgggtggtcacgcggattcagtgattacctccactaatcttctcttcgcgactacccactgaatccgtcaattacctgccttgtctccctccgcggcggtgatcgcctcggctatcggatcatgccggaaatcgtggttgcgatactcaggatcatccaccggcagatgctgcaccagcgtgtcgaacacctgactgtatatcttgccgtgatcgagcaccgcgtcgagcacgtgaccgccgaacgtgcgatcgtctgacagaaaatgctcgtgaaaaccggcgacggcggctccatgaaacatctccggcgagaaatatcccagcatcgtgcccttcacgtcgtgccgcaggaacatcgcctgccggtcggcgacctccaccagagtcgggtacggggcctgctgtttgatgactgccctcgtcttgatgaagctgaaggtgcctcgcacgatgaccgagaagaacgtgttggcgcggccgttcgcctcgacgatgcggttgttgagatcctccaggccgatatcgcggcgctcgcactggtattggaacgcggcgtgatgcacgttcgcgaacggcatggtgaaatcgtccggcacgcgttccgccacgccgctttgtccgaccttataggcgacgccgtcgaggatgatgagctcgccgtcgagcccctcgccggttccgatgccggtgtcgccgtgggtgagcagttcgccgatggtcgtggtgccttcgagcagtccgggcaccagcagcgccagcgtgccgtgctgatacagctggttggcgtgatgcgccgtgatgggtttgatctgtgcagcttgcgattttgtcacggtgattacgataatgcagcacgcggggcgcttcaacgcgggcttcgcataggggagcgcctgcgctgtgacctgcctcacgaacaacacggccacctcatcccgccaaagtcccatctgcggcctctgaaatgggactatggtcggggaaggagtcggataggaaggagtaggcggatcgccgctatgccagatgaggacagatgatgatggccgctatgaacaccagtagcaggcacatcgcttcggtgactccggcgatcatcggtttcggccgtcgttgcccgcggaatcgcagcggtatcgccactgactgcgtcagcaggacgaccgcgacgacacccagccacatattgacggcgaacccggtgatggcaagcgccgcgtgccacacccatgaggccaccaagtaggatccttcccgtattcgcgaatcatcgttttggcgaacagcaccgagccatactgcgtcagcgcgaaaacgattgcggccgtcaacgccgccttcggcacggaatacgccggccaccatgcctgcacatcagtccaggaacgccagtcaggcagtacgcgaatgccctgccgatactgcgccacagcatcgcacgaaacctggccgccaccagccccgcataacggcagcagccggtccccgaacgaggcgatgaccaccgtcgtcatcgatgtggcgagcacggccacggcgttgccccacagcgagcgctcccggcgcagccatgcggcgaacagccatacggtgtccgcgttgacgccgcccgtcagcagtgcgagtgccgccagggcgatgatcggagccgtgctggcgtcggtcttggacagcgggttggacacgccgttcggctgcgtcgaggtgctgccgttttgcaccggcgatgcctgctgcttggggttgttgccggttttgtttccggcatcggccgtcaccttgaccgtgaacgatgcggtctggccatcataggtcaccgtgatcttcgccgcgccggacggcttcgcgaagtcgtaatgataggtcacggcctcatcggtcgggtcgatggccttcgtggacttgtcggagtaagtcgcggtaatcttcagaccagtcgggtcgaactgctcttgatgttcctgcacccaggtcttctcgatctcacggaacttcgcatcgccgaccgtcgaacgcagcgcggcgagggcgagcctgaatgtctctcccaagttggttgtcatcgtacagcacgaaaaccgtgcgcggggccgtttggctactgcctttcccgatagcccattgaaaatcgtgtacggataggtgtatcggcgcactgagaggtgagaataatgggctatctgcatttcgaggggttgatggcagagtagaggcgctccgggaaccgcatgattccaacaaccgtagggcagtgataccgagggtatcgtgctctgacaacctcacgaaacgcagatagacgttcccgaggcgccaaatcaacctcacgaaacgcagatagcgccgaggagcggcagccctgaggggatatggcgggattcgggcgtgcgacacgcccgcggagccgtgtggccggtagcccggtgggctgccggtaggcgacgccgaggggcggcagccctgaggaaatatgacaggattcgggcgtgcgacacgcccgaattccctataggtacccctggtgctttaattaacaagttgcctgttttgggctcgcaaattggaatcaaaaaagcgagcgtggaacaaggggtccgtttcgacgggcttcttgcatgtctacgcactgatgtggttatggccgcgaaaagtattttcgtgtgtcatgctcgccggtgccctttagcaggatggtaatagtcaacgaatcgctagaaagggcggacggcaatggcgggacagaaaatccgcatcaggcttaagtcctatgaccatgaggtcatcgaccaatcggcgaagaaaatcgtcgagacggtgacgaacgcgggtgccactgtggtgggcccggttcctctgccgaccgagaagaacgtgtttgttgttattcgttctcctcacaagtacaaggattctcgcgagcatttcgagatgcgcacgcacaagcgtctcatcgacatcgtggaccccacccccaaggctgtggattctctgatgcacatcgatctgcctgcagatgtcaacatcgagatcaagctgtaagggaggagggatcgttatgacttcgcaaagaggtagccacaaggctctgctgggtcgcaagctcggcatgacgcaggtgtgggacgagaacggcttcttcgtccccgtcacgctggtggatgtgtccaccaacgtggtcacggccgtcaagtccgaggagaccgatggctacaaggccatccagatcggttacggccagattgatcccaccaaggtgaccaagccgctcgctggtcacttcgccaaggccggcgtgaccccgcgtcgccacctcgttgaggtgcgcaccgaggacgccgccgagtacgagcccggccaggagctgtccatcgacgctttcgccgagggctcagaggtggatgtcaccggcaccaccaagggcaagggcttcgcgggcacgatcaagcgctggggcttcaagtcctaccgccgtacccacggttctcacaagaacgaacgtcgccccggctccgtcggcgcatgcgccactccgagccgtattctcaagggcaagcgcatggccggccgcatgggtcacgtgaccgcgaccgtccagagcctgaccgtcatgtccgctgatgccgagaacaatgtcctcgccatcaagggtgccattcccggccccaagggcggcatcgtcctcgtccgcaccgcagtgaagggagcctgattatcatggcaaacgttactctcaacgtcactgacggcaagggccaggccactggctccgttgaggcgcccgccgagctcttcggccacaccgccgacgaggtccaggctcacgtcccgctgatccaccaggtcgtcgtggcccagctggctgccgcccgtcagggcacgcacgccaccaagacccgcggcatggtttccggcggtggcaagaagccgtggaagcagaagggcaccggtcgtgcccgtcagggctccatccgtgcaccgcagtggtaccacggcggcaccgtgttcggtccgcagccgcgcgactactcgcagcgcacccccaagaagatgaaggccgcggccctgcgctacgtgctttccgatcgcgccaacgccggccgcgtcgtcgtggttgacttcggtgtcaccgacaccccgtcgaccaaggccgccatcgccgcgctcaccccggtgaccgagaacaagttcaccaccgtggtgttctcccgcgataacgtcaacgagtggctgtcggtgcgcaacatcccgactgttcacccgatcttcgccgatcagctcaacacgtacgatgtggtcacggctcagtacgtcgtcttcacgaaggaaggccttgaggccttcgtcgacgcgaagaccaagccggccgccaaggaggcctgatcatggtcgctattcacaagccagcacatgacatcatcctgaagcctgtcgtctctgagaagagctacgccctgtccgatcgcggccagtacaccttcgtggtggccccgaacgcgaacaaggtgcagatcaagcaggctatcgaagagatcttcaaggtcaaggtgacgaacgtcaacaccctcaaccgcgccggcaagcgccagcgcacccgcaccggtttcggccagcgtgtttcccagaagcgcgccatcgtgaccgttgccgagggccagtcgatcgacatctttggcaactgaaggttagccgagaaaagttaaaggaagaactatattatggctatccgcgtttataagccgacgaccgcgggccgtcgtaacgcgtccgtctcggacttctccgagcttacgcgcaccacgcctgagaagtcgctggttcgcaagctcagcaagactggcggtcgtaactcttacggccgtatgacctcccgccaccgcggcggtggccacaagcgccagtaccgtctcatcgacttcaagcgttgggacaaggacggcgtgccggccaaggtcgctcacatcgagtacgacccgaaccgtaccgctcgcatcgcgctgctgcactacgccgacggcgagaagcgttacatcatcgcccccgagggcatcaagcagggtgacaccattgagaccggcgagaaggccgatatcaagcccggcaacaacctgccgctgaagaacatcccgaccggtacgatcgtgcacgccatcgagctccgtccgctgggcggcgcgaagatcgcgcgttccgccggtgccgccgtgcagctcgtcgccaaggacggtgcctacgcccagctgcgtatgccgtccggcgaaatccgcaatgtggatgctcgctgccgcgccaccatcggtgaggtcggcaactccgagcacgccaacattcagctcggcaaggccggtcgcgcccgttggatgggcaagcgtccgtggacccgtggtgagtccatgaaccccgtcgaccacccgcacggcggtcgtacccgcggtggcaagccgccggtttcgccgtggggcaagggtgaggttcgtactcgtcgtccgaagaaggcttcgaacaagatgattgttcgtcgtcgtccgaatggtaagaaccgcaagtaaagggagtatcgagaagatgactcgtagcatcaagaagggccccttcgtcgacgcccacttgcagaagaaagtcgacgagcagaacgagaaggggaccaagaacgtcatcaagacgtggtctcgtcgttcgatgatcactcctgatttcatcggacacaccttcgctgttcacgacggccgcaagcatgtcccggtgttcgtcaccgaggccatggtcggtcacaagctcggtgagttcgcccccacgaagaccttcaagggtcacgtgaaggacgacaagaaggcccgccgctaaaggagagaatgacttatggaagctaaagcaatcgctcgtcacgtccgcgtgacgccgcgcaaggctcgccgcatggtcgacctcatccgaggcaagaaggccaccgaagccgttaccattttgaagttcgccccccaggccgcggcccttccggtccgcaaggtgctggagagcgccatcgccaacgctcgcgtcaaggccgacaaggccggtgagccgttccgcgagaatgacctggtcgtcaagacgacctatgtggacgagggcgttacgctgaagcgtttccgtgctcgtgcgcagggtcgtgccgctcgtatcaacaagcgcaccagccacatcacggtcatcgttgccaacaaggaaggggatcgctgagatgggtcagaagatcaacccgttcggataccgtctgggcatcactgagagccatcgctcgaagtggttctccgattccaacaaggtcggcgagcgctacagtgatttcgtgctcgaagacgacaagatccgcaaggtcatgaacaaggatctcgagcgtgcgggcgtgtcccgtatcgtcatcgagcgtacccgtgaccgcgtgcgcgtggacatccacgccgcccgtccgggcatcgtcatcggacgccgtggcgccgaggccgagaaggtccgcgccaagctcgaaaagctgaccggcaagcaggtccagctcaacatcttcgaagtcaagaacgccgcgctggacgcccagctcgtcgctcagggcatcgcggagcagctgaccaaccgcgtcactttccgtcgcgccatgcgcaaggcccagcaggacgccatgcgcgccggtgccaagggcatccgtatcaagctctccggccgcctcggcggtgcggaaatgagccgttccgagttctaccgcgaaggtcgcgttccgctgcagaccctgcgcgctctgattgattacggcttcttcgaggccaagaccacttacggccgcatcggcgtgaaggtctggatctacaagggcgacatgaccgagcgtgagttcgaagagcagcaggcgcagcagaacaacaaccgtcagggccgtcgcggcgatcgccgcccgcgccgtggcaaccgtgccgccggcgctcagcagaaggctgcgaccgaagccgctccggctgaggcccaggccgccgccgaggctcctgccgcaacggaaacgaaggagtgagctgatgcttatcccaaagaggaccaaatatcgtaagcagcatcgtccgggccgctctggcatgtccaagggcggtaccgaaatcgctttcggcgattacggcattcaggcgcttgccccggcgtacgtgaccaaccgtcagatcgaggccgcgcgtatcgccatgacccgctacatcaagcgtggtggtcgtgtgtggatcaacatcttccccgaccgtccgctgaccaagcacccgctgggcgcccgaatgggttccggtaagggtacccccgagttctggatcgccaacatccaccccggccgtgtgatgttcgagatcggcggcgtgtccgaggaagtcgctcgcgaggctctgcgccgcgccatcgacaagcttccgatgaagtgccgcattatcgcacgtgaaggtggtgatatctgatggcagtcggtaccgctgattacgcaatcaagaatctgaacgagaagaccaacgcagagatcgagggcttcctcaagaagtccaaggaagagctgttcaacctgcgcttccaggctgccaccggtcagctcgacaacactgcccgcctcaaggcggtcaagcacgacatcgccaggatgtacaccgtcctgcgcgagcgtgagctcggcatcagccaggagcctgaggctaccgagaccaagtcggaggagaagtaagcatggctgatactacagagcgcaacttccgcaaggttcgtcgcggttatgtcgtgtccgaggcaatggacaagaccatcaccgtcgagctcgaacagcgttcgacccacccgctgtacggcaaggtcgtccgctccaccaagaaggtcaaggcccatgatgaacacaacgacgcccacgttggcgacctcgtgagtattatggaaactcggcctctgagcaagaccaagcgttggcgtctcgaatccatcatcgagcgcgccaagtaaacaagttcggcaaggctccgcgagacaccctgcctgcgctggtataggcaggcagggtgctcggggagaaccagctcggctaaggagaatcaatgattcagcaggaaacgcggcttcatgtcgccgacaacacgggtgccaaggaactccttgccattcgcgtgctcggtggatcgaagcgacgctatgccggcctgggcgacgtcattgtcgcctcggtcaaggacgcgatccctggcgggtcggtcaagaagggcgatgtggtcaaggccgttgtcgtccgtaccgtcaaggagcaccgtcgtgtcgacggctcctacatcaagttcgacgagaacgccgccgtcattctcggctccggccgtgaaccgaagggcactcgtatcttcggaccgatcgcccgtgaactgcgcgacaagcgcttcatgcgcatcgtgtccctcgctccggaggtgatctgacatggtagccaagatcaagagcggcgacctggtcaaggtcatccgcggcaaggatcgcggcaaggagggcaccgtcacccgcgtgctgcccaacgaccgtctgatcgtcgagggtgtgcagatcgtcaagaagcacgtccgcgccacgcagcagggacagcagtccggcatcgtctccgtggaggctccgatccatcgctccaacgtgatgctggtcgacccggagaccaaggagccgacccgcgtcggcgtgaatgttaagcaggaggctcgtgacggcaaggtgaagaccgtgcgcgtgcgcgtcgccaagaagtccggaaaggagctggcatgaccgatagcactatcgaggcgccggcaactccgcgcttgaagcagcagtacaaggacgtcatcgttcctgaactggagaaggagttcaagtactccaaccccatgcaggtcgctcgtgtccagaaggtcgtcgtctccatgggcgtcggcgctgcggcccgcgactccaagctcatcgaaggcgccgtcaaggacctcactctgatcaccggccagaagccgaagatcaccaaggccaagaagtccgtcgcgcagttccacctgcgtgaaggccaggccatcggtgcgtacgtcaccctgcgtggcgaccgcatgtgggagttcctggatcgccttctgacgctggctctgccgcgtatccgcgatttccgcggcatcaacggcaagcagttcgatggtcagggcaactacaacttcggcctcacggagcagtccatgttccacgagatcgaccccgacagcatcgatcaccagcgtggtatggacatcaccgtggtgaccagcaccaaggacgacaaggaagcaagcgtgctgctcaagcacctcggcttccccttcaaggagaactgatatggcaaaaaccgctcttaagaacaaggcggccggcaagccgaagttcaaggtgcgcgcctacacgcgctgccaggtctgcggtcgtccccactccgtgtaccgtaagttcggcctgtgccgcatctgccttcgcgagaaggcccaccgcggcgagctgcccggagtcactaagtccagttggtaaacatcgacgctgaaggtccgcggcccgaacgtctgcagtgcaggcgctagggcggcggaaaccacggcgagaaagggcaacaagcccacatgacaatgacagatccgatcgcagacatgctcacgcgtctgcgtaacgcgagcgcggcaaagcacgagaccgtggaaatgccgtactccaagttcaaggcgaacatcgccgagatcctgaagcgcgaaggctacatcaaggacttcaccgccaaggaagccaaggtcggccaggaccttgaggtcaccctcaagtacggcccgaacggcgagcgttccatccagggcatcaagcgcatttcgaagccgggcctgcgtcgctacgcgaagtccgactccctgccgatgccgctcggtggcctcggcatcgccatcatctcgaccagctcgggactgatgacccagaaggaatgcctcgaccggggcattggcggcgagatcgtcgcctacgtgtggtgagaaaggagagctgacacatggcatcgcatattggtaagctccccgtcaccatcccggctggcgtggaagtcgctatcgagggtcagaacttctccgccaagggtgcgaagggttccgattcctacgtcatccctgagggcatcaccgctcaggtcgaaggcaacgagattatcctgaccgccgcggatgacctgcgtcccacccgtgccaagcacggtctgagccgctcgatcatcgcctcgatggtcaagggtgtgcacgatggattcgagaagcgcctgctcatcgtcggcaccggttaccgtgccgtcgccaagggcaagggcatcgagttctctctcggctactctcacacgatcaccgtcaacccgccggaaggcatcactttcgaactgccgaacgctaacgaagtggtcgtcaagggcaccgacaagcaggtcgttggccaggtcgccgctaacatccgcaagctgcgtgctccggaaccctacaagggcaagggcatcaagtacgcggacgagcgcatcctgcgcaaggccggaaaggctggtaagtgatatgagcgtcaagattctaggtaagggcaagaaggtcgcgcgccttcgtcgtcacgctcgtcttcgcaagaaggtcgtcggcaccccggagcgtccgcgcctcgtcgtcacccgctccaaccgtcacatggtcgctcagatcgttgacgacaccaagggccacaccctggtgagcgcctccacgctgaccgccgagttcgctggcttcgagggcaccaagtccgaggccgccaagaaggtcggtctgctggtggctgagaaggccaaggcggcaggcatcgagcaggtcgtgttcgaccgcggtggcaacaagtacaccggtcgcgtcgcagccgtcgctgatggcgcccgtgagggaggtctggcactgtgagcgacaacgaagtgaaggaaacccaagtggctgaagagactcagaacactgcggcacccgagaacaacaacaatgatgagcgcaagtcccgtcgtggacagcgtggcgaaggccgacgcggcgagcgtcgcaaccgtcgtgaggagaaccacggcgacgagatgctcgatcgcgtggtgaccatcaaccgcgtgtccaagacccacaagggtggtcgtacgttcagcttcgccgccctcgttgtggtcggcgacggcaacggcaccgtcggtgtcggctacggcaagtcccgtgaggtcccggcggccatcgccaagggccagctcgacgccaagaagcacatgttcaccgttccgcgcatccgtggtaccgtcacccacccggtgatcggccatgatgccgccggcaccgtgctgctccgcccggccgccccgggtaccggcgttatcgccggtggccccgtgcgcgccgtcatggagtgcgccggcatcaccgacatcctcaccaagtcgatgggctccgccaccgccgtgaacatggttcgcgccaccgtggccgccctcaagcagcttgaggagccggaagagatcgctgcccgccgtggcctcgccctgaacgaggtcgcccccgatgcgatgcttcgcgctcgcgccgccggcatcgccgaggccaagaaggctcgtgaagaggctcaggccaaggccgccgctgaacagaaggatggtgagtgatggctaacctgaagatcacgttgcaccatggtctggtgaaccgcacgcccaagcagcgcgcgaccgcccagtcccttggtctgcgcaagatcggccagagcgtgattcgtgaggacaactccgttacccgcggcatgattctcacggttcgtcacctcgttaccgttgaggaggctgactgattatggccaacgaagatgaactcctgcagatgcacaatctgaagcccgccccgggtgccaagaaggaccgtactcgcatcggtcgtggtgaaggctccaagggtaagacttcgggtcgtggcgacaagggtacgaagaagcgctaccaggttcgtccgggctttgaaggcggccagttgccgctgtacatgcgcctgccgaagctgcgtggcttcaagagcccgttcaagaaggaataccaggttgtcaacgtctccgctcttggggagctgttccctgagggcggcgaggttaccgttgacgcgctggttgccaagggcgctgtccgtggcggtttcccggtcaaggttctcggcgatggtgacatcaccgtggccgtcaccgtgaagggcgccaaggcatccgcttccgccaaggccaagatcgaggccgccggcggctctgtttccgaaaactgattgttgttcggcaacactgcatgtgaccaatgagataaggccctccccgctcatgtcgcgggcgagggccttatctgtcattacgactcgtcatatgacatatgacaccagcgtgtctgcgggtagaccccgtacgctagactcgacggttagagtatgtttgcttcggtgcgccgggcgcgcacaacggaaaggaatccttgtgaggacgttaatccaagcctttcggaccaaggaactgaggaacaagatcctctttaccttagccatgatcatcatctaccgtattggttcgttcatcccgacgccgggagtcaactacaagacggtgcaggattgtatcaacacacttagcggtagccaggaaaacttcatcggcttggtcaacctcttctcgggcggtgcaatgttgcagctgtccattttcgcgctgggtgtcatgccgtacattaccgcttccatcgtcgtgcagctgctgcgcgtggtcatcccgcgcttcgaggcgctgcacaaggaaggacagtccggtgaggccaagctgacgcagtacacgcgttacctcaccattggcctggccgtgctgcagtccaccacgattctggtgaccgcacagtccggcgcactgttcaacaacatgtgctcctcgccgattccggacaactccgtgtggaacctctccgtcatggttctgatcatgaccggtggtaccggcctgatcatgtggatggccgagttgatcaccgacaagggcatcggtcagggtatgtccatcttgatcttcatgtccatctgctccggcttcctgccgcagctgtgggagatcggttggggcaccaacggcaccaacggcgattggctgaagttcggcatcgtcaccggcgtgctggtggtcatccttgtcttcgtcgacttcgtcgagctgagccagcgccgcatccccgtgcagtacacgcgccgcatgatcggccgtaagatgtacggtggctcctccacctacctgccgctgaagatcaacatgagcggtgtcatcccgccgatcttcgcgtcctccatcctggccatcccgacgctgatcgcgcagttcggcaagtcgggacagtcctgggtcgactggatcaacaagaacctcgccaacaccacttcggtgtggtacatcgcgctgtatgcgctgatgatcgtgttcttctgcttcttctacacgtcgatcacgttcaacccggacgagaccgccgacaacatgaaggaatacggtggcttcatccccggcatccgcgccggcaacgccaccagccgttacctgaactacgtgatgaaccgcctcaacacggtcggtgccgtgtacctgctgttcgtcgcgctgatcccgaccgtgctgatcatggcgctgaacctcaactccaagctgccgttcggcggcaccacgatcctgatcatcgcgggcgttggccttgacacgctgcgtcaggccaaggcccagaccgagcagttccagtacaccggcttcctgctcgaaggcatcgaccacaaggaaggctgatccttctgcgctcccgcttttacgggagcgaacatatataacgtattcacttcaccaaggagaccacatgcgactgctgattatgggcccgcaaggtgtcggcaagggcacccaggccgccctgctcgccgagcactacggcatccccgccatctcgaccggcgacatcttccgctacaacatcaagaacaagactgagctcggccttgaggcgctgaagtacaccgacaagggcgaactggtgcccgacgagctcaccaacaagatcgtcaaggaccgtctggccatggatgacgccaagaacggctggattctcgatggctacccgcgcaacgcctcccaggtcaaggcgctggacgcgatgctcgaagagctcggcacgccgctggacaaggtcgtcgcccttgacgccgaccacgatgtgctgatgcagcgcatcgccaagcgcgcgcaggagcagggccgttctgacgacacccccgaggccatcgccaagcgtctggccacgtacgccaaggaaaccgctccgctgctcgacacgtacaagagccgcggccagctggtcgccattgacggcgtcggcgacatcgacgccattcaggccaacatcgtcgccgcgctgagcgactgattgccgctgccggtcgtatcgccggcaggagcaaggataaagcaagaaattataacgggtcatgcacgcctcggcgtgtcgtgacccgttatgatatattctttaaatttggtgtgtcttcggacatacaagtgtaatacacccaaggaatggactgtaaggcttatggcaaaagacggtgtgattgaagtcgaaggtcaggtagtggaagcattgccgaatgcgatgttccgcgtcgaacttgagaacaagcacatcgtgctggcgacgatttccggcaaaatgcggaagaactacatccgcatcctgccgcaggatcgcgtcgtgctggaaatgagcccctacgatctgaaccgtggacgtattacgtaccgttacaagtaaataggtacaagcaaaggaaaaccatgaaggtcagccctagcgtgaagaggatctgcgaaaactgccgcgtgatccgccgtcacggccgcgtcatggtgatctgcacgaacccgcgccacaagcagcgccagggctgagagcagattccagcggcaacaaataaataaggcgctgagtcacagcgaacagctgaaccccgggtacgcaggcccgggccggggaaccggaagactcggtgcacgacctgcgtgaacacagaaggaatcgcaatggcacgtcttgccggagtcgacatccccaatgagaagcgcatcgagatcgccctcacctatattttcggtgtaggtcgcactcgtgccaaggaaacgcttgccgcgaccggtatcaacccggatattcgcgtcaaggatctgacggatgagcagctgattacgctgcgtgattacctcgaaggcaattacaagatcgagggcgatctgcgtcgtgaaatcgacgcggacatccgtcgtaagatccagatcaactgctaccaaggccagcgtcaccgtaagggacttcccgtgcgcggtcagcgcaccaagaccaacgcccgcacccgcaagggtccgaagcgcacggtcgccggaaagaagaaggccaccaagtaatagggtggcgtcgattcgggccacggggtgacacccatcgtccggatccaatccaaaacaacagttcgttacaaggaaacgagggtcaatggcagctcctaagcaggccgcgcgcaagcctcgtcgtcgtgatcgcaagtcgatccccgtcgggcaggcgcatatcaagtcaacgttcaacaacaccatcatctccatcaccgacccgtccggcgcagtcgtgtcctgggcgtccggtggcgatgtcggattcaagggctcccgtaagtccactccgtacgccgctggcatggcggccgagtccgcggcccgcaaggccatggaacacggcgtcaagaaggtcgatgtctttgtgaagggcccgggttccggtcgtgagaccgccatccgttctctccagtccgctggactcgaagtcggctccatcaccgacgtcactccgcaagcgcacaacggcgttcgtcccccgaagcgtcgccgcgtctgagcactcagcaatctcatccatccaaaaccgcttacggaaggtgagtgcaccaccgtccagaagctgaaaggatacacacagtgcttatcgcacagcgtccgacacttaccgaggaatccatcaatccgcagcgttcccgtttcgtcatcgagccgcttgagcccggtttcggatacacgcttggtaattcgctgcgccgcacactgctgagctcgattccgggcgcggcggtcacttccgtgcgtatttccggtgccctgcatgagttcaccactctgccgggtgtcgtggaagacgtcactgagattctgctgaacatcaagggcatcgtgctgaccagcgagtacgacgagcccgtggtcatgtatctgcgcaagagcggcaatggcgaagtcaccgcgggcgacatcacaccgcccgccggtgtcaccatcgccaacccggaccagcacatcgcgaccctcgccgacgacggcgaactcgaaatcgagttcactgtcgagcgtggccgtggttacgtccccgcgcagatgaacaagcaggacaccgatgagatcggtcgtatcccggtcgattcgatttactccccggtgctcaaggtaagctacaaggtcgaggccacgcgcgtcgaacagcgcactgatttcgacaagcttattctggatgtggagaccaagccggccatttcaccgcgcgatgcggtggcttccgctggctccaccctggttgagctgttcggcctgtgccgtgagctcaacgtgcaggccgaaggcgtcgaagtcggtcccgctcccgtcgcggaggagaccaaccccgagatggccgtcccgatcgaggacctcaacctcacgcagcgcagctacaactgcctcaagcgcgagggcatccacacgatcggcgagcttgtcgctcacaccgagcaggatctgctggatattcgcaatttcggtatgaagtcgatcgacgaggtcaaggacaagctgcagtccatgggactgtcgctgaagtcgtcgccgctgggcttcgataccaacaatttggaaggtggtacgttcttctcgcctgaggacgagtgacgtcacctttcgcaacagatataaccgtcggattcggacgttcgggcatgtgcccacctgaatccgacgggctataaggagaaactatgcctacacccaagaagggcccgcgtctggcgtcaagcccggcccatgagcgccttatgctcgcgaacatggccaccagcctgttccagcacggtcgcatcaccaccacgctgccgaaggccaagcgccttcgtccgctggccgagcgcctgatcaccttcgcgaagcgcggtgacctgcactcccgtcgtcgcgtgatgcgcgtcatccgcaacaagtccgtcgtgcacgtgctgttcactcagattgccgagcagatggagcagcgtgagggcggctacacccgtatcgtcaagatcgctccgcgcaagggcgactccacgcctgccgccgtcatcgagctcgtcaccgagccggtaagcccgaagaaggctgtcgtcaaggaagctgaggccgccaccaaggtcgccgccgctaccgaggctccggtcgaggagaccgccgccgctgaagctccggttgaggcgcccgccgagaccgctgccgaggagaccgccgacaaggccgagtgagacccgtctcatagacattgataggggctgggaaccgtaactggtttccagcccctgtttttgtttgttgggtggtactggaggctgttgacgggccctagtccgttgcacggacagccctccgccagcgggtgcgttggcatcagatgcggttgcgttcctaagtgcgcgccgaaacgacaaccgtgcgcacttaggaacgcaaatagccccgtttgcgtagctaagtgcgcggactcgtcgtttcggcgcgcacttagatacgcaacagtaggcgataatgacatatccacgttattacgtacctgcacgcaacggaagagggggctcccggcgtgaaccgggagccccctctagggtctcagcgtgtcatccgcgggggatgacacgtgattcggtcagatcctgcgcttacgcaccagcaggtagcctgcggacaacagcaacagggcgctgaagacgaccgccgtgaccgaagcaccggtcttggcgacctcgtcaggcgtgttcggcttcggcttgtcgtcaccgggcttgttctcgcccggcttgttgtcgccaggagtcggggtcacggtctttgccttgacggtgatcgtgaaggagtcggtgagcttgccggaggtcactgtgacggtgacgtcgcccgcagccgtgaacggcttggtcaggtcgacggtcttgccgtcggcgtcgaccgcggacagcttgtattcgccgtccttcagcagcgccgtcttgccgtcggaccaggtgcccgtcaccgcgagacctgtcttggcgaacgtctcatccacggtgtacgtggtcttgtccggcttggacgtgaccttgatggacttgagcgtcgcgggttccggatcgggatccttggccgtcacggtcacgtcgaaggtggcggtcttgccgttggcggtgaccgtgacagtgacctttccggccttggcgaacgccttgtcaagcgcgaccgcggcaccgtcctgcgtggctgagagcgtgtactcgccggccgtcagggtcttcgtgctgccgtccgacatcgtggcggtgaccgccagtccagtggcgtcgaacgtgtcgccgaccttgtaatcggtgacggtcggcttggtgacggcgatcgagctgatggtcggcttcgggccgggatccggcgtggagtccttggtgaacttcgcggtcagagccgtgttgccgtcggctgcgaacgtgtacgtggcatcggtggaaaccgccgtctcactggccgtcgtgaaccagccgctgaacctgtagccatccgccgcgaccgccttggcggtcaccgaggcaccggatgcgacgtccacggccgtatcggtgccggtttcgccctcggcggctacgctcaccgtaccgccttcggccggatcggccgcgacgaatacgcgcacggtggaggacggcttgttcgccacgccgaactcggagaccgcgacccagccatcgttcgaggacttggccacgaacttgacgtaccgcacttcctgctcgtcgaacatgaaggtcttcttggcgcggctggcctcgaacacctgatccgtggcgacctgcttccactcgtcgttcgcgttggccttgacgtacagatcggccttggtcacctgtccgctgtcctggctggtacgcggcgtgaaggagaactggttgatcgtgtacttctggcacatgtcgatctcggcgtagaacgagttcgaaccggtcagcttgtccgtggcgcccttccagttggaatgccagatggtgctcgggttgttgtcgaacgcgtaccgcagcagaccttccgtgtcgttgtattgggtctcggaattggtcgtgccggtccagcaggacttgttgtactggtctgtctcggcctcggacttcttgacgatgacgttgtcgatgacgccgttgatcgcagaggtcttcgagccgatacgctgcagcggcagtgcgaaggtcgcggcggtgatgccggtcttcttctcgatgcccttgtcgatgtacttgccggtcgcatcgctcacgaattcgccgtcaacatacagcttcgtggtctgctggtccaccttgatggtcacggtgaccgtcttgccgaccggcagctcgtaatcgaagtagtagttgtacagctctcgcgtgaagccgagcttgccgttctccatgacgcggatgtcatgcgtgccgtacggagcgtcggcctcgaagaggatgtctccgggcttggcagcctgctggagcgtcacgtcgaacgtcagctcgttgccgttgccgagcttgtcgagcttggatgtggcatagctggagccgccggcgagcttgagcgactggtccttgacggcggccttgctgccgtcgccgatggtcaggtcgcggccgttgccgctggcgtcggcgagcccgtcgttgaagtcgtagctctcgtagacgctgttcttcgaagtggcctggtagtacgggttggtgcgagggccggttccctgcttggcggccagcgccgtgagtttcgcggcggtgcccttctccttgccggtggcggcccaggtcttctcggcgtagaacggcatcgcgtcgaagaagcgccagtacaggtcggattcggtcagacccgatgcgctcttgtcgatgttgtcgctccagatcgcgaacgcggcgccgagcatctggtcgtcgccggagggcacggcctggtagccgccgctgctgcggatcttgttgggctcgaagctgtcgaagacgcggctgatgttcagcaggtcgccgtacgcgttggcacgtccgtagctgccgttgggcaccatgtagccgtagtcgtcgatcgtgttgatcagcttgtagcccatgttgtacatctggaggccgtcggcccagtccttggaccacaggttcatctcgacgttctcgatcgcgtccttggtgatctccgtcttgtggtcgttgatccaagtcaggccgccccacatgcgcacggtgttcgtgtccttgatgtaggggacgatctcgttgatgaacttacggtatgccgtgtagttgtagaggaactcgtcggcaccgatgtgcacggtcgtgtcgctgtcgaacgtcgggtcgtcgcccttggtgtagtcgtcgaagatctccttgatcttggcgatggtctcgggcttggacacgtcgaggtggtcgatgagcggtcggttggagttgatcggggagacccgtcccttcaccatgagctcgggccagatcttcgtgaaggagttggcgtgcgcgggcacgtcgatctccggcacgacgttcatgccgagggcgcgctcgtcctggatgaactgcttgaacgtcttcttggagatggagtagtcctcggccgtgggcgattcgcccttgtcgttggtcaggctggattcgagacggaacgcgtcataggccttgaacgcctcgtcctcgttgtcgcccttgccgtagttctccaggaagatgtagttgtcggacagatgcgcctggaagtcgttcatcttgtagtagcgcatcgtgcgggtgatctcgcgcatcatctccagcgagacgggcttgcgggccacgtcgagcaggagtccgcgggtggtgaagcgcgggtagtcgcgcatcgaaccgatcacgaagccgttggcgtcctgcttggtcatctgcaggatcgtctgcatcgcgtacatgttgccggtcacgctggacgacttggcgaccacgcggtcggcccggatgtccatcgtgtagccttcgtcgccgagctgcgcgatcgcggccgtggagtcggtcttgacgaagttgaacgcaccggcttcggcggcgcccttcttggcggtcagcttgatgccggtgaagtccttgtagtcggcgacgaactcgtcgaccacggccttgagcgaatcatcgtcgtagacgaccttcgtcacggcggaggccgccagcttggcggcactggtcgaatgccattcggcgatttcggggatgatggtcggcttggcgttgttgccttcctgctgctggttggtgcctttgacgacgtaggggatgtcggaggtcgtcttggtgttgccggtggcggtgtcggtgacgacgtaggcgacctgcacggtcttgtcgaccagcgggtggttgacggtgccgtcggcggcgatgagctgctcgtagtcggcgccgttgaacttgacggtgtagccgtcgggcacagtgggcagagccagcgtgtcggtgtcggtctcgatggtcaggtggttggattcgaggtcggagaccacgctgtcgagcgtggcgcccggctcggcctgatcgttcgaatacgcctcccattcggcgacgctcacgttgttgtattcggagcttttgatcgcgaagttcgacagcttgagcgagcgggcgttgacggcctgatcgagctggatgacgacgtcagcgacataaccggccccggaggccgtcatcgcgtagccggacttgagcgtgtgctcggtgccttcggagtcggtgtaggacaggtcgaagctctggacattggtaggcttcggattcacgtcacgctcgaagaaatagatgcggatgtccttgaccgcggtgagccgcgggaattccgccttcagccagatgttgctcggggtctcgtagccgctggcccaacggttgttgcggccggtgcggttctggtcgatcgccttgtcgggggtgagcgtcgccgtctcgttgctggaggcggtcatggtggcgccgagcatgtggttcgtgtcggccgtgtcgagcacggtctccttgggtgcggagtacacggaaatctcgttgatgcccacgttgacccagttcatggtgccgccgtcggcggacagtacggtcaccttcacggcggacgcctgctgtgcctggtcaagcaggatgatctcctgttgcttggcgcgggtgtccttctgatacaccttggtataggtgtcgccctgcttcagctcgactttaaaactggtgatgttctgatcggcatctttgcgctcgaaatcgatgttgatctgcttgacggtcttggtgccgcccaagccgacctcgatccattcgtttgcggccttgttctgcgcggtgccccagcgtgtgccgagatcgccgtccacggccttctcgggcgcagtctgcgccacttcatatgaactggccgttacggtctgattcagtgcaagattgtcatcgctggcttgcgccgccgtgacgccggtcagcgacatactcagtagtgtcacggctgccaggacactgcctatggccgctttcactctcctcaatcgcataatctctccattgggtatgtggttaatgttgtttctgttattgtcggaatctttgttgattggttagcgcatcgccgcattcgttgcgactttgctccaatataaacaaagtttaccgttacatccaacatttgcccacagtgtatcggcacatgggtgtcgcgaggtgggggaggggactcggcgcggcgtcgatatactggtgggcgtgatgagattgcgcattgacctggcatatgacggcggcggcttcttcggatgggcgaagcagccgacgattcgcaccgtgcagggcgagatcgaacgggtgctgcacacgattacgcgcgtgccggtcgacgatcccgccgagccgctgcgcctgaccgtcgccggccgcaccgacacgggcgtgcacgcctcgcatcaggtctgccatctcgacatcggcgaggaaacgctgagccgctgcgtcgggcacatgagcgtgccgccgaccgtagcgctcaagcaccgtctgcaacgcatgctgcccgcggacatcaccatccatgacgtgacggtcgcgccgagcggattcgacgcgagattctccgcactggaacgcacttacgtgtatcgcgtggccgaccgtgccagcgaagtcgacccgcgtctgcgcggcttcgtgctgcacctcgacgccgacctcgacgtcgccgcgatgaacgaggccgccgtgatgaccatcggactgcatgatttcggctcgttcgccacccccaatccgggcggtaccacgattcgcgaggtcaaaaccgcatattggcggcggatccccacccggccgctggtcgtcgacggcgtgggggagcgataccgcacgccggccgccgaatccgacctgctgtgcttcaccatcgtcgccgacgccttcgctcgcaacatggtgcgctcgctggtcggcggctgcatacaggtcggcatgggcaagcgctcgaccgactggttccgagagaagatggccgtgccgctgcgcgagggctccacagggccgatcgcgccgcaagggctgacgctggagcacgtcgcctatcccgccgacgacgagctcgccgaacgggccgagcgtatacgcgccaagcgcacgctgtagacgcggggtgggcgcgaaggcagacgttcggcatgccggcgaaccgttcgcggcgcgaccgattcgtaacatgattgtcgatttttcgagcgaatgcggaaaccacggccgcatacgctgggacgagttcagtatcatagagcataagcgttcagcatgcgtatctgtgagacaaggagtcgccatgacagaacggtcagcccgacaattcgccgaggaactggtcaacaggcgaggagacatcaaccgtgaactgagccgcaacggcgtgcgtttcggcgtatacaagaacggcgaataccacgaccggctgtttccatacgacccgatcccacgcatcatcgaatccgacgaattcgacgagctggaagccggcctcaagcagcgcgtgaacgcactcaacgcctacctcaaagacatctactcagacaagcgcatcatccacgacggcgtcatccccgaagaatacgtgtacacgtcggccggctactttccgcaagtcaacggcgtgactcctcccggcggcatcttcgcgcacatcgcaggcgaagacctcgtccaaggcgaggacgggcgctggtgggtgctggaagacaacctgcgcatcccgtcgggagccagctacccgctgttcgcgcgcgacatcgaacgccgtacgaatcccaaactgttccgtgacgtgcatgtgcgcgacaaccgcgactatccgcggctgctgcgcaaggccatggacttcgtatccaccgaaggcatcgccgtcgtgctcacgccggggcgctacaattcggcgttcttcgagcacgcctacctggccgagaagaccggcgcggcgctcgcgttccccgaagacttggaagtcgtcgacaacaagctgtacttcctcgactatgccggcaaccggcatcgcgtgggtgccgtgtaccgccgactgtccgacgaatacctcgacccgttcgcgttcaacccggactcggttatcggcgttcccggactgctgtcggcctaccgttccggcaacgtcgccatcatcaacgcgcccggcaacggggccgcggacgacaaggcgatctactatttcgtgccgcagatggtccgttactacctcaacgaggagccgatcctgcacaacgcgccgacctacatgccgatgttcgagaaggaccgcaaggaagtgctcgaccgcatgggcgagctggtcatcaaggacgtggcggaagccggaggctacggcgtcgtgttcggctcgtcgctcgacaaggccgcgcgggaggatctggccgaccgcatcaaggaggatccgcgccggtttatcgcgcaggaggtcatccagttccgcgacatcgacgtgatcgacccggacagtggcgaggtgagcccgcgcaagtgcgacctgcgcgcgttcgtggtcaccgggcagaacacgcacgtgtggtattccggcctgacgcgctactcgtcagtgcccggccagatgatcgtcaattcgtcgcagggcggcggattcaaggatacgtgggtgctggcgcccgaagacggcagcacggacaagcagcgcgaggagtcggtcgcctcggtgaacctcattccgcattcgaagcggcactcgctgtcgctggtcaccgcgtcgaaggccgacaacctgtactggctcgggcggtacaccgagcgcgcgttcacgacactcgtgcagttcttccccttctacgaccgcgtgatggacaccgatgtggacgcgttccgcccgttcgcgaaggcgctcgacctaccgcaggatttcgaggacttcgacgggttcatccactccttcctctacgacggcacgaaccccgactcggtgcgctccgccatcgtcgccgcgttcaacaacgccgtggtgctgcgcccggagctgacgtcgaggctgctgcagtacgtcgagctcgcggtgaagaacatcaccgaggccgccgagcgttccgccagcgcggatgacatctactcgcagcgtgacatcgccgacgacatgctcgcgttctggggcggcatcgagaactccaccgcagacatcacactgaaggcgttcgtgttcatcggcaagtacatcgagcgcatcgacctgtacacccgcttccatctggacaatagcgagctcgacgcgccgctcgccaagttggagacctactcgcgcacgctcgacggcatgccgttgccctcatgcttcgtgtccggcatcagctggctactcgggcagttgccgagccgcggctacccggagctgacgagccgcctgaacgagttcctcaccgacttcaacagccgggccatcaccggcgacccgaaggacgcgggcatgctcaacgcgatgaacatggacgccaaacgtccgtgaggggcagaccgccgatcggagcgtgaccggtcggcggccgtcagctgacggatgacctccgccgtttctgctagactagagtggatttttgcgagcattatccgacgaggagcctgccgtcatgaagaaactggtgtttgactacgagatgaagctgacgttcagctcgccggtcaccgaccatcgtttccaactgcgctgcgtgcctgcgagcggcccgcgacagcaggtggtggacgtggaggtcgccatcgagccggacgtcgaactggagacgaccatcgactcgttcgattccgtggtcatgaccgggttcatcccgcagcctcacacgatattcagctattcggtgaagggcatcgcgttcgtcgacaacgcccacatcaagtcggagatctacaagccgctgtaccggttcaactcggcgctgacgattcccgggccgtgcatcgaggccatgatcgcggcgtgccgggcgcgcatcgccgggctgccggccgacgccacgccgattgatcaggcatgggaggtgatggacgaggtgtatcaggcgttcacgtatacgcccgcctcgaccacgatccgcaccaccgccgagcaggcgctcgcccagcgcaagggcgtgtgccaggactacgcgcacgtgatgctctcggtgtgccgccacgtcgggctgaccgcccgctacatcgcgggcctgctgggcggcgagggtgcgacgcacgcatgggtggagatctaccacgacggccgttggatcgggctcgaccccacccacaaccgcatggtcgacgacaactacatcaccatcgcccacgggcgcgattaccgcgactgcatgctcgacatcggcatcttctcgggctatcaggtccagcagaaccaatgggtgaacgcctccgtccacgagcagctgctgtgagggcggttgcccggggcgttttgcgggctatctcgctttcgaggggttgattgaggctgctcgggtcatctatctgcgtttcagggggttgctcaaacgcgatacctgatgtattcggcttgttacgctattggaatcatgcggattagcgagccgtcatacttgaccaccaaccccttgaaatgcagatagatgttttgcgggagctgaatccacccctcgaaacgcagatagctcgccgatggaggctcgatggagcggtggcaggtgcgccacgcgctgatttgcgtaatcgggaaatcgacttataatgaacaagttgcgttttttcgcagcgcatggataggtgtccgagcggtctaaggagcacgcctcgaaagcgtgtgaggctaacccctccgcgagttcgaatctcgccctatccgccagcaaagagggttccgggattctcccggaaccctctttcgggcttataggaacttttgtggtgctttaggtctggttctcggcgtcagtcggtgccgttgggatatcgcgtgccggtgtggaattcgttccagtcgacgccgatcccgtatgcgggcgagacgtcgccttccggttcgggcgacgtcgctttcccgtcctccagcggatcgtcgggaatgaacgattccggccgtgggtgcgcggtcttcatgtagcacacccattcgcacgcgcggagcatgtgcgcctcgggcagtccgcggtggttgagcaacacgttcttgacgaccgagttgacgccgccctccagccggttcgtggtgcgcgccaccggcccacctgcggcaagcgccggcccgggaaaggcgaagagcttcccctcgcggaacagtttctccaaccgccggcagcggcggcgcagctccccgtgcgtccaccactggaaggcgaggacttctccgctttcgccgtcgatggcgatgatcaggcaccagccgtggcccatgtacgtgccgtcggacatgaccgtgtggcgcttcgcgtccggcggggcgatgcgcagccggattgaccagcaccatacgatgcgtttgcgcagggcgcgcgcgtcgcccgtggattccgacgccgtctgggacgacgccccggcagccatgagaggaactcctccagcgtccgcgcccgtctgcggccgcgctgcggcatcgtcgagctcagccggcaggcccggcatctccaccgttgcgtgcccttgccggtccgtccgttcttcttcatcgcacgcccgcatgccgggcatttcctcgctttgctggatggcgttctcgcaccatccagcccgccaccgggagcgcatcattttccacgcggggaaaaagacatgccgacacgcctactcgtacagggccagacctcgatcataagcaccacaaaagttcctatgggccctacgttgtcgttactggctcatcgatgagccatcgagggtgagtttggcgtttttccatcgggtttcacggcaacgtgagaccttttacgaagaaacggttatgctgcgcatatgcaatcgggctgacttctgcggcgtacgggtgttgcttttacccccgtatgcataatagggctgcgggagtgacgcgatcaggagaagaggaacgcgtccatgtcggggtagccgagcgcgaatgcggaggtgatgtgggaggagatcagcgtggagaggacacgcaggcgtgcgtcgttttccgtgccgacggtgttggtatcggtggcgttgacgtcggtggtgtcagttgcactgccggtatcgccgctgccgttggtgttgttgccggtcttgtcggtgtgcttcgacttggccgacgccccgtcatcggccattgcggcgagttgctcccgggcgcagtcgatctccgtcaaggccgttgtcggcacgctcaggccggtcgtggaatcggtcatcgaggtcggcgaggtgaggatcttctggatgtcgtagaccttttctcgcgggtcgcggctcaagccggacgcggtgaagagcaattgccccgcggtcttgtgccggtcggaccggctcagggtggcgccgggcgtatcccgcgcggcgagcacctccatgacgaacccggcgcggtcctcggccagcgacatggcgcccaaggtggcgccgtcgaggtcgatgcccagaacctgcctcaggctgtcgtcggagaccgtgcggtaggtgtcattgccaccgagtcttgtgcccagcgtcacggccacatgctcggcctgggcgcttctgatcgtgccctgcgcgaatcgctgggtgcaggtggcggccacctcgctccactgcccgacggcctgcttcgccgcgagatatcgcatgatgatatggcgacggccgttcatggtggccgtcgacgcgtcggcggcccagtaggcgttctcgcaggcgctgggctggtgttccgactccgcgcgcccatcgatccggggcgcgctgcaggcgctcagggcgccgcacagggcggtgatgcagagtgccgcgacgatacggcgacaccacgaagatatgttcctctcacggcatggaatgccgtgatctggccaatgacgtgtctgcataggcctctacactaatagacgactgtgaccatatgcgcgccaccacggctataacttcataggaggtcttgagtatggaactggacctggcaggaatgcatcagctcgccatcgagcaaggaatcgatctcgaacaactggacgccgcactggaagaggcgctgcgtctggcctatctgaaaacacctcatgcggccaagcatgcccgtgtcgagctcgacatgcgggcaggcacgttcaccgtgtgggctcgtaaggagatcccggtggagcccaccgaggatgaccctcatcccgcaccggagctgggcgaggagtacgacgacaccccgcgcaacttcgggcgcctcgccgcggccaccgcgcgccaggtcatcggacagctgttccgtaaggccgaggacgacaaggtcttcggcgccttctccggccagaagggcaagctcgtcaccggcatcgttcagcaggatgccagcgatccgacgaacgtgcatgtcgccatcggcgatgtcgaggcgattctgccccgtcgcgagcaggtgcccggcgagcgttatcgtcatggcgagcgtctgcgcgtgtatgtcgtcaacgtggcgcgcggcgtcaagggccccgagatcgtcgtctcccgttcgcaccccgagctggtgcgtcgcctgttcgagcgcgaggtcccggaactggtgtccggcgccgtgtcgatcatggccatcgcccgcgaggccggcgcccgcaccaagatcgccgtccgcgccaacaccgatggcgtcaaccccaagggtgccctgatcggccccggcggcgcccgtgtgcgcgccgtcatggagaacctcggaccggagaagatcgacatcgtcgactggtccgccgatccggcgaagttcgtcgcctctgcgctgtctcccgccgtcgccaccggcgtgcaggtcatcagcgagaagaacaagaccgccatcgccttcatccatgatgaccagctgtcgctggccatcggcaaggaaggccagaacgcgcgtctcgcggcgaagctgaccggatggaagatcggcatcgaatccaccgaagcgcacgcgaagaaggtcgctgccgaaggcaagtgatccgcgacacggcggtgacgcgcggccgacggcacatccaacgtccctagtatgctggacacggcacaccgggtgtggatgcgttatgccgtcatgccacgggatcgagatatgaggtaacacgaccatggttgcacgatgaaacgggcagaatccgtcatcggaaaatagccgcgcgagtctacgcgcggcccagaattaggagtaatgtggcgaaaaaacgcgtgtacgagcttgccaaggattttggcgtcgacagcaaaaccgtccttgacaaactcaaggacatgggtgaattcgtaaaatcagcttcttcgacggttgaggcgccggtggcgcgcaagttgaagaacgccttccagaagggcgaggcgaagccgggagcgtccgcagcggaacgcaagacgccggctcccgcaccgtcggagcatcgtgctcccgcagtcaagcccgcacctgtagccaagcccggtctgggcaagaagcccgccgcggcaccgcgtccggcggaaccgcgctctgcggcgcctgctgcacatgtgccgtcatcgaatcgcggcacgacgccgcgcgacaatcgcaacgaatcccgcggcgacatgcgtgacgctcgaccgaaccgtgaaggcggcgagaaccgtccctcacccgcgcagcgtcacaatccgcacgcgccttcagggcagcgcggctccttccccggcccgcgttcccaccaacctggtcacggcggcaacgccggcggccgtccgcaggattcccgaggaggctcccatcagggtcagccgcgccagggccagcagccgggcgcaggcagcgcaccttccgccaacggcggcgcccgtccgtcgactccggggcctcgtcccggcaacaacccgttcagccgcaagcagggcatgcacgcgcccaccccgcgcgacatcccccgtccgcacccgatggcccgtccgaccgtaaacggcaaccacaacgacaatcgcggcggccgtggcggtcgtcccggcgcaggtcagggcggtcgcggaggattccgtggcggtcgtcccggtcagggagcgcagggcgccaagccggggcagtgggggcataaccgtccgggtcagaccggcggcgcccgtcccgcgggcggcaaccgcttcggtgccggcgctggcaccggcgctggtcagggcggcggcttccagaacaactccaacacgtccggaaccggtccgtcgcgcggcggcggtcgcggtcgcggcggcgcggccggcgcattcggccgtcagggcggcaagtcgtccaaggcccgcaagaaccgtctcgcgaagcgtcaggaattccaggagatgaaggcacccgtcatcggcggcgtgcgcatccccaccggcaacggccagaccgttcgcctgcgtcagggcgcctcgctcgccgatctggcggagaagatcaacgtcaacccggcggccttggtcaccgtgctgttccatctcggcgagatggccacggccacccagtcgttggacgaatccaccttccagatcctgggcgaggagatcggctggaacatccagatcgtctccgccgaggaggaggacaaggagctgctgcagcagttcgacatcgaccttgacagcgaggagctgcaggaagacgaggatctgaagccgcgtccgccggtcgtcaccgtcatgggccatgtcgatcacggtaagacccgactgctcgacaccatccgcaagaccaacgtcatcgcccgcgaggccggcggcatcacccagcgcatcggcgcctatcaggtgaccgtcgatctggaaggcgagaagcgcaagatcacgttcctcgacacccctggccacgaggcgttcaccgccatgcgtgcccgcggtgccgagctcaccgacgtcgcgattctcgtggtcgccgccgatgacggcgtgatgccgcagaccgtcgaggccatcaaccacgcgcaggcggccaaggtgccgatcgtcgtggccgtcaacaagatcgataagccgggtgcgaacccggagaaggtccgtggccagctcaccgagttcggcctcgtgccggaggagtacggcggcgacaccatgttcgtcgacatttccgccaagcagggcaccaatgtcgacaagctgctcgaagccgtgctgctcacggccgacgccgacctcgacctgcgtgcgaacccggatatggacgcccgaggcgccaccgtcgaagcccgactcgacaagggccgcggcgctgtggcgaccgtgctcgtgcagcagggcaccctgcgcatcggcgacgccatcgtcgccggcacctcgtacggccgcgtgcgcgccatgctcgacgagaacggcaaccacatgaaggaagccaccccgtccacgcccgtgcaggtgctgggtctgacatccgtgccgaccgccggcgacctcttcctggtcgcatccgacgaccgcaccgcccgccagatcgccgagaagcgccaggccaccgaacgcgccgcgcagctcgcgaagcgccgcaagatcgtctcgctcgaaagcctcaaggagcagttcgccaagtccgaggtggacatgctcaacatcgtcatcaagggcgactcctccggttccgtcgaggcgctggaagactccctgatgaagatcgaggtgtccgacgaggtcggcatccaggtcatccaccgcggcgtcggcgcgatcacccagaacgacgtcaacctcgcgaccgtcgacaaggccgtcatcatcggcttcaacgtgcgcccgaaccgtcaggtggcggatctggccgaccgtgaaggcgtcgagatcaagtactactcgatcatctacaaggcgatcgaagacatcgaggccgccctcaagggcatgctcaagccggaatacgaggaggtcgtcacctcccactccgagatccgcgagatcttccgctcctccaagttcggcaacatcgccggcgtcatggtgcaggacggcgaggtcaagcgcggtacgaagtgccgtatcctgcgcaacggcgtcgccacggtcaacgacctggagatctcctcgctgcgtcgtttcaaggacgacgtgcagtcggtcaaggaaggctacgaggccggtatcaacctcggcactttcaacgacatcgagctcggcgacatcatcgagacctttgagatgcaggaagtcgagcgcaagtaaggcgcatatatacatgggaggcgggcgctttcgggtgtccgccgctttttcgcggacgggcgcagcgaaccattctcattacggttcgtgcgccccccgtttttcgccaatgaacagtattcgctgctgatggccggaactccgggcttttcggttttgttcgattgtgcgctaatgtgtgcaatcctcgcatgtttcttattgagaacgattcgctgtgagccttcgagtaggggatgtgcgaatatgatacgagtgatattgtcagcggttcgccgcgcaatcgaggaaaaggatttttatggcaggaacgaacccgcgcgccgcacgagtcgcggcgctgatccaacgggtgatcgcgtcgtcgatggaagctcagctgcacgacaagcggcttgcgagcgtgaccatcaccgatgtgcgcgtcaccaatgacttgcagatcgccaaggtgtactggactcagcttgggcatgatgggcgcgagcagggggagcgcaagcgcgccaagcaggcgctcgatcaggcgaaagggcggctgcgttcgctggtcggctccaaagccggcctgcgactgaccccgcagctgcagttcatctatgacgaggtgccgagcgaggcgcatgagatcgaggatatcctggctgtcgcgcacaagcgtgacgaggagatcgccaaggcgcgcgagaccgcgcagtacgcgggcgacgccgacccgtacaagcatcctgaagagcgcgatgacgacgagtttgacgatgacgacgagtacgacgagtacgcggacgacctcgacgatgacgacgtcgaaggcaacggcatcggcgtcgagaccctggaagatgacgccgagaacgcggcggacgaggcaacgggcgaccgctgagccgcatatcagcggttctgcgagacgggagaggattcactgatggggaccgtacccgaagcctcgggcggcgagcaggctccgatcgtggctgcgcaagccgcgcctgtggctggctccgccgcgccggcgactcctacgtcgggattgttggtcgtggacaagccgcgtggcgtcaccagtcatgacatcgtcgcggctgcgcgcggcgcattgcatatgaaaaaggtggggcacgccggcaccctcgacccgatggccaccggcgtgctggtcgtcggattcggcaacgccacgcggttgctgaaccatatcgtcgaacatgacaagacctatgaggcgacgattcgcctcggccagtccaccaccaccgacgatgccgatggcgaactgctgtcggctacctcgcccgagcgctggcaagagctgctggcattgccggtcgccggtgggcctcagtcggctggcgagaatgggcctgtgaacgcggccaagggttcggccgtggcaaccgcaaaggtcgcggatgacggctccgcgtatcatccgcatcaggaagcgtttttgccggattgccagcagctgtggcgcgaccgtatcggtgacatcatcgcattgcagctcaccggcagcatcgagcaggtgccgaacacgttctccgcaatcaaaatcaacggtcaacgtgcctatgatctggcccgcgacggcaaggacgtgcagctcaaggcgcgtcggatcaccgtcagcgcgttcggtgtgctggatgtgcggttcggctatgccccgacgcggcagctaggacttccgctcgtctcggcggcggacgagcgggcgacgacggaacgggatgacgcggaggcgacgccggtgatcgacgtcgatgtgcgcgttagctgctcggcgggcacatatatccgcgcgctcgggcgcgacctgggcgcggcgctgggagtcggcgggcatctgatacggctgcggcgcacacgggtgggcggtttcgacgtctcctcgccgaatgtcatcaccgcgcacgtggagacacgcgagtacaccgaccgcaacggcaaccaccagtcccgcaaccgcgccgtgctcgatgtgattggcgacgagcttgcaggcaaggcgctgacgatgctggatgccgcgcgaggcaccatgccgctgctcgccatcaccgatcaggacgccgtcaacctgcggtacggccggcgtatctcctatgacatccacggtacggtcgccgcgtatctgccgcagagcggggaagtggtggcgctcgtcgagcgcgccaagcgtggcgaggccaagccggccaccgtattcggcgcgtaatgcgtcactgtgtgcgaggtgcgtcacgctgtgcgtccacgcacacagtgacgcaatgccagaaatccttattttccaaaggttttgtggtatgcgtcacgctgtgcgtccacgcacacagtgacggcgcccgcacacagtgacggcatcgggacggcatgatgcaaatcagttcatcatttcggtggcgcagccgcactggtggcgggtatcatggaaggccggaaccatgcccacaagccgcatatacggcgcaacacgtgaaggaacaccatcacccatgaaaatcacgactcttgccccggacgcctccgggctggtcgaatggccgacgctgagtgccaacaggaaatccgtggtcacggtcggcgtgttcgacggcatgcaccgcggccatcaggcggtcatccgccgagcggtggaactcgccaaggccgacaaggcgttttccgtggtggtgatgttcgacccgcgtcccggtgtcgtgcacgcgtacgcggccgcccatgacgggcaggagccgggcgacggcttccgcgaccccatggcgctgaccagcgtcgaccagcggctgcggacgctggagaaccttggcgtggaccatgtgctgatcgtgcgctatacgctggcgttcgccacgaaatcatatcggttcttcctcggccagatggtcggcaaactgggcatgcgcacgctggtgctgggaacggatgcggcgatgggcgccaaccgcgctggcgatgtgaaggccatcggagtcctcgcgcaggccaccggcgtgttcgagcttgagatcgtcgacgaccgcggcccaggtcatgtgcgtgtgccggccgacgttaccccgcagatgccgagcgagcctggggagcctgtggatccgaccgaaggcatgaccaaggcgcagctgcgcgcgtggagcaagaagcatcaggggcgcgaagtgcgcgtgtggagctcgacgaacgtgcgatacctgctcgcacatggtcgtatcaaggccgccgacgagatcctcggccatgcgcacgccatcgagggaacggtggtgcacggcgaggagcgcggccgcacaatcggtttcccgacggcgaacctggggagcatgattgacggttatattccggtggatggcgtgtatgccggctggctgatcgatttgggcgcggcgggagcgaccgccgactccgacgagaatgcctccgacggcaacagcggcagcggcaatgcctcggtgattccgcgcgtgtatgattctggctcatccaaggccaggctcgccgccgaatcaccctaccggtggccggcagcgatctccatcggcacgaagccgaccttcaacgaagagaccggtctcaatgagcgggtggtcgaggcgtacgcggtcaccgacgaatggctggacctgtatggtcacgacgtgcgcgtcgaattcgcgggattcctgcgcccgcaggtgaaattcgacagtgccgatgcgctcaaggacgaattgacgcgcaacgtccaggagaccagggaactgacctccgcgcgttgagcgcggtaggagcacccgacagaagtcggtctctccacctgcgtccgaacggtatcggcataggctcgcatgcgctgaatcgcgccgctatcgtgcctcgcgtatcttgcgcgtgccgtgtcgccaccgtcaccgtcactgtcagacgacgcccagagactccagcgcgtcgcgcagatgcgtcacctctacgatgcgcagcccctcgatggtgacacgcttgcgcatcggcggcaccaccgccgtggcgaacccgagccgcgcggcctcgcgcagccggtgctccagccgcggcaccggcctaatctgcccggtcagggagatctcgccgatggcgcacgtgtctcgcgcgattggcttcgacctggccgcactggccagcgccgccacaatcgccagatcacaggctggttccttcgccagtcctcccgcgatcgtcgatacatacaggtcgttcgccagcaggttcaccttgccatgtcggtacagcacggcggtgagcatagcgatgcggttcgtctcgacccccaccaccgcccgtcgcggtgtcggcagcacggaattggtcaccagcgcctgaatctcaatgggcaggctgcgatggccgtccagcgtgaacgtcacgcacgtgccctccacacgttcgtcggcggacgacaggaacagtcccgagggatcgctgacctcctcgatgccctcgccactcatatcgaaacacccgacctcatccgtcggcccgaaccggttcttcaccgcccgcagcatacgcagcgccgtttccggatcgccctcgaactggcataccacatccaccagatgctccaacgtgcgcgggccggcgatggacccgtccttggtgacatgcccgaccaggagcacggggatgttcagcgtcttcgccgtgtcgatcagcgcgctcgccacctcgcgcacctgcgtggagccgccggagatgccatcaacgtcttgcgagacgatggtctgcgccgaatccacgatcgccagtgtcggccgcgtccgctcgatcagccccagcacggtggcgagatcggtggtggaagccagcagtaggttctgctccatcgcattgacccgcgacgcccgcagccgcacctgcgcctgcgattcctcgccggagacgtacagcaccgagccgttgggctggcctgcggcgatgttgccggcggtctccagcagcagtgtcgacttgccgatgccgggttcgcccgcgatcagcacgaccgagccgggcacgatgccgccgccgagcacacggtcgaactcgccgaaacccgtggacagccgtgacgccgtggacgtgtctatctgggtgatgggcgtcgccgcgctgacgatggacacggccgcctgcgtgcgtgaggtgcggcccggcgccgcggtgcgcgacgacgatgcggcggaacgggcctcgtggaattcctccacggtgccccactgcccgcactgcgggcagcggcccacccatttgagaccatcccaaccacattcgctgcatacatatcgcgtcgccgacttcaccataccgcagaccttagcacaaagcggcacgccgacgtcgccgacgaaacgatgccgttgcgtcgtatgcgcgtgagagaatcacagcatggcaaagactcaatccccttcctatccgcacggtagttccgcatcgcgcggcaagctgatcgtcgtgatgatcgtcgccgcgctggtcgtcgtgcttgcgctgctgtccgcgttcgtatggcccggttgggcattgaacaagacggacgaagtgacgaaggtgcagcagcagaccgccaccgagcctaccaagccgagcatcaaggccaccgcgctgccggatgacgcatccgaactgctcaaggcgatgccggacagcgtgctcaactacgcgcgcaccaaggcgggcgccagcgagacctggaagtccgcgtcgccgctggaggagtacacgctcacgtactccacgggcaagtcggcgaaggacgtgaccgtcatcgtcgcgcaatggtcggactccgacaccgtgaagaagcagtacgacgagctggcgaagaacctgaccggcaaggagctgaagtccggggacgtcaaggtgtcgggcaagagcaccggcagctacacggtgagggccgacagtaaggatggcaagaccgcgacggcgttgtggcagaacgataccgccgtgttcgaggtgactggctccaaggaatccgtgctgcggttctacgagccgttcccgctgtgatttcgtgataattcggggtgatttgcggattcatggcggaaatggaacgcgcggatgcgtaagtccctcaatacgtgtactattgggcaagttgcaatctttaacgtactaagggaggctgacgatgggttcggtcatcaagaagcgccgcaagcggatgagcaagaagaagcaccgcaagatgctgcgtaagactcgccaccagcgcaagtagtcgttcgcttgcaagagcgcacacaaagccccgcgaccctgtcggccgcggggcttttacattctcgtccccgctggcggaagcgagctggatatgacagcgccggcagactccgatggggggggggctgccggcgccgggattgaggcggcgattcgccgcgttaggtcacttgttgccgttggccattacgcgtgggccgttggggtcgccgacgatgaccttgtcgaccatgttgaggaacaggccgtgctcgacgacgccgaccgtgttgatcaggtcctcggcgagatcctgcgggtggtcgatgcgctcaagatgcaggtccacgacgaagttgttctcgtcggtgcgcacttccttgccgtcggcgtcgaggcgcagcaccggcttgtagttcttggcctcgaactgcttgatgacgtggccggcgccgaacggaatcacctcgaccggcagcgggaacttgccgatggtgtcgacgaccttggactcgtccacgatccacacgattttgttggagttcgtggccacgatcttctcccacagcagtgcggcgccgccgcccttgatgccgttgaagttcttgtccacctcgtcggcgccgtcgatggtgatgtcgatatgatccacatcatcgatgtccacgatcttgatgccgtaaccttcggcctgctcctgcgtgcgacgggaggtcgtcacgccggtgaactgcaggccctcctccttgacgcggcggccgagctcatcgaccaggaaacgcacggtcgaaccggttccgagaccggcgatcatgccgttctcgatcagcttggcggcttcgatgccggccgccttcttcagtgcatcctgctgtgccttgtccatcatgtactccttgaaatgtccgtgcattccccttggagggaaacatgcttcaaactttgggattgaagtccacctctatagtatccggttcgtggaacgtcaccgccgttcgtccgggttttgggaggagaaccgtcgccattcggctgctatccctgcttgtccgtatagaacgtggcattgtcgagggtgatggtgccgtcgccgttcacatatccgtccacgcgaaccagtccgtggatgatgcgcggccgtccgtcatatgtcgggctggtggatggcgggggagtaaagcgcagcgtgcccgacgcggtgagggcggtcggtgagagccgcggcgccgcaggttcggccacagagcgtgtggagctgccggactgtgtgccttcggcctgtgccgaattcgatgacagtgcgacggtcgcgtccgattcggtcgtcataggaacagcaggagctgacatcgcagtggtggatgatgtgtccgactgggtctcgccgtagtcgggcacgccttcgggttcggcaagcagctccgccaacgatggcttgcggattcgctttgcgacgttgtcgccgtccgattcgtgctcggctcccgcttcacccgattccccgcctcgcccgagatggtactcctgcgtggaaatcttgccgtccagcagcatctgcgcatcctccggcacgtcggttcccttggcatactccgaagccagcagcgactgccatccctccttcggcagatatccctcctgcacgccgctgcggcagtcgccggcatacgtgcgggccaggtcgtccaccttctcgttgccggcgttgcccgcgtgccccttgacccacacgaacttcaccgagccggcgcggcgcgacagctcggcgtcgatcgccctgatgagcgccgcgttcttcacaggcttcttctgcgagttcttccagccgttcttcttccacccgtgcacccacttggtggaacagttgatggcgtactgcgagtcggtctcgatgaccagcggctccgcgccgggatgtgcgcgcagcgcctccagcactgcgcacaattcgccgatctgattcgtgccgttcgtggcgccgccggcatcgcagtcgccgccgtgctcatggccgccggaatgtgccatgttgagttcgtggtcggcccaggcccagcccattgggccgttcggattgcccagggcgcttccgtctgtcgatacggtgatggtcatgacaacaacagtaacgcacgccgtgccgcggccatgaatcgccgatgggctgcgacacgaccgaaaacgtcgcgatattttgttaagtatatatactgaatactgaccaatgatgaactcacacgagtccccgtgtcacgatgatgcaaagcagcatggtgacgaataattcaatgatgagagattcagccggcgcgtccccagtgccggacaaggaaaggaaccccagtatgcgcagcaaggcattaggaggcctgcttgccgcggctctgtcgttgagcccggcagtggccatcggcgtgcagacggcgtacgcggcaggcggcgatacggcggcgaccgaatacacgctgtaccccaagccgcattcgatccgttatgacagcggacagtacattcttcgcgacatcaacgtcatctatgacgatgacatcgatgaagccacccaggaccgactggacgaagtggcggcgctcaagaacctgaacgtcaccgaatccgacgccgcagtcagcggcaagaccaacgtctatgtgggcgtgaacggttccgatggcaaggccgagactgccatcgaaagcaagtacagcccggattccgccatcttcgacaagaccgactcatacttcctcaagtccgacaacggcacgatctccgtgctcggcaaagacaccgacgccagcttctacggcctgaccaccctgtaccaggtgctcggccagatcgatagcctgacgatccgcaacttcaccgtcaccgactacgccgacgtggtcagccgcggtttcatcgaaggctactacggcaacccgtggagcactcaggaccgcatcaacctgatgaagtggggcggctactacaagctcaactcgtacttctacgcccccaaggacgatccgaagcacaactcgcagtggcgtacgctgtacacgcaggacgagctcgacaccaagatcaagccgctcgccgatgccggcaacgcctccaagacgcgtttcgtgttcgctctgcacccgttcatgaacaacgcgattcggttcaactccgaggcgaactatcaggccgatctgaaggtgctgcaggacaagttcgcgcagaccatcggggtcggcgtacgccagatcgccatcctggccgatgacgcggcgaacgtgggtggtaacaattacaccaagctgctcaccgatatggtcgcgtggctcaaggaaatgaagaagacctacccggacctcaagaccacgctgccgttcgtcacgcaggaatacatgggcaacggcatgagctacttcgccaacttccccaaggaagtgcagatcgtcatgaccggcggtcgcgtctggggcgaggtctcgcagaacttcaccgacacgttcacctcgaacgtcggccgcggcccctacatgtggatcaactggccgtgctccgacaactcgaagagccacctgatcatgggcggctacgacacgttcctgcatccgggcgtcgacccgtcgaagatccagggcatcgtgctcaacccgatgcagcagtccgagccgagcaaggtcggcatcttcggcaacgccacctactcgtggaacatctggcggagcaagagcgaggccaaccaggcatggcaggattcgttctcgttcgtcgaccacaactccgctgtgccgaccgccgcgtcgaacgcgctgcgtgagctgtccaagcacaccatcaaccagaacatggattcgcgcgtcaccgcgctgcaggagtccgtggacctggctcccgcactgaccgccgccaaggcgaagctggctgacggcaccatcaccgcccacgacctgaccgacatcaaggccgcgttcgtcacgctgcagaaggcagccaagacctaccgcgccaagggcgatgcgaagatgctcggcgacatcggcaaggactacaccgggcaggacgccaacgagcagatcgccccgtggatcgactgctgggatgacaccaccaaggccgcgctcgcctacatcgcgggcatcgaggccgcgctgaacggcgacacatcctcgacgctcaaggagtactccgacgcgcagtccgcgttcgccgcgtccaagaagcacggcttctactacgtgaaccacaccgagtacgccgaggtcggcgtgcagcacatcgtgccgttcatcaaggcgatggactcctacctgtccaacaaggtgcagcaggaggccgacccgaacgtcgtgaccaagacgtacatcagcgacgtgttcaccacgccgacctccggttcgatcgaagacatcttcgatggcaaggacagcacggtcacggtgttccagaacccgaactacctgcacaagggcaactacgtcggcgtgaagttcagcaaggccagcacgctcaagaacatccgcttcgcgttcaacggcggcaagaaccacttctaccactccaagctgcagaccaccacggatggcgagaactggaccgacgtgccggatgcgacgttcgagcgcccgaagggctccgaggagccgatcaaagtcaccggtctgaacatcaccggcgtcaccggcgtgcgactgatcgccaccgccgacaacggcgatgacctgtggctcggcatcaagggcatcgacgtcaacaaggtcgagaaggagactctcgctccgtacacggcgaccggcgtgcagctggagaacctcaacgccacctacagcagcaccaaggagcagatgatcgacggcaacccgtccacgatcacctacctcaaggacccgaacggcgacaagatcgcggccggcgcggccgtgatcgtcgatctgggctccagcaagccgatcggcgaggtcacgattaccggtcatgcctccagccccgacgaccgtccgagccagggcgtcgtcgaggtcagcgatgacaaggccacctggaccaagctcggcgacctgagcgacgacgtcacctccacggtgagcggcaacgtgaccgggcgctacgtacgcatccgcaacaccgccgccaagaacgtgtggtggcgcgtggccgagatcaccgtgaccccgcccgagaccgccgacccgctcaagtcggtgtacacgaacaagacgcagcacgggtacactgccacgctgggcgccaatacggcggagctgttcgacaaatcgcacacgatgcttgacggcggccagtacgccggactcgatctgctggcgatccgtgatctgaccgacgtcgaactgaacaccggcaacgcgaaccccagcctgcagatctccgacaacggactcgtctggaccactgtcgagccgggcaacctcacgggcaagaccgcccgctacgtgcgcgtgatcaatgacaccgacggagcggccttctcggtcaacaagctcaaggtcggcttttccacggtcggcaagttcggcaagctggtctcatccgacatccagaagcgcaacgattggggaaccgacacccgcgaaagcggcaacgcgttcgacggcgatatgaccacggtcatcaagttcgccggccagccgcgacagggcaacaccgcggtgttcgatctcggtcagccgatcgacatcacctcgctgcgcatctacacgcaggacacgcagtacgactacatccgcgacaccaaggtgcagatgtccgtcgatggcaagacctgggttgacgcgttcgagattggcgacggtgtgtccgacaccgacaccacgaccgcgttcggcgacataagcgacacgaacaagaagaccgattccaactacccgaacgtcttctactacggcaaggacgacatcgccaacggcaccggcatgcgctacctgcgtctgctgaccaccgccgactacccgcagcgtgcactcgcgttcaacgagttcatggtgaatcagggcgcctacgtctccaccgaggcgaacgcggcgttctccgccaccaaggtcgaggagcgcggccacgcgccgagcaacatgatcgacggcgacctgaccaccacgtacaagccgagtgcggccaatggctccctgacctacaagatcgatgacccgagcgacatcaagtcgttccgcatcgtgcagtcgggtgccgccagtggcgcgaccgtcaccggtacggtgtacgacgcggcgaccggaaccacttccggtgtgacggctcgtacagccgcccgctccacctccgaggtgacgttcggaacgctggaacaggcgatcaacgagttcaaggtgccggacggcgagcagctgctcagcgtcaagatcgcgtggggcgacgccatccccgagatctccgagttcatcacgctcgactcggccgacactgatgccgacatcaccacggccaaggcggcgctcaaggcgaagatcgacgcgaccgtcgacacttccgcctggaccgcgaacgccaagaccgcgtatgacgaggccaaggccaccgcccaggctgtgtacggcagcccgctggtcggcaaggcttcgatcgacgccgcagccagcgccgtgcaaagcgccatcgacgccgcgcagaccaaggccgacgccgccgcggtcgccgcgctgcgcaagctcgtggacgaagccgtcaccaacgacggccacttctacacgacagtgacgttcaccgcgtacaccgacgcgctcgacgaggtcaaggaagcgctgaaggacacgaccaacctgtccacagcagacgccgcaagcctcaagaaggccgtcgaggacgctctcgccgcgctgaaggactccacctaccagcgtgagctcgcgacgatcgccgtcgacagcttcgccacgatcgacgaggccgactacaccacgaactcctacgcggctttcaaggccgctaaggaggcgctcgacaccctgatcgccgccgacggcaccaagccggccacgttcaagaccaagaccgccgagtacaccaccgccaagaccgcgctggtgaacgtcgccgccctcaaggcccagatcgcgcacgagagcaactacgtggaggcgaactacaccgccgactcgtggaaggcgtactccgacgcgctcaaggccgcaaaggcggagctggtcaacggcaccaccgattcggtggccgccgcgctgaccgcgctgaccactgccgagaacgcgctggtgcgcaccacgacgccgcccgacaccaccgtgctcgacgagaccatcgccgacatggaaaaggttaacggcagcgagtacaccaccgacagctacaaggtcctgaccgacgccatcgccaaggcgaagagcgacaaggccaagggggatgccggcctcaaccagcagaacatcgacgccatgaaggcggcgaaggaggccctggtctccaccgtcgaactcaaggcgaaggtcgccgaagccggcaaggttgactcgtccaagtacaccacggccagctacgaggcgctctccaagctgctcgccgcgaaggacgacaccacctccgacccggtcgtcaagggtctcgacacgctgtacaagtccggcaccgtcaaggagctcgccgagcgcgtcgccgccatcgacgccgcggtcgccaagctggatgcccgcgccaccggtgtcaaggactacgtggacggcatcaagctcaaggacaacgacaagggctactacaccgacgccagctacaaggcctactccgacgcctacaaggcgctgaagaagctggccgccgccggtgaaggcgaagtcgggattgccgagttcaccgaagccaaggaggcgttcgaagccgccgaggccaagcttgcctacaagtccgcggactacggcaagatcgatgacctgctcgccaaggtcccctcggacctgagcggctacaccgccgactcggtggcgaagttcgaggcggccaagaaggccgtgaagcgcggactgaccatcgaccagcagagcaaggtcgacgcgatggccgacgcgctcgaagccgccatcaagggcctgactctcaagtcgcaggcacccggtggcaacaagggcgacggaacccagagcggcactcataagggtgacgacatctccaagaccggcgccgacgtgcaggtgttcgcgatcatcatcgcgctcgccacgtgcgctggcctgggcgccgtggcctacgcccgtcgccgccgcgaggcgtgacggcaggctgactagccgataacccaaggggctcccctccaatccaaggaggggagccccgatttgttggacgctgtgtaaatgtatcgcggacacgcgcgatccgcgcccgttacgcgaacaggtcgttcagcgcttcggccatggtcggatgcgtgaacatcatgtcgcgcagcgtactggccggcgcgcccatatccatcgccagcttgacgatgttgatcacctcgtgcgattcggcggcgagcagcatcgcgccgagaatgcggtcggtgccgttctcgacgagcgccttcatcatgccctccggccgacgcatcacctgggccttgggcaccgtggccaccggcagtcgcttgaccacgtaatccagtcccgccgccttcgcctcgcgctcattcaggcccacgcgcgaatacggcgtgtgcaggaacgtgcttgacggcacgttgcgacggtcgctcagcgtgtacgggcgcgcggaaccgttcagctgagaccatactacgcggtagtcatccagcgagatgtacgtgtgctgcgggccgccgttcacgtcgcccaaagcccagatgccgtcggcggtggtacgcagcaggtcatcgaccttcacggcgccgcgttcggtgagttccacgcccgccgcctcgagattcaggccctcgacgttcggcgtgcgtccggtggccaccaacaccgcgtcggtggacaggcacagacgcgctttggagccgacgtccgacgcacccctcatcgagacggacagcctgatgccgtcatccgccgatgtgatcgccttggtgtccgcgccgaacaggaacctgaccccctgcgattccagctgtgcacggatcgcggccgccacatcctcgtcctcgcgtggcaggaactcgtcgctgtgctgcagcacggtgaccgccgtgccgaaatcggcgaacatcgaagcgaactcaagtccgatgaatccggcgccgatgatcaccagccgttgcggaagctcgtcgacgtccatcagaccggtgctggtgtatacgcccggagtggtgcgaatgccgggaatgtccggaatgtgcggcgtagcaccggtgttgatgaacatcatgtccgcggccacggcgaccggtccgtcggcggtggtgatttccgcactgtgggcgccggtgaagcgcgcgcggccggtgatcacggtgatgttgtcctggtcggccagcttatggtagttcctgtcgcgcaacatcgcggtgatgcgccgcttctccctgatggcggcttcgaatgccgcttcgcgggtttcggcggtacggttcgcgccctctcgccgcgcccgatcggcggagaggatcagtgatttggacggcaggcatccgatattgatgcaggtgcctccgtacatgtcggcgctcgcttcggccacgatgaccgttcggcccgttgaagcgagctttgcggccaatgtcttgcctcccttgccgaatccgatgatgagggcgtccgcggaaatcgcggatggaacgtcggtgctgctggtgctggtcatggtgatgtccttacttatgcggatggtggtgcgcccaaaccgaggtgtatccgtctttcgtccccttccttggcgacgatgggaccggtcgacgcgagtgggcgcaccactgtacgcacgcgcgccgaagtcggagccgtagtcctgtcctatgcggctacgataccgtcatcatatcagatgcggtgggcggagcgaagcgtgaatcggacttatccacatggttatccacacccgaggtgggtccggtcacggcgttcatccagacggcccatgggtgtaatgcgaaggcccttcgcggaagctgatccgcaaagggcctcggggtcggtcgtttggtggctaacgggccgccagcccggccatgcgttgcatggatctcattcgcccaatgccttgtcgacgacgagcttggcctcgtcgagcaccttgtcgagggcctcgggggagacgaaggattcggcgtacaccttgtagatgttctcggtgccggaaggacgcgccgcgaaccagttatccttggtggtgaccttcaggccgccgatcttggcgtggttgcccggcgcctcggtcagcttggcggtgatgtcctcgccggccagctgcgtggcggtcacgtcatcgccggtgagcttggcgaacttagccttctgttccagcgtggtcggggtgtcaacgcgcttgtaccagctctcgccgaagcgggccacctgatcctgatgcagctgcgcggggttcttgccggtcttggcggtgatctcggcggccagcaggtcggggatcaggccgtccttgtcggtggtccacacgcggccgtcgcggcgcaggaagctcatgccggagctctcctcgccgccgaacgcgacctcgccgctgaacagcggatccacgaaccacttgaagccgaccggaacctcgacgagcttcgcgttgatggacgaggccacgcggtcgatcagggaggaggagaccagggtcttgccgatgccggtgccttccggccagcccggacggttgccgccgaacaggtactcgacgcacacggcgatgtaatggttcgggttcatcacgccccagttcgggcagacgatgccgtggcggtcggcgtccgggtcggtgccgcccaccaggtcgtacttgtcccaggcaccggcgttgagctggtccacgaggcccttcatcgcgtacggggagctcggatccatgcggatcttgccgtcgtggtcgatggtcatgaagcgccaggtcgggtcgacctcggggcgcaccacgccgatgttcaggccgtacttctcgttgatgagcggccaatagttcacggaggcgccgccaagcggatcgatgcccaggcgcacgccggagtcgcggatcacgtcgaagtcgatgacgttgcccaggtcggcgacgtagtgctcgcggaagtcgaagccctcgacgtactcggacttgatggcctcctcgtagggcactcgcttgatggacttgaagtcgccgagcagttcgttggcgcgggcggcgatggcgttggtggtctcggccggtgccgggccgccggtgaccggatcgtacttgaagccgccatcggtgggcgggttgtggctcggggtgaccacgatgccgtcggccaggccctcgccttcgaagcgctgggtgccgtcggccgcgcggttgtgcgtcaggatcgcctgggagacgactggcgtggggacgaaatcgccgcgggagtcgacgcgcacgtgcacgccgttggcgacgagcacctctatggcggtcttctcggccggaccggacagggcgtgggtgtcgcgtccgaggtacagcgggccggtgacgccggccttcttgcggtactcggcgatggcctgtgtgatggcgacgatgtgggcctcgttgaacgaggtcttcagtgacgagccacggtggccggacgtgccgaagatgacacgctgctccggaaccgccgggtcggggacgaggtcatagtacttgccgatgacttcgtcgacattgatcagatcagctggggtggcgggcttgcccgcattgtttgctaccatgcttctattttgccacgaccagtgtcatttgggttacgtttttgtgagaaattgtgattttttgttcgagaatgttggtgatgttgccgggcgtgctgcctgcgcatgccatgtgcgcccagctctatccgctctgtcattaggtacaccggtacattacgggttcaaatagccgttatctggtattccccgtgcgaaatggtcgtttcaaagcccaaaaacgaccatttcgcacatgcaattgtgaataacggctatttgaacccgtaatgtaccggtgtaccagataagaggatgacggcggggagggggaaggcggaaaagaatgcagcgaaaagagacgcggaggaaagggacatggcggaaaaggggcacggcgacaaggatgcgaggaagcacgattgaccctagaggattgattagtggagtgacagagtacgacggatagccccggaggacaggatggcgaagggcggaacataggggatggagacgcgggaggaagggacgagtggaaatggcacggcagaggcggtctgtgttggccatcgacgccgatatgccaacggcatggggaatcaaaggcgcttggaaccggcgagaggttgatggattggcctttgccgcgaagagggcggcaatcacgatggcaccggtcgtggaaccggtcttcgcgagcgtcttcaccgcatcggcggaaggcgcgacctgaacctgcggcttgaagatcgtgaccttcggcttgctgggcttggtcggcttggtaccgggcttaactaacgagctcagccggctgcgtcggctcgccaggcttcgtcggcgccttgtgcatgttggcgaacgtggccgcgtcaacggtctcgccatccttcgcatacgagacggcggcggtcagcgtgttgtcggccgtcgcggtcacggtgatggtcgccgcgtactcggtgctgtcatacgtgacgccatcggcgttgccggcgacctgcacgagcgtgtactcgtacgtgccggcagcgtcgaacggcagctggtcgaaagtgacagtgccatcggctgcgttcgtggtagtgcccggcatccaccacgtacgcagccgcaaggagaacgtctccgatttgcgcgacaccgtcggcgcgaccgcatacggccatgtcggcgacaacaacgatgccggtatactcgaccgcctgtccacgagcaagtacaagaacccggccgagctgtccacgtgaggcgcagacaccaccggcccagacctgaccaccaagggtgtgggtaatttcacgcaggatgatggcatcccgttgcaggtctgggacgcgtctgcgtcaccatcggtatgcccgcctgcaagtccggttcgaccagcggttggacatgcggcgtcgtcaccgccgacaaggtcaccgaaagcgtgaacgacaacggcgagctgctcgacgtgtacgacttccacttcagcgccttcctgctgagcggtgactcgggcggtgccatcgtgtccggccactactcgatcggcgtggattcgtacggcaacatgagctcctgcgatgacgcggccgatgacgatgcggtcgccggtggcttcgccatcgttgacagcaagtacaacgccgaggcgatgttcaagcacggcttcaacctgtccatcaacgtcggacagccgaagttcgccaagctcgccgccggccagatatccggtatggtcgatgccgccgccggcgcgaaggtcacggtgacggtggatggcaagagctacgtcgcgatcgtcgggaacgccggtgcctggacggttcgtctgccgaaggcgcttgcgcccggctcgcacaaggtgacggccgtggcctcgctgcagtccaagggctccgatttcgccacgaccggagccgccgcttcccggaagttcacgctgtagcggtagcgggtcttcgcggatgggcgccgtgatgcgtccgtaaggcggcgtacgtgcgggctgagccgcgagcgcgccgcccgccccgtcaattgcgggtgatgtctcgcgcggcgagatccgaaaatggttccacgccatacggccggtcggtgctctatgttccgaccggtcgtcacgctgcgcgggttttgcgtcactgtgcgcgggccgcgtcacgctgcgcgacccctcgcacagtgacgatatccccaaaacccagtgattgcaagggttttcgtcatgcgtcactcggtgcggggtcgcacagcgtgacgcggcccgcgcacagtgacgggtgcccgcgaaacatgcgtcgcatgagccggcgatgatgcttatatggatgtttatatagatgaaaggcggggcgcatcggccacccgctcatcgcccgaatggttgcgatgccatctttgtgatttatcggcgtgtcgcagttcatctgaagttaacatatcaatcgactcaatgcagggttgcaagtcgacaagacgcaagacctgagatacggataggactatccatatctcaggtctttttttttgcggcccggcaccggagacggatcaatggaagattcacggaaagggatgtgagatggcagcatcaactgcatcgcagatcatcgaagcgatcggtggcgcgggcaacgtcaagagcctgacgcactgcgcgactcgcctgcgcttcgaactcgtcgacgcgggcaaagtagaccagcaccggctggagaccatgaagggcgtgctgggagcggtgccgcagtccggcgaccgttaccaggtcgtcatcggcggcgcggtcgccacgatgtacgagaacatcatgcacctgcccgagatggcgggcgtcggcgctggcaagggcgcggtcgccggcgacaaggcgcagtccgatgccgacgtcaaagccgccgaacgcgccaaggtgcgcggcaaagtcgcgtggatggactcgttcttcgagtacctgtccgactcgttccgcccgatcctgggcgtgctgctcggcgcgtcgatcatcatcgccctgatcaacctgtgcatctccatcggtatcgtgccgggcgaggaagccaacaccagcctggtgttcatcaaggccatctggaagggcgtgttctacttcctgccgatcatgattgcctacaacgcctcgaagaagctcaaggtcgacccgtggctcggtggctccatcatggccgctctgatgaccccgcagttcgccgacctgatggactccgaaaagtggaagggcgtgaccacctgcgtcaagagcgccacgctgggcaccacctcctgctcgaccaaggtgtttggcattccgatgctgctcaacgactacagcggcaacgtgttcgtgccgctgctgatggccgccgtgctcgcgctcgtctaccacgggctcaagaagattatccctgacagcgtgcagatcgtgttcgtgccgttcttctcgatgatcatcgtcggcgccctcaccgccttcctcatcggcccgctcggcatcctcgccggcaactggctcggcgtcggcttggcctggctcaacggccacgccccgttcatcttcgcgatcctgatcccgatgctctacccgttcctcgtgccgctcggcctgcactggccgctcaacgccctgatgctgatgaacatccagtcccttggctacgacttcatccagggcccgatgggcgtgtggaacttcgcctgcttcggcgcgaccgccggcgtgctgttcatctccatccgcgacaagaacaaggacatgcgtcagacctcgctcggcgccctcgccgccggcctgctcggtggcgtgtccgagccgagcctgtacggcatccacctgcgctacaagctgatctacaagcgcatgctggtcggctgcttcgccggtggcgtcgtcatcgcggtgctcggctggctgttcccgtccgtcactgcagccggcgaatcggtgcgcggcgtgaccaccaacgcgttcgcgttcacctccctgctcaccatcccggtgttcagccagatgtgggtgtacgccgtctccatcgccgtgtcgttcatcgtctcgatggtgctgatcatcatgctcgattaccgtactcccgagcagaaggccgagatgaacgccgccagcgagtctgacgggaccgccgtcgagacggcgccggcggacgctgcaccggtggcgaccgccaccgcgaccgctactgccaccgccgttcgcaccaccacggtcggcgcccccgtcgcaggccatgtcgtgtcgctcgacgacgccggcgacccggtgttcgcctcccgcgcgctcggcgagggtgtgggcatccagcccactgattccaccgtggtcgcgccggtctccggcgtgctgcagaccgtggccgagaccggtcacgccttcggcctgaagaccgacgacggcatcgaagtgctggtgcacgtcggcatcgacacggtgaagatgaacggcgagggcttccacgttgccgtcagcgccaaccagcgcgtgaacgcgggcgacacgctggtgaccgtcgactttgataaggtcaaggaggcgggatacagcaccacgacactgatgacggtgctgaacaccgcggcgcttgccggcgtcaccccgaagacgggcgtggacgtgcaggcgggccaggaagtgctggacatccagcgctgaccgcatcaagagccaatcggcgcaacggccgagcggccggaaggaatgccgtgaaaattcttcgcgtgttcaacaacaacgtcgtactcgccaaggacggtgcccgcgaggtcatcgtcaccgggcgcggcctgggattccaggccaaacccggccagcgcgtcgacgacgcgaaaatcgtgcgcgtgttcgttccggccgacggccgagacccggaccatatcgcggaactgctgtccgagatacctccggagatcattcgactggtgacggacgccatgacggcgaccgggctcgcggaacaggccgaatcgcagcccacgcttgtcatggcgctcgccgaccacatcaccggtgcggtgcagagggcgcagcgccacgtcaacatcgcatatccgctgcaggcggaagtccagtcgctgtacgcgtccgagtacgcgcaggcctcgcggctggtcaatgaactcaaccgtcacctgaacggtgtcctgcccggcagcgaggccgtggcattggcgttgcatctggtcaacgccggcttcgcgaacggcgacctgtccgacacatacaagatgaccggcgtcatccagcagatgctgaccatcatcgagcagacctacggcgtctcgcttgatcagcacagcgtcaacgtcggccggttcatcacccatttgcgctacctgttcgtacgcatccatcagggcaagcagctcgacaaggaacccgagccgatcatcgcatcgatccggcagtcatatcccaaggccatgcagtgcgcgcagaccatcggcaccgtcgcctcgctgcgtctgggctccaacctcaccgaagatgaggtcgcatacctggcgttgcacgtcgcacgggtcgtcgcggatgcacgtaagcatgagtagcgctctcaaaacttgcagatagaggccatttttcatgaaaaatggcctctatctgcaagttttgagcaggtacacctgcggggtctcgtccatgtgcagcgtgatccactcgttgtgtgcacgggtcgggaagtaggcgctgtagatcttcttgccgagtgcgagcacggactcgtcaaggtgtgtgccatcggaattacggatggcatcagcgccccacaattcggcaagttccttggttttttcagcgaagttctcttcactgggcaatgtgaagcggccagtgctggtcatgggttctccttcttgggaacagtcatcggggaaagatatatgggtgatgaaatcacgaaggccgatgaaatggccggcatcatcgcaggcccgctggatcctgactgcgcaaatccttgacgcctacgatgacgctggacgatggtaatcgtgtcactgatcgaggtgatggccgtaccgcccggcactcagtgacacatcatgccgggcggcggttcgtggttttctcccgcacatggcgggagaaaacatcagcccttgacggcgccggcggccaggccggactgccagtagcgctggagaccgaggaagatcacgatcaccggcagcacgccgagcagtgcgcccatcatcagggcgccgcgatcggtgaatgtggccaacgacaccatgccgtacagacccagggtcaccggcttgagggtgtcggaggacaccatcatcaacggcagcaggaagttgttccacgtggcgacgaacaggaacaggaagatcgtcaccattgccggggcgagaagtcgcagcacgatggtgaagaaaatcctggcttcgctcgcgccgtcgatgcgggcggcttcaagcagttcatcaggcacagagctctgggcgtacgtacggcccaggaagaagccgaacggcgagacacagcacgggatgatgatggacgccatcgtgttggtcagcttcagagcgtggaagatcgagtactgggggatggtgagcagggcggcaggcatcagcatgcaggccatgatgatgccgatggcgacgttcttgccgcggaagttgaacttcgcggtggcgtagccggccatgacggacacgatggtgccgatgagtgcggagacgcccgagtagatcagcgagttcagcacccagcgccagaagttgccacgggtccagccgagcagcttggagtagttggtggccacggcgttggggatctggtcgagcgacacggagaaccacaggccattgccgctggtcatctgggagggcgtcttggtggacgcaatgatggcccagtaaatcgggaacaggaagtagatcagcgccaacaccagtacgatgaccgtaagtgtcttgactgcaggcgacggcctcatggaacggggcagatcgtgctgtgcagcctcgcgctgcttctccaaacgacgttcgcgcttcttgttcgcgcgcacttcagcggttgcagagctcattactcgttcaccttcctttcagcaagggtgtacacgacggcaagcagacctgcgatcagtgccatgacgatggcgatggctgatgcggggccgtcacctgacggggtaagcgttccctgcgaagtattcatggccatcatcatcggcgtgtacgccttggagatgcccggatccgcggtggacatgatctgcggctcgttgaacagctggatggtgccgacgatggacagcagcatggcgagcagcgccgcgccacgcacgttcggcagcttgatcttcatggcgacctggaaaccgttggcaccatcgatgcgggcggcctcatacaggtcgtgcgggatggcctgcagcgcggcgaggaagatcagcatgttgtaaccggtgaacgtccaggtcgtgatgttggccatggaaccgaggacaacgttgttggcaaagaagtcgacatggatgccgatggactccagacccttgacgattggggaaatctgaccgttgtacaggtagacccagatgatggaggcgacgacgccggggatggcgtagggcaggaagtagcccagacggaaaccggtaacgtgcttgacgacaaacgaatcgatgaccatagccagcgcaagggcggcgatgatcatgatcggcacctggatgacggtgtagagcagcacatggccgacaccagtccagaatttgccggaagtgatgacgtattggaagttctggaatccgacgaactcgttgaccagttcgccgccgccatagaggccgccgccttggctgacctgacggaagaagctggaatagacggcccagatgatgggcaggaggaacacgaaggcgaacaagattgcgaacggcgccatgaacgcccagccggttcggttctcgcgcttgaatgccttcgagcgctttggctttgcggcggcgcgtttcggcgcggcacccttggcctgagtaatggatgcagtcataatacaaacctgtcttttcgaaaaacagaaaaacgattccacgagcatgtactcttggacatatgaaaggccggagtccgaatccccggcctttcattttatgatgcctgaggcatcgggggtcttgggtgatggacggaacttttcagcttatccatcaccggaccgggttatgttcactccttgacagggagcttggcgttcttcagcgcttcgacggaagtcttctgagcggtgtcgaagatgtcggagaccttggcgtcaccagtggcggccttggcagcagtctcgttcatcgctgcacccacggcggagaagcccgggatgtagttgaacgaagccatgttgtcgttcgctttcttgaactcagccatgatgtcctggttgctgaagaactcggaccacgcagccggagtcttggcagcctcagtggtggcggccacgaccagaccctgggagaccagatccggaacctgggtgttgaaccagtcgaggaacttcatggcctcggccgggtgcttcgagcccttgagcacagccacgccggaaccaccgtcggagccggtcttggtgccgttgccgaaccaatcgggcagctgggcgaccttccactcccccttgccggtgccaccggcggagctgatgaacagcggggcttcccaagcggcagccacagtgccgatcagctgacccttgttaatggaggcgtcgaaggacggatcccaacgcgggttggtgagcgcggacttgtcgtcgagcagctgctggtacaccttggccacggccttggagcctgcagtctgggtgtcgaccttccaggcattgccctcagtcttgtaccacgcgccggaagcgccggaagtgccggacatcgtcatcatgccctcatcgggctggaacgtcatgatgtacttaccctgggcggcggtcttcttggcggtcgcgataagctcgtcagcggtctgcggcacggtgatgccgagcttctcgaactccttggcgttgtagaagtacgtcagggggccggtgtcctgcggcagaccgtaggccttgccaccgatctgcatcatggagaacggaccctcagcgaagtggtccttgtacttcgcggcctcttcggtgacgtcctgcaacagaccctgactgaagacctcaggcaactcggcgtatccgacctgagccagatcaggagcggcgccggccttgacgtcggtcgccagcttcttgatcatgtcctgagccgcgccatcgaacttggtggccttgacttggatgttcgggttgtccttgttccacttggccacgatgtcattgaccagcgtcatgccctttttatccggcaggcgatgcatgtaggtgatcgtcaccttttcgtctttgggggtattgctgctgttgttcgtgggcgaaccgcaaccggcaagggcgatgcccatgacagtcagcgacgccagaccagcaagcagtcgtttcttagctaccatattcctaactcctccattgagatggatgttgcctcctcgtcgtggcaactaattagttagtgtaaaggcatgccaaggaaatgtcaactacattaacatttgtgtcgtgtcaccggtcacacagatggtaacccacggtgtgcaacaccgcacgccagtaagcatgacagatttatgtatataaagtttacaatttatttttctctcttctagtcgtcaaggccatccctatcgacaacaacggagtctccccgcgaaaaaccttacggaacaccggcctatacggcgtgtcgtccattccttcggcgctcgaatcaagctcatcctcataatgtgacactcctcacattaccagagtcattctggtcacgcagccatcttcatcccgctcacgcgccgaccgcaatgccgggcacgatacggaaaacgccccggcgtgtcatcaaggacacgccggggcggggcgcaaaggcgatcggtaccgcgaggcgtctactcgacgctacgcaactgcgctgctatctggatggcctcgacactggcttcggccttgcttcgcgtctcctgccattcggtggcgggcaccgaatcgagcacgagaccggcgccggcctgcacgctggcctgatgatcgcgcaggaaggcggtgcggatggcgatggccatgtccatattgccggagaagtcgaaatagccgactgtcccgccgtagatgcctcggtcggccgcctccagctcgtcgatgatctcgatcgcgcggggcttgggagctccggacagcgtgcccgccgggaacgccgacatgaacacgtcgaacgtggtcaggttcggatcgaccgtgccagtgaccgtcgagcagatgtgcatgatgtggctgaaacgcttgatgtccatcagctgcacgacctcgacgctgctgggcaggcagaccttgctcaagtcgttgcgcgacaggtcgacgagcatgatgtgctcgctgcgctccttcggatcggcgagcaattccttggcaaggcgctcatcctcttccggggtggcgccgcgcggacgggaaccggcgatcgggaaagtcatcgcatgcccgttgtcgaccttgatcagcgtctcggggctggaaccgatcacgttgaaatcgcgtccctcggcgtcggtgagcgtcatgaaatacatgtacggactggggttgagcgtgcgcagcacacggtacacgtcgaacgggtcagccggcgaatccagatccagacgctgggatatcaccgtctggaacacatcgccgtcgacgatgtgccgcttcgtctcctccacccagcgctcatactcggccttggcggtgcggaaccgcagctgggggtggggcaggcttcggtcaagcacgctcacgcgggcctcccccgccaccggcgtggcggccttgcgctgcatggcatccagccgttcgatggcctcgtcatacgcggcatcggcgcgggtcggccggtcgtcgacgttcaccgcattggctatcagccacaccgagccggacacatggtcgaccactgcgatgtcggtggccaaggccagcgtcacctccggctggccggtctcatccggcgcctcggcgcgcagtttgggctcccaatggcggatggcatcccagccgacggagccgaccagtccgctggtcaggttcggcagtccggccacatgcggcgccttgagcaccttgagcgcggcatgggccacctcaatcacgtcaccctcagtgggcactccggccggcacctggccgagccagttcgccttgccgtgatcggagcgcagttgagctatcgaattgacgccgatgaagctgtatcggctccaggaaccgccgtattccgccgattccagaatgaacgttcccgaacggcccccggcgagacgctcgtaaaagcccacgggcgtcaacgaatcggcgagcagtcgccgcacgatgggaaccacacggtatccggcgtcggcaagccgatggaactgggcgcggtccggccatgtgccgccccattcgagatgctcgacactgcacgcggccccatcatcgtgcaggccgccggccacaccggcatcgtcaatacgccgctcgctcatcacgcattctcctgttccgcggtacggtccccgacgacgaccggcaacgggccgccctcctcgaagcacgagcgcttgccggtatggcaggcggcacccacctggtcgacctgaaccagaatcgcatcgccgtcacaatccagcgccagggacttcacatactgcacatggccggacgtgtcccccttacgccagtattcctgacgggagcgagaccagaacgtcacgcgaccggtcgtcaacgtgcgccgcagcgcctcgtcgttcatgtagccgaccatcagcacctcgtgcgtgtcatactgctggatgactgcggcgaccagcccgcgcgcgtcacgcttgagccgcgcagcgatgcgcgggtcgagttcgtcggtgttgtcatagtcgatggtggattgcgtatctgtcatgtccttcatattcctgttcatgtccctatggagtcgtgttcatgcatgcggcgaatcatcgccggccggttccgccgcgatttacaggcgaaccgtgtatcccgcggaccgaagcgcctgcttgacctcgcggatggtcaccagaccgtaatggaagatcgacgcggcgagcaccgcatccgcaccggcggcgatggccgggggaaaatcagcggctttgcccgcgccaccggaggcgatgatcggtatcttgacctcgcggcgcactgccttgatcatctccaaatcgaagccctcacgggtgccgtccgcgtccatcgagttgagcaggatctcgccagcgcccagttcctcggcccgcttgacccaccagatcgcgtcgatgccggtggacttgcgcccacccatcgtggtcacctcgaacccggactgcgtatgctgttcgccctgctcgcggcgggcatcgaccgacagcaccagcacctgattgccgaatcggtcggcgacgcggctgatcagcgtcgggtcgttgatggctgcggtgttgacgcccaccttgtcggcgccgcaacgcagcagcgagtcgacgtcctcgggagtacgcacgcctccgccgacggtcatcgggatgaacacctgctctgcggtgtggctgaccacgtcgatcatggtctggcggtgcgagctggaggcggtcacgtccagaaaggtcagctcgtcggcaccctgacggtagtactcccccgccagctcgaccgggtcgccggcatcacgcaggttctcgaaatgcacgcccttgaccactcgtcccgcatcgacatctaggcatggaatgactcggacggccaacgacatgattgctcccttatcaagctcggttgttgtacggataccaagggtagcgtccgcccgttacagcagtgccgcggcgttccgctacatgggacgggaaggccgcgccctctgcggttcgagattcgcggcctgcagcagtgagagcgcggttaggccgcgaaagcctctttggtcttggcggcgagctggccgcaggcgccgtcgatatcggagcctcgggtgtcacgcagggtggccgtgattccggcatggtgcaggatatcgaggaactgctgctcatcctcgggcttggatgcggtccagcgagatccctcgatcgggttgagcgggattgggttgacatgcgcccaatcgtcgccgtaatggttgagccgcttggccagcagtcgcgcgtgctcggcctggtcgttgatgccgcgcatcaacgcgtattcgatgctgacgcggcgcttggacgacaggaagtaatcgtgggcggcgtcgagcacctgagtggtgttgaaacgcttgttcatcggcacgagctcatcgcgaagcgcatcactgggcgcgtgcagcgacacggccagacgcaccgggatgccctcggccgtgagcttcctgatgccgggcacgacgccgacggtcgatacggtgatgttacgcgcggagatgccgaacccttcgggaggcatcgcgctgatctggcgcacggcggacagcacggaccggtagttgcccatcggctcgcccatgcccatgaacacgatgttgctgagccggccggggcctccggccacttcgccgtcgcgcatcatacgagcggcgacgcgcacctgttccagaatctcgccggtcgacatgttgcgggtgagtccaagcttaccggtcgcgcagaacggacagcccatgccgcagccgacctggctggagatgcataacgtggtgcggttcgggtaacgcatgagtacggattcgatgtgagagccatcgaaaaggcgccacagcgtcttgatggtggtgccctgatcggccacctgatgggtcacctcgtcgatcagaggcgggaagaacgcctcgacgatatcgccgcgtgtggcggcaggcaggtcggtgaacgcctcggactcggtctccagccggccgaagtaatggttcgccagctgcttgacacggaacttcggcaatcccagatccttcgccctggcgatgcgctcgtcaggcgtcatgtccaccagatgcaccggcggcttgccccgtcgggcatggtccttggacagcacgtcgcggaaagcccccttgtcgccgggggtgattccggtctccggctgttccgcatcctgcgcatgcccggtcgtcattgctcctccatcatcgttcgtatcttgtcgtcgcttcccgcatcgtcatgtccgatcgtcaagacgaccgtcacatgccgacaatccacagcagtccggccaggaacggcgcgcacatgaggatggaatccacacgatccatcacgcctccatgacccttgagcaggtgtcccatatccttgatgccgatatcgcgcttgagcatggacgcgcacaggtcgccgaacgtgcctgcgacgccggtcagtactcccatgacgatcggaacccaccagcgcgacgcccacaccgcgccgtcatacgtgcagaagaacaccgcgaacgcgccgatcatcgcgaacaggatcgaaccgaacagtccctcgaccgatttcttgggggagatgcgcggcgacagcttgtgcttgccgaaccatgcgccgaagaacaggccgccggtatcgctcagggccggcaggaacaccagcgtgatcgcgtgcgcgaccggatgcccgttgaacaccagcgacagcacgatgcagctggccagcgtagggatgtacagcacggtgagtatcgagacagcgacatgcgacagccgactgtgatgcagttcgcctttctcatggttgaacgacgactgctcgcgcgcggcggcgtcggagctcgacagcttggatgcgacggcgagcgaaagccagttgccgaagctgaaccgggcggtggcgagaatggccaccagcatcagcgtcgccatcgtcagcagcgccatcgtgccgaaatggtacgggctgtaataggtgccgagcaggatggccgccgaacacagccacagcgcgacgaccgggatatgcagaccgaccgtggcgaaatcgacacggagctcccacagcgcaagcaccatgaacacgacgatcagcagcacgaacacgtcgatgcggatcagcaggctcgccaatatgatgatgacgagcaccgcgccggtcgcgaccgcctgcggcatgttgcgcccggtcttcttgttgatgttcgccagggcctcctcggcctccacatgaagctggtcgttgtgttccatgatgttcaaccgcctccgtaagtcgatggtgccatgatgattctgccttcatcatagcgaaccggacgaggcgatggtcacatgccgcgtccggttcaacgatttcgtcatgaaggtcagacctccatgatctccttctgcttggtctcgaacagcgcgtcgagctggtcggtgacctgcttggtgaccttgtcgagctccttgagcagacgatcgccctcgtcctcgcccatctcgccgtccttgacggacttgtcgatggtctccttggccttgcggcggatgttgcgcacggcgaccttgccgtcctcggccttcgacttggcgagcttgacgtattccttgcgacgctcgctggtcagctccggcatggtgatgcggatgacgttgccatcgcggttcggattgacgccgagatcggagtcgcgcagggccttctcgaccttgctggcctgggacacgtcgaacggggtgacggaaagggtgcggggctccggcacgccgatggacgcgacggccttcagtggagtcggagcaccgtagtagtcaacgacgatgccattgagcagcgcggggttggcgcggccagtgcggatgcccgcgaagttctccttggtgttctccacggacttgttcatctgttccttggcttgttcgacaggattggccattttgtgctccttgttgttgttcttcgttgaagttggtttcccgggttggatgcaggcgcgcgatcaccgatgcgcgtcgctcacgcgagcgtggattcggcggtggacaccagcgtgccgatctcctcgccgagcagcgcgcgggtcacgttgccggcctcttcgagaccgaacacgcggatgcgcttcctgttgtcgcgggccatggacagcgcggcggcatccatgaccgccaggttgtcgacaagggcgcggttgtagctcagcgttgcgaaacgcttggcatctgcgtccttgcgggggtcggaggtgtagacgccgtcgacgccgttcttgcccataacgacctcatcgcaatgaatctccagcgaacgctggatggacaccgtatcggtggagaaatacggcatgcccgcaccggcgccgaagatcacgacgcggcccttctccaagtggcggatggccttgagcggaatgtacggctcggcgacctgacccatggtgatggccgtctgcacgcgggtggcctgcccctcctgctccaggaaatcctgcagcgcgaggcagttcatcaccgtgcccagcatgcccatgtaatcgccgcgggaacggtcgatgccggcctgctgcaattccgcgccgcggaagaagttgcctccgccgacgacgatggcgacctgaacgccctgccgcacggcggggacgatctcctcggcgatgcgacgaatcacctgcgtatcgatgccgacctttccgccgccgaacgcctcaccagacagtttcagcaatacccttcgtggctgatccgccgctactccatctgccatgcatagcctttctgatatcggttccctgatgcttcgtgagccggaaccgcccgacatactgcctatcagcgtatccgcaaactgcgacagtgcccggtagcgactcgcgcgatcacagcgattcggcgaattcctcgacccgggccaccacgtcgtcgagatacgacgcagaagtgcgccaccggccgggaacctctatcgaatgattggcctgcgggtactcatgcacgaggccactgagacgatgggcccggtcgctgcggtacagcgggtccgcggttcctgcgcagatcagcggttcgggagccgagccgggctcgtaatcgtcatcgcccggcacagggatgacggaccgtgtcggatcgaagtcggccggtgacagcacgggcgtcagcaaggccatcgggacgccgagccgggacacatgcgggtagatgaacgtcgacagcgatttcgccaccaccagggtgcgcggctgcgatgccggactcgaccggcgagggatgccatccagccagtcgtcgacagctccggacagcatcgagaatattctcggcgcgggggtcttcgacaggtccgcatcgacgtcgagccgttccacgaaccagccggcatcggccaacgccatcgcgcagtaatacagcagcggccgatcgcagttgtatccggtgcccggcatgatcagcgcatgccggtcggtcctatccgatgccatgcggttcttcggccattcgtttctgcggcaggtgggctgcgccgttccgctccccatcaacgatgaaatcatcgtcatgatcccccatatgatttttcgttattcgtgtgattgcatgctgtcggctggcatggctgcgccggccatgccaggtatgacaaaggcggccgacgcatgaaagcgcggaccgcctttgttgaggttcatctcagctcacaggctgctcccccggcccgatgatgcggaccggagcgggacgaatcaaaccttcgcggttcgattcactcctcttcgcccttgccgacctcgatgcgggcgaaggccacggccttgccgccgacttcctcgaacagcttgccgacggtcttggacggatccttgacgaacggctgctcaagcaggacgacttccttgtagaaggcgttgagacggccttcgacgatcttcggaacgatcttctcgggcttgccttcggccagggacttctcggtggcgacgcgacgctcggactcgacgacatcggccggaacgtcctcacggctgagccacttggcgcccatggcggaaatctgcagagcggcctcgtgagcgaccttggcaccggcttcgtcggtggcgatcatcgcgacgatgctcgggggcatctcgacggacttcttgtgcgcgtagatctcgacgtgcgggccggagatcttggcgaactggccgaccttgacgtgctcgccgaacagggcggccgcctcttcgacggcgaccttgacggtgccatcctcggcgttggacgccaggagctcgtcggcgttgttcgcgtcggcggccacggcgtagccgagcacggtgtcggcgaattcgacgaacttcggggtcttggccacgaagtcggtctcggaattgagctcgacggcgtaaccggtctggccttcggcggactcgatcaccttggaggcgatggtgccttcctgggccttgcggccttcacgcttgccagcggcctggatacccttggcgcggatgatctccttggcgcgggcgacatcaccctcggcctcggtgagagccttcttgacgtccatcatgccggcgccggtgtcttcgcgcacctgcttgatcaaagctgcagtgattgctgccattgatttgtctcctcgttaaaaatgtgtccccatagtgatgggaggctgttgcacctcccatactacaggaggtaggtcactcggccttggcttcctcggcctcggcggccggagcggcttcagcggaagcgccctcggtcagcagttccttctcccaagcggccatcggctgctcggcttcggtctcgccctcggccttggcggcccggccggaacgctccagcaggccatcggccactgcgtcggccatcaggctggtcagcagctcgatgccgcggatggcgtcatcgttggccggaatcgggtagtcgacggactccgggtcggtgttggtgtcgacgagggccacgaccgggatgcccagcttgtgggcttcctcgacggcgagcgattccttgttgatgtccacgacgaacatcgcggagggggtgcggaccatgttgcggataccgccaagctgcttctccagcttatccttctcgcgctccagcagcagcagttccttcttggtcagaccggagccgtgcacgtcggagaagtccatctcctcaagttccttcagacggctcacacgcttggagacggtctggaagttggtcagcatgccgccgagccaacgctcggacacgtagggcatgttcacgcgcgtggcctgggtctgcacggcttcctgggcctgcttcttggtgccgacgaacagcacggtgccgttgtgggcgacggtggccttgatgaagtcataggccttgtcgatcagctccagcgacttgaacaggttgatgatgtggatgccgttgcgctccatcaagatgtactgcttcatcttggggttccaacgacgggtctggtgaccgaagtggacgccggccttgagcatttcgctcatcgtgatctgtgccatagcactacctttcttgtcggttcttgcctggtcatgcgtacctgagtgcagccccgccgaagcgtggccgaccgacacaggccgtcgcggacatgacgcgatatggtgtgcaccggttgacgataacggttggccgtcgccacctgcgactgcggtgacggccgggttggcgcacaaatattcagaataccaccacgtgcctacttggcggcgtgctcacgcatgtaccgcaacgcctcgcggcgctccgtcttctccagccggtcgaggtacacgtgaccgtcgaggtgatcggtctcatgctgcagcatgcgacccatcaggccgctgccctccagcacgacctcgttgccgtccaggtcgatgccgcgcacgcgggcgtaatcggcacgacgggtcttgtaccacaggccgggaacggacaggcatccttcgtcaccgtactgttcgccgctcttctcctccagcaccgggttgagcacgtacccgatcttcccgttgatgttgtacgagaaggcgcgcagcccgacaccgatctggttcgccgagagcccggcacgacccggatcgtcgacggtgtccagcagatcctgcacaaggcggcgtacggagggcgtgatctccctgatcgtctcgcacggggtgcgcagcaccggatcgggaactgttctgatttcgcggatggccaattacttctcctcactggtgtcgttgctgtcggatgccgcgtcgcccacgctgtcctcctgctcggggctgccggattcggcttcgtcgtccttcatgaagcgaatcttccccttcgcctggtcgaaggcctgcttgacgctttccgaagactgcttcacggtctcggcggtcatgtcgaggatcttgacggtggcgggcagcggctttgcggcgttcttcggagcatagatcatgttgtcgatcacgtcggcgtaacgctgcagcactttcgggcggaccaccttcatgctgggtgtcagagtgccgtcctcctggttgaactcctcgtccagaataacgaacttgcgcaccgactcggcgcgggagacgttgccgttggccttgtcgatgtactgctgcaccaacgctcggaccgcgtcgttggtcgcgatctcgctcatcggcgcgtcgatgtcgaggttctgcgaggcaagccacgatcgggtcatctccgcgtcgagttcgatgagcgcggcgatgaacgggcgtccgtcgccgatgacgacggcatgggcgacgatcgggcatgtgttgatgacatcctccatcggcgccgggctgatgttcttgccgccggccgtgatgatgatgtccttcttgcggcccgtgatgaacacgaatccccgatcgtcgatcgtggcgaggtcacccgtgtgcagccagccatcggaggtcagggcctcggcggtccgctgaggctgcttgtagtagccaaggaacacgttcggccccttgatcatcagctcgtcgtcatccgcgagcctgatggagatgcagccgggccggccgacggagccgacctcgttcgcgtcctggaaattcaccaggcagggcgcggccgtctcggtcatgccatacccctggatgaaggtgatgccatcgaatccgttgaagaagtgcgcgagatcggcattgagcggggcgccgccgcaggcgagccacttcatgttggggcccagggcggaacggatcgacgagcccacggtctgcatgtagaagctgtgctggatgcgggcgcccagggaatgatggccgccggccatctcgtccttcgaccactgcacgaaatgatcgaacgccttggcgaacaggcgccccttgagaccggctccggccttctgcgaggcggcgttgtacaccttctcgaacacgcggggcacgcccagcagatacgtgggtttgaagccgcgcaggtcggcgagcagccgcttggcgctggggatatagccgaccacgccatgcgagccgatggccacgtactggatgtaccgcgcgaagcagtgcgccagcggaaggaacagcagcagacggctcggctggtacagcatgtcgttgagtacctcatagccgttgtagaccgtgtggttgaagttgcggtgagacagcatcacgcccttcggtttgccggtggagcccgacgtgtacacgatggtgaacaggtcgtcggcgcggacgcggccgatcgccttgtccagttcctcgtcgctgacggactcgccgaaatcggcgaccgcgtcgaggccgttcgccttgaagttgaacacgtagcgcaggctctcgctgtgcgcgcgaatctgctcaaggatctgcgcatgggagtcgtcgccggcgaaggcgatgaccggttcgacctctgcgacgatatcacccgtctgtttgggcgaatcggtctcgtatacggggacgctcaccgcgccgatggaggcgcaggcgaagtccacgacgccccactcatagcaggtggcggcgtatatcacgaccatgctgccgggcttgaccccgaggccgagaagccccttggccacctcacggacgcggtcgttcatctggccggcggacacgtcatgccactgcctcgtctcatcgtcctgccattgggcgatgaggtcatcggggtcgcgttcgcaacgcttggcgagcagtgaatagatggtgtccaagtctgtggtctgatagatcgtatcgacggtgtattcacgcaacataggctccactataagcatggccgcgtaccggcacgcggccatgcggaacatatcatccggcttgcgcggcgtgtatcacccgatgtccgtcatcgtgcacagccagcggcatcccatctggcgcagcacgatgttcgaccagtagttctgcacgccgatggtcagatgcgtcgatatctcgaacgtcgtcggattgatgaacatccccgacatcatccggggcaccaccggcagataccggagtttggccttcagctcaggattcgactgcatgtggttgtcgagcaggtacgccatggtctccagcttcttgagacacgggccggtcaccgcccgtctgagcttgcccgcatgcagctgtccgcgcatgatgtcggcggacatgcatgctatgcgggcggacgataccgccagcgaatggccctgtgcggcgttgatgcttcccgcgccgcagctggtgatgtgatacggcaccggaacgtcggacgattcgatgatgacgtacccgtcgaggctcggcaccgggcagggcgggttttcgcgcgcgtaatgataagtgggttgctccatgtccgtttctccgtcttctctctcgcccccatccacgatgaaaggggataatcccagcacaacacaacaaaggcacccccgcaatggacgagggtgcctttttgtgcaatcgtgccgcgattcgagcctccgacgcggaggcgaagcatcacggatcagacgtggtaggggttgacgaccaccgagcaacgctggaagctcttgacgtcgacatagcccgtggacgccatggctcggcgcagcgcgccgatgtagttcacctggccatcagcgcggtggctgggcccgaacaggatctgctccagcgagccgaccgtgccgacatcggtgcgggaaccgcgcggcagggtctggtgacgggcctccgcaccccaatgcttgccgccaccgggagcctcggtggcgcgggcgagcggagcgccgagcatgacggcgtcggcgcccatggcgagggccttgacgaagctgcccgaatcccccatgccgccatcggcgatgacctgcacatagcggccgccggactcgtccatgtaatcgcggcgggcctcagccacgtcggcgatcgcggtcgccatcggggcgtggacgccgatcgtcgtgcgcgtagcggtgaccgcaccgccgccgaagccgaccagcacgcccgccgcaccagtgcgcatcaggtgcagggccgccgtgtagttcgcggcgccgccgacgatgaccggaacatcgaggtcgtagatgaacttcttgaggttcagcggctcatggccgagggacacatgctcggcggacaccaccgtgccgcggatgacgaacaggtcgacgccggcttcgaccaccgtggagtagaactgctgggtgcgctgcggggaaagcgcgcccgccacggtgacgcccgcatcgcggatctcatgcaaccggcgggtgatgagctcgggcttcaccggctcacggtagatctcctggatccgctcggtcgcgacgtcatcgggcagctgggcaatctcgtcgagcagcggctgcggatcgtcataccgcgtccacagaccctccagatccagcacgccaagagcgcccagccggcccatcgctatcgccgtggcggggctggtgaccgaatccatcggggctccgatgaccggtacgtcgaactcataggcatccacctgccacgacgtcgacacgtcctgcgaatcgcgggtgcgacgagagggaacgatggagacatcatccagcgcgtaggccatgcgggccttcttgcccaaaccgatttcaatttcctgagacatggtttcaaggctaatgccgggctgtgacaccggacgcggccgcacacgcgcatcacccgccgtctcacattgtggcgaataccgagcggcggacaacgcgcggtaacatcgatgcgctaagactggtgcacatacgccaatcacgctaggaggaaacgcatggccaaaatcaaggtcgagggaaaggtcgtcgagctcgacggcgacgagatgacccgcgtcatctggaaggacatcaaggaccgtctgatcctgccctatctggacgtcgatctggactattacgacctgggcatcgagaaccgtgacgccaccgacgaccaagtcaccatcgacgcggcaaaggcaatccagcgcgagcacgtgggcgtcaagtgcgccaccatcactccggacgaggcccgcgtcaaggaattcggtctcaagaagatgtggaagtcccccaacggcacaatccgtaacatcctcggcggcacgatcttccgcgagcccatcgtgatgagcaacgtgcctcgtctggtgcccggctggaccaagccgatcgtcgtggcccgccacgccttcggcgaccagtacaaggccaccgacttcaaggtgccgggcgccggacgcctgaccgtcaccttcactcccgaggacggctccgagccgattgagcacgtggtctatgactacggccaggacggcggcgtggcccaggtgcagtacaacgtcaacgattcgatccgcggcttcgctcgcgcctgcttcaactatggcctgatgcgccactacccggtgtacctgtccaccaagaacacgattttgaaggcctacgacggccagttcaaggacatcttcgccgaagtgttcgagaccgactacaaggacaagttcgccgaggctggcctgacctacgagcaccgcctgatcgacgacatggtcgccagctccctcaagtggcacggcggctacatctgggcgtgcaagaactacgacggcgacgtgcagtccgactccgtggctcagggcttcggctcgctgggcctgatgacctccgtgctgatgaccccggacggccagaccgtcgaggccgaggccgcgcacggtaccgtgacccgccattaccgtcgctggctcaagggcgagaagacctccaccaacccgatcgcctcgatcttcgcgtggaccggcggactcaagcaccgcgccgacctggacggcacgcccgaggtccgccatttcgccgagacgctggagaaggtcatcgtcgacaccgtcgaaggcggtcagatgaccaaggatctggccatgctggtgggaccagatcaggcgtggctcgacaccgagggcttcatgaacgcgctggacgagaacctttccaaggcgctgaccgcgtgaccggccgggcggggttctccggcggctcccgccaccggtgatcgccgccggcaatccatcgccatcaaggcccgcatcccatgtccccacacgagatgcgggccttgtgcgtatggtgaggctacaatcgaaagtcacagtattcgcatgactgaaagggcgtgaccatgtcaggacgacgcatggtgtcttgtctgaaactcatcgccgccgcgatggcgacgggtcttctgctcacgacggcgggatgcgcgtcaacggacgataccaacactccggacggcggcaccgtcacgcaatccaccggggcggtggcgatattcaccccatcggacggcatcaccctctcccagcacacgccgttgaacaagtgggcgaaactggtgcccgacatcacctccgagctcaagaagcaaggattcaaatccgcgaacatcaccacgaccacatccagtgacctcgccaagcagagccaggacattcaggattacgtcgtcaatcatgcggtgtcggcgcaaagcgggaaagacagcgccaacaagaaagacggtgctgacgagaaggaaataacgctgatcgtcgcgcccgcagccgaaacgcagacatccacccggcaatacggcgattacgtcagccaaacgagcggcacggcgacggataggaccggttcagacgaggccggttcaacggatgcatcggaatcgactgacacatccgaatcggcgaatgcatccagctcggataacgcatccgactcgacggccacgcaatcgatgccccgtatggcgaacgcattgcagctggccaaggactcgggcatgcacgtggtgctcgtggccaatccggtgaaggacttcacccccgacgctttcgtcgaactgtcgacagccgaacgcatcgggcagatccaggcgagcaagcttgccgacaaactgcaactcgacaccatcagcaaggacaatccgaaggccgtggagatcctgctgccctacaccgcatccgctgacggcagtgacgacgaattcgccaaggaggccttcgcaggcgcctggtccgtgctgcagccgtatttcaagaagggcacggcatacagtccgtccggactgctgacggccgacacgaccgacgggcagtgggagtcggtcgccttcaaaatcgacaaggattcgcgcatcaccgacgagatcaccaatcgtctcaaacagaaggattcggcctcgcacacccgaatcgacggcatcatcgccatgaacgattacgtggcttccggagtggtcgacgcgctcgaccatctcggatacaccggttcggcggccgacatcaacccctccatcacactgcccggaatcgtcggcaacatcaccggaaagcaggatctccaccgcaagaaggtgccggatccgatcaaggcgccggaaaacgacggcgacgccgccaacgacgggtcggcctcggaaaaggccagggacacgcagtggcccatcatcaccggatatggcgcgtacgtcgacgaactgccgcaactcgtcagcggccatcaatggatgaccgccgtcgaggaccgcaagggcgccgcgacgcagctcgcgcagatgtgcctgaaaatcaatcagggcacggcggtgaaatcgccgcagaacctgaccaaggggacgtatccgggcgtcgcggggaagaacatgccgacgctgcgccccgacctggtcgcggtcagcgcgtcgaacctcaagagcacgctgatcgaccccggctacatcactctggccgacgcggggatgtgacagacgcagggattgcgcgtcacagggaatgtagcaggcgcggcaataccgggatgtacgcgagtcggccgtcaccccaaccatccgtcatgatgacgggaaccggttgaggtgacggccgactcgttgcccggctggacttcctctcagcggcccttcggggcgtaaatgcgcgtgtcgatgagttcgccgaagtggtcgatcaccgcttgacggcgtgccttcatgctggcggtcagcaatccgttctcctcggtgaacggctccggcacgatctcgaatttgcgaatcgactctgcccgcgacaccagatcgttggcagcgttgaccgcgcgctcgacctcggcatagacgatcgggttgcgcacggcttcggcgaggtcggagacctgctccacaccctgcgcggccagccaggcgttggtctcatcgagatccaaggagacgatcgccgcgatgaacggcttacggtcaccgatgacgacgcactggtccaccaccggcgatgtcatcacgctggcctccaatatgcccggagacacgttcttgccgcctgccgtgatgatcaggtccttcttgcgtccggtgatggtgacaaacccgtcgtcgtcgatgtcgccgaggtcccccgtgtgcaaccatccgtcaacgatctggctctgggtgatttcaggatggttatggtatccgacgcagaccgcacggctcttgatgcatagttcgccgtcctcgccgagccctaccgacaccccctgcagcggcaggccgaccgtgccgatgcgatatcccttggttggattcaccatggccggggcgcaggtctccgtcatgccatacccctcaagcagcggcagtccgacaccgttgaagaagtgtgcgacggccccgtccaggggagcgcctccggacaccgcatattcgcagtggccgccgaacacgcccatgatcgtgcgatagatcaggcggtcgtacatggcgtggcgcatccgcagcgaggccgagaacccgttgccctcctgctgcgcgtgcgaccattcgcgtgcggtggccgcagccttggcgaagatgcgccctttcatgccggcacccgccttctgcgaggcggcgttgtacaccttctcgaagatgcgcggcacggccagtatgaaggacggcttgaactcgccgaaatcagacagaatggtcttgaggttgttggacagccccagctccacgtcaccggcaaagcagtacagcaccatgtaccgcgcgaatgcgtgagccagcggaaggaacagcagtagacggcggtcacgcccataggcgatgtcgggcatggattgcgtaccggcataggtgacgtacacgaagttgccgtgtgacagttcaatgcccttcggcatgccggtggagcccgacgtgtacacgatggttgccaggtcgtcacccttcaccagacgctcgcgctcccagaactcctcgtcactcactccgcgcccgtattcctccagcgtgttcagcgcaccgaaatcgatgacgtacacgtctttcagcgtgctgcagcgcgagcggacggactcgatcttgtcacgctgcgcatcgttctcggcgaacgccatcgtcacctgggagtcgttgaagatcgtggcgatctgagccggcgagttggtctcgtagacgggcacggtgagggagccgatggacatgatggccatgtccagcgcagcccattgccatgaggtggaagagatgatcgacaccgcgtcccctggcatgacgccacgggcgatcaggcccttggccagtgcgatgaccttgtcgcggaattcggcggccgtgaacgagcgccatgagccggtaccgtccttgtacgagaccagcggctcgtcgggcttgcgttcagcgcgttcgaccagcactgagaacacgtttttatcgccgtcaatgggcttggtgaccggttgcgtatattccttgagcatttcagcgctcccctcgactgtgggccggtcgttccggcgaacgggtggcatctacatcgccaccgttcaattgtacggcttttccatacgaattcggggcagcatcgccgtcaatcgggtttcaggccgatgcgcatgggtctcacacgggcgagcggatcaagatatgtcgtcgccgtcccctcgttttgcagtcgaaccctcctgactccccaatggaggcatcggccgtcgcaatggtcggacgcccctcccacttcgccgatgacgtcgccgcgtctcacggctgttccggcaacgccctcggtatgcgccggctcgaacgtcgacacaaggtcaccgtggttgacactgacgaccgacttaccgccgacactcccggcgaacgatatgatgccatccgcaggggcatacagttcatcgccgtcggatgcctgcagatccacgccgcgatgcccggaaagccatggccggtcaggtgggtcgaaatccgcgatgacggccggctgacccacaggccaaagccataccgtccgacacgccgcctgtcgccctgcgcataacgtcaccgcggtgaagacctcttccccggcggatgcggagggcacccgcaatagcgcccagttcatcatcgcagcgaacatcacggcaacggacatgcagcacagccggatcatggtccgtttgcaacgctccatgcggcgaagcgcgaattgcctgcgccgtatggcatggcggtcataccgcacccgaggatggtgccatgctccccgctgcccatctaaatcatcattcagcatcagtctctcccccattccgtcgtcggtcgccggaacgtccccgcgccccggcatccccagcatcgcacaccgatgcacggcggagggcgaaaaacgaccgatgtggtcgaaggctcgggagttatccacatttcggcgtgtcgcgccgatactgcacggcacttgctgctggaatcgcctgacaatgcccgatgattcgcgggcgaaaccgtcgataaaccgataatttgcttgtgtctgcggcatccgactgtcagttctcgtcatcaatcaaccattggaattacaggcgacacgccgaggcgagcactcaagttgcatccatgtgatttgtgtgtaatatattcatcttgtgcacagcagttagctcagcacaggaaatcattcctgcgtagctcagttggcagagcatccgactgttaatcggacggtcgctggttcaagcccagccgcaggagctcattggaagccatcggcgtgttgccggtggctttttctgtatttatatccatgagcatctgatcggctttcttgtttccgagcatcatgcgcataatcgcatcgttagacagttcgtccaccgtagtgtcaagatattccgcagccaaaagaacctcttcaaatcgccagtttgcgcgagagatcttgagggacataccggaaggctttatcccgagatagcttgccatctcagtttgatttttgccttctctcgcttgtgcggccagaagctgctgaacgttgaaagaaacgacttttaacttgtatgcggctcgcgccttggggctgacgcccggcattgtttcaatactggtcatttttaacctttacaacaatatgtttacctgttgcaaaatatattacctctcgatttgcgtttagtgcaagtttgtcgtacactttttgcaggtcgtaaaaagtattacaaaaatggaggctggaggtgtgtacgccgatgaatgattggttcaaagaacgcggtatcggccaagagcaggtcgccgccactcttaacgtttccgtctcgaccgtttcacgcatcgtcaactacaaaagagacctcagcatgaggcgtgcgatgattctgcacactgagtatgggattccttttgacgttatgtatccatctcaattgagcgagggtgagggggtgtttgtccgataaggaaatgcccggtctcgatctggaacatcgaaaccgggcgtatgcaacacatccaatgttgaacgattccctagtcgccaaacttttgaatcgttcgcattgccttttagattatggaggctgcacaaatgtctagtgtaaccgaagtcgctgtgccgacttctgattttgatggtaacgcccccgtgaatggttcgcggtgcatggcgtctacattttccgaatccctgtattggcgacgttctgcccggcgctacgagctggcgggtcttgccgcttcgatgctggccgcgttgtcgtgcgtggtttttctggcgattctgcttgccgcgaggaatctgcttctgccgggattcgctttggtgccggtggcctgcggcctggcttgtgtgggttgctggtgcgaccgtaactcgcgtgatgcctgggatttcgctttctggtcccttcacgcggaggtgaggcaatgaccatgaccgttggcgcgcgttccctcgataacgaggagcgctcgaatttccgggactacatgtccctgttgtccctgtccgtggatgcgtcgatgaccgtgagggaggtcatggcggtcgcctatctgatcggccggcatgacgcgcttcgtgacgtgcggaacgcttcgtcgccggctcggacggtgaaccgtcgtctgatccatggcggtccgtcggattgcgtgttcaaccgcggctacgaggccggtgcgggcatggtgtccgacgagatcgacgcgttgatgcgcgacgtggaggccctcagcggcgatgacgcggcgttctcgatgctcaggcatccttcggtgagcgggggtgatgagtggtggaattggtgatcctgctgttcgtggtgctcgcggtggcctgtttcggcctgttgctgccgttcctgcgtctggccgtcggcatcgtgcttctcgtggtccgtctgctggcctccctcgcgcgatcaatgggggcgggccgatgatgcacctcatactcgtgatcgccgtcgttttcgttctcgccgcgtcctatctgctgacgttcgccctgtgccgcgcggccacgcgccgcgacatgcttgaggcccgttggcgtgaggagtcggccggttccgtgagtgaggagagccatgagagcgcatgaaacgcttgagcgtgccgggcgtcatggcggcttcccggcccgtggttccgcttcgggcctgttggcggcctgcccgtcggacggcagccacgacttctacctgtcgatgatgctcgacgttcccgtgccgcgcgtgcccatgctgcgcgcacgtctgcaagactcccgccgagggggtgccgcatgagcgtgaacgcggtcgattgggcgctcaggttcgcgcccgtggacgccaggcacaacggtgccgctcgcgtgctgatgtgtctggcgaacgtggccgacgacgaggggcgcaacgcgcatccgacgcacaggaagctggccgcgtggtgcaagtgcagcgtgagcacggtcaaacgccacctgtcatggctggaagcgaacgggctgatccgtcgcggcgaccaacgccaggccgggcatttcagcgagtggcaccggcccgtcgtgtgggacctgtgcctagggaaccgtctggagctcgaccccgacttcttcgactcgaacgacatcgactcgacccgaggcggacggccttccacggaaaacagggcgaagggaaaccccggctcacatgtggaccgtggttatgtcgacggggacacgggaaaaccccagctcacgggtgaaccacggttcacagctgtgaccccacccccagctcacctggtgagctacagtacgtccctagtacgtaataacccctctgcccctacggggcatctccccgcaagcggagagacctccccggacgatgacggaatccgcgaggacggttcatgggccgacgccgccggagccgaacccccaagcagcgaatcctccggggccggttccgacgcggaggcggtgtgccgcacgatggcggacgggctgcgcgccatgccgccgatgccggtgcccgaaccgttggcccggcccggcaaacgcgaactcgacgccgcccgacggctgatcgcccgccacggcatgccactggtgctggccgtggccgaatgggtgtcgctgccgccttccaagaccgacaagggcgacgcttccggcaaaccgtatgacggtttctggcgtcgcacgctcaccggcccccgctccctcgcacggcactgggaccaggtatgcctccagatggccgacgacccccacgggcgtcgcctgctcgccgaacacggcatcctcgccgacaagggcgaaacggcgcagccgccgagcgcggaatccacgccgaaggtgccgaactacgggatccccgacaacctggaccggcgcgtgttgaaactgctcgacccttacgacttcgatgcgggcaatgacgggttcgaggcaccgcgcaccctgcgccggctgttgaagcgcgtccccgcgaacgatgccgaaggcgaacgcaatgccgtgctggaggcattgcgggcgggccgcgccttcctggacgcggtatccagggagaaggacgacggcttcgggcagcggaagccgtccgggaccgggccggcgtccgtccgtttcggcttcatcggcggccgtgggccgaaggaggtgccggcatgttcctgaagggagaatgcgcggatttccccgactcgtggtcggaccgcatgtgggggcccgacgacctgcccaaccagcgaacccaatacgagctgcgccgcgcggcggtgcggatctgcgaggcctgcccggtcagggccgaatgcctcgcgttcggcatcatggtccgggaccagtacggcatctacggcggactgccgttgagggcccgacgccaggtgctgaagaccgcgcgggaggccggattccggttcgaccccgacgacccgaccgccgaacggcggctcgcccggtacatccgcgcgaaccccgagatcgtggcggcggcacgcgaacgcgaatgcaaacgccgcaagaccgagcagcgcaacgcacgccagcaacgatggcgcgccaccacacgctcgaccggcaaggcgaaggccccggccgccgccacacacaccccgcccttgcaggacaccctcttctgaagacaatccgatacagataaccggtccggccccataaggacgaaccattccggaaacccgtatacgcggcaaaccgtggaaccgtgcacccgtggacacgggaagccggaaacccgaatgaaaggaacaatcccaatgaccacgaacacgaaaacggtggccttcgtcaacctcaagggcggggtcggcaagaccaccagcgccatcggcaccgccgaagcactcgcccgactgggccataccgtgacggtgcgcgacgccgacccgtccggcgcggcgaccctgtgggcgcacaaggccctatcggccggccgcccactgcccttcggggtggaggtcgtcaaccggttcaccgtcgccgcgcccgccgaggaggaatgggtgctgatcgacacgcctcccttgcagaccgatctggtggaggcggcggtggacgcggccgacctcgtgctgctcgtcaccaccaccggccccatcgacctggaacgcatgctggagaccatccggcagatcaacaagccctcctcggtgctgctgacccagacccgctacggcacgcgcagcctcaggcacgccgaggagttcctggccgagaacggactggcccattgcagggagaccatcccgtacaaggaggccatgcgtctcgcgccggacgagggccggttcccgtccgcctcgggctacgggcttatcgccaaggaactcagcgacgcattcaacgcctgacacccgcagaaccggaaacccggaaacccgtgtccacgcaaacccgtggacacggggacacggaaaggaacaacatcatggagatcaacaagccgatgaccacgaggaacatgctggcatcgaccctcaccgactacaagaaaccggtcaagctgcccaagatcacggtggagctcgaccccatgctcaagaaacggttcaaggccgaggccgtgcgacgcggcaccaccatccgcgacatgctcacggcatggatcgaacgcgactgccctcccctcgacgcggcggacgcaagggccgaggcgaagcaagacggaagaaggagtggatgatgacggatgacatcgaggagcgggccgcactggcccgtcgcgggatcatggaccattcggattgcgaggagtgcacggaggactggacgttcctgatgcgtcagggacgacgggagttcccgttgggattacgcacggtgctcgcgtgcctcgcgttcgccgaacgcgagggcgcggtgcccgagctgccggcggattggtgggttagaatcaacaggaggtatcgatgacgacgatgcgcggcgaggggagccgactatggatgcgttcaaggcatggccgggaagggcggaaagcatcgtgatcagccaggagtcatacatgaggtgcaccggcggcgtggccccgtggcgtcgtgacggcgacaaggggccgtcctactacgcggtgtgcccgctgtgcgacaatcccatccagatcgtcggcctgttccgccggcaggaggaaagccgtgcgcgccggccctacgggcgacaccaccggggcgacgtgccgggcctgtgccgctacgacgaggacgcctatctgcactgcccgtatgcggatccgaaccatcggacggacacccgagcgagacgtcatccgaaggaccagaccgggcgggccctgtatggtctcatgcgcggcgagttcgaccgggtgacgctggcgtgggaacggttctccggcatccatctggggccgggggccgcccgtgacatgcttcgcaaatggcgggacgaccagggatggcgctactacgacgcgacctacggcaatctgccgcagatgctgttcttcgcggccggcggacagaacctggtcaaacgctacatcgtgccggacagcccgttgcacgaacggctgaaaggcgtgccgcgggtgagattcacgccgacgcgctcccggtacgtgcaggtggacaaggccgggccggggttccttactctggatttcctgctgtacgcccggcgcatcgaatgggacggacagcacatgaacgagacgttcaggctgcgcggcctgctgggccgcgatgacgggcaacaggccttcgatgacctgaccctcgacgtcgatcaggactggctcccccacacagcggacgcccaacccggccgcgacgagcggctactcgacatcgcgcgggaaacgctgcaatccgacgcgggtatcccggcagatcaataaagcgttatcaatgcaaggagaacaatgatgaacgagaacgacaagacggaaatcctcgaacccgtcgaaacacccgccgagaacatcacagagccaagcaaggatggaaggaagtgtccgaagtggctgccgcccctggtcgcggccgtctgcgcggtgattctggtcgcggccggcatcatcggctggaacgcttacagcggcgcgaagctcgccgaggccaaggaggcgtgcgccaccgccgccgacaccgtgcgcaacaatgccaacgaatacaacgcgctgctcaacggcgatgccgccgctgccgccgccgtcaaggccgaacaggtcaaggactcgaagaccgtcgaatccttgggcaaggagctcacggccatggcacccgaatacgagggctgcgtggccgaaaacgcgcaaggactggatgccgccaccgtgaagctcaatgaacaggccgactggtacgagacccacgagaagagcctgtcgaaggcggtgagggccgtcgccgaatccaaggccgcgaagaggctggatgacgcgaaaacgaatctgacggcgaagctggacgaggcgtcgaagctgcttgcggattcggacggcaaggtcgcggacaacgccacccgcgacgcattgtcgaacgccatcgacgcggcgaacgggctgaaggacgggaacgatccggcgaagatcgacggagcgcgcaaaacgctggaggatgccatcaacggcgtgaacgcgagcgtccaggcaaagacggacgcggatgcgcaagccgccgcagcggccgcagcggcagcccaggctcaggcgcaggcccaatccacctacagcggcgtctcctcctactccggaggcgcgtacaggcgcacggaaggctccacttccggctccaacacataccgtggcaccacatcgggcggctccggcccggccgccgcctccgccccaaagccgaacctcaacggcgcttacggctgcggcaacagctgcaccggcaaggatgatggctattaccatcactgatcgatggatgactgattatggctcgtatcgggaaaccggtacgggcctttttcatggatttcgcaaaggaaagccatgtccctgtgaacctgtgtcccccgcattcccgtgtacccgtattgccgggaaatacttccggattttttgtagacgccatgctccgtggttcggcgtgtcgtctgtgaggcttgttggtggctgccgggccaaccggtggctacctcccgttattcctgcggtcggaagccccgccaccctttgaaaaaagaggcggcggggccatgaccggaacgattgagggaggggatgaacagacaaggttaacggaggttcatttacatgaactttggcaggaagatgatgaaggccggtgtcgcggcggtggctgcgatcgccacgcttggcgccggcggcgtcgtcgcatcgaccgcgttcgcgggcggtggcggcggcaaccagcccggcacgggcggcgacctggccgcggtgcagttctggcaatacaaggacgatgcttcgggcgcatggggtccggccacgagtcttgattcggtgcgcgccgccatgaacaatgccggcgtgacgttggagggcgatggcgtcacgaaggcgcaggccgcattggaccaagcccgtacggaatgcgagaccggtttccagcggcgtcaccccggcgagggcaacggcgactgccgagtggtcgcggtcggcgcggtgccagccgtcttcggcggcaactacatctacaacgggtccggcgtggcttcgccgaccgggaccggcggctggtacgacaactggaacacctacgtagctccaggaacataccagtatggcagcaccgtatataggacctcatatccgttcgatgatgatccgtcgaacagcgtggatgcgattatgcgtcgtaatgtggaggcttccagcaagccctcgatcgtggtgatcgtgctggacaagtaccagccggcaccaccgaactatcacttgagcgtgagcacgcaggctgcggagatgtcgggccagtcgggcgacaccaaggacgcctcggatgtgatcaccctgtccagcgacgggtcgaagaccgagaacgtgaacggcaccgcgaccctgcactggcgtggcatcgacggcaccgagaagacggtggcgaagcggttcaccgcatccaacaagggcagcgccacagtgagcgcgtccttcaaggacatggacgcctcgtgggagtcgtggcctgcgggcaagcgctggtgggacgttgacgtggcgaagcagggcaacatggccgaggcggtctcccacaagggagagcacgacggcaaggagtccggcgagaagaccaccaccccgcccgagaaatggctgaccaacgaggccggcgacacgctgacgcaccgtcatgacgtgcccgtgccgtcccatgacgtgccgtcccatgacgacaacgactacatcgacaactacatcgcctccggcagcctgtacacggctcacatcaaggcgcattccaacgcctccagcaagttctggatctatgacttcatcgtcacgaaggacgtggtgatcggcggcaccgacaaggacgacgtgagcaaggtcaacgtgaccgacgcgaacggcaacatcgtgccggcggacatttccatcgacgattccatcgatggcaagcgcgtggtcaaggcgcacgccaccgccccgcattccggcctctacacgctgaacgtgccacagtcggccaaacccaccggcggcgactacgagatcaacgacggttccgtggcgtgctggaacggagacaacggcaccggcagcctggccgactgccagaccggcaacagcgacagcgtgggcaaggtcacgccgaccccggacaaggtgtgggtgctggacgagtccggcgctctcgtggccgaggacaagcaatggaccaaccagcagggcgtcgatcagaagacgttcctcgtgggcgaccaggtgggcgtggtcgtcaacggcagcatccccgcgcacctgctcaacccgctggcatcctattccatcaccgatgatctgaccggttcgaaccagtggatcgactggaagtccggcaaggtgttcgtcgacggcaaggacgagaccgcgaacttcaccatcgcgatcgaccggaaggccgggaccgcgaccgccaccgcgaagtccgcctacatcgcgaagacgatgttcaggaacagcgcgagcaaggtcaggttctacctgacgggcaccatcaaaaagggtgccaccgagggcaagaagatccagctgaccaacaaggcgtacgagaagtggaacaacgagacccgaccgaccaacgagccgccggtgttcgtgtggacgcccaaccccaacaaggcgtgggccatgaaggtcggcggcaagtggcagctgaccgtcgatccgaccaagaccgacaaggtgggcggcgacgacaagtactaccgtctcggcgacgaggtggcggcggtcatctccggcaccctgcccacaggattgggccgcgtgcccgagatcgcgtggaccgacgacttcgccaacgtcgatagcatcctcgacctgaaggacacctccaacatcaaggtctacgagcaggacaccaccgacgaggccaacgccagcgtcaacgacctgaacaagaccggcagggacgtgaccgaccagttcgacatcaccgccgagggcaccaaggtcacggtcagcgcgaaggactcctacgaggccgcgcagaaggacctgaagaccgcgaagcagatcagcgtcgtgatccccttcgacgtgaacttcgacaccgtgaagctgctcgaatcctacggcaaggcggagggcgacgagctcaacacgtgcgcggacccgaagggcgacgacctcgacaacaagggcggccagacggtcggcggcagcacggtggacaccaacacgccgaagatctgcgtgaccgtgcccccgatccacaagcaggtcatcgccgaatcctcccagggcggcgaccagtccagcatcgacaccaagaccgtgttccccggccagaccgtggaatacaccgtgcgcgtggacccgcagatccccgcggaccaggcatattcggtgaccgccatcaagctgagcgacacctattccgagtacaccaccgcgaacaagcaaaccctggagatcaccgacctgggaaccggcggcatcatcccgaagagcgcctacaaggtgcagtgggacgaagccaaccactcgttcgaggccacgttcaccaaggactgggttgccgccaactggaaggccggctccaacccgcgcgtgctgctgcgcttcgaggccaaggtgaacgaggacgcgcccaccgacaagaccgtcgacaacaaggccgcgctgaccgtcaacaacggcgtcaccccgtccaacaaggtcgagaacgagccgccggtcatcaagccctccaagcaggacacgcagaaggacccgaccatcaacatcgacggcaagaccgcgctgctgggcgacaaggtgtactaccgcgtcaacatcgacgcctccaggctcaccgacaccgcctacaaggtatggcgactgggcatggtggacgactacgacgaggagtacctgaccctcgacgcgaagcacgtggagatccttgacgagaccggcagggaccgcaccggcgagttcaacatccaggacaaggacggcgtgctctacacgttcgccaggaccgttgacaccatgatccccgcgaccggcgagaccgttcccggcgacccgcagcccgacgacctgaaggcgtacagcgagaaaaccgacaaggattacgacccgctgaaggacccgagcatcgaccagtcgctgctgggccacacctaccaggtggtcatgccgatgaccgtcaccaaggtcaaggacggccacacggtggagaacaccgccacgcaggtcacgaacgacaggcgcgacaagaccaacaccgtcaccaacccgctgaaggagatcaacccgaccaaggacgtgaccgtgcaggtcggcggcgacagcatcgacggcaagagcgtgtatctgaaccacacgttcctctaccgcctggattccagcatcctgcccccggaccgcgcctaccagaccgtcacggactggggcggcacggaccagctgaacaccgagtacgaccagtacctgggcaactgggccgtctacgccagccgcgacctgtacagggacggccagatgctcgcggccaagggcgagaagatcgcgggcagcggcttcgactcctcgaagttcggcggcaacctgttcaccgtggacgccgacgagaacggcaaggtcacggccgacgcgacccagacctacctcgacctcgtgagcgccgacaacgagcacgaggccggctgggtgctctacctccagtgcaagcgcatcgccgtggccgacgaggtgcccaacacgtggaccgagaccatcaacggccagccgcgcgaatccaacaaggtcgtcaccaagaccccggacatgaccccgagcatccacctcgaaaaggtcgataccccgaccctcaagcaggaaggccaggagcaggcggaccgcgacgactccaagcaggcgctgaagatggacgccgacaacatcggcatcacgttcatcatcaccaacacctccaagaccgacccggccaccggtgacggcgcatggttcaaggcaagcgacctgaacctcgacgactccaccatcgtcggcgacgcgcacgtggacatggattcgctcacctatcccgccgactgggacaccctggtgctcaagccgggcgaatcggtcagcgtgaccggcacgctcaagggcgtcaaggaaggcgagacccacacggatcgcgccatcgtcaccggaaccccgctcgtggaatgcgcgccgtccaacggcgacccgttcaacgacaagaccgacggcggcgaagacaccgatccggaatactccaccggcgacgtgaccgagatcgacggcaagcagctgtgcgccgacacccagaccgccagcaacaccgacgactggaacggctaccgtgccaagccgttggcctccaccggcacggccgtgctcggccttgccggcggcgctctggcggtgctactcgcgggcggctccctgctcgtgttccgcaagcgccactacgcacagggttccggccgccacacggccgtgaacgcgggcaagtgaccccgtggcgttccggcctcgtcgtccgatgacggccgggacgccctccattgacttcacatgccggaaaggggcataaagctttccgaatcccgtgcccccggacggcgtgtgaaccccaggcccttcgccagcctctcccccggcgaagggccttttccatgcccggaacccgtgaacccgtggaaccgtggagccgcagacccgtggaaccgtgctcccgatggggcctgtagacggtgcgccccgcagcggcccgcgacccggcgcatcatcgactctgacattgttcgcaccatcatcattcctctggaggttgcacatggctgacaggcaaaccgcattggccgtattcgattttctcgactcgctgcgcgccggacaataccgcatcggcgcggacgcggaaaaggaccatgccacggcgggactgctggcgtcgctgtccggcgacacggggctgcgcgacgccgtgtgcgcgaagctgatatcgccgggcctggagcgcgcccgtttcctcatggtcgccgagcatgatccgcgcgccttgcccctgttcgcctcgggccaggtcaaaccgtggtaccaggccgactacaacgtgcgcgagatagccaacagcgagttccaccaggatatacccgcactgctgtggcggctgtccaacagcatcccggattccgcgcgaagggagggcatgcttgaggcggccgcgtacatgagcttcatgcagggcgatcccgaggccgcgttcaccggccatctgggccggctcgcggcggtttcgcccgagggcgaggtcacgcgctgcctcatggacgcgcacgagcacggccagcatcccgcatgggtcatggaacggcggcagctgcgcgaacggcaggccgacgccgccgacggcatggccgccaccgcgccggaccgcccgagcctccgccagcgcctcttcccgaaccgatgaacacctccagcacggacccatgggagatgggccccataatcgccgccggcaccgccgtcgccatcgacacggcacgagaaccggaaccggaacgccggccaccggccgaacccgaacccgagcccgggcccgggctggagccggatgcgcgatgcgtggacgacgccggaagcgaagaccgggcgaacacggccgtcgatccgtgggagatcggcccgctgccatcggcctcgaatccggtggggaatgatatcccggccgatgccccggcatcggaaccgcagcacgttgtcggtgccgtggagccggccgatctcgccgacacgatcgacctcacgccggtcggcgaccgggatgccgccatgcccgtgcgcgaatggaggcgcatagccacgaccgcgggcggcatcctgctcgcggcctgcgtcacggtcgccggcatgtccgcgtggagatcgcatgaatccgccacggccgcacgcgagctggaacaggcgacggcggactgcgccaccgcccacgctgcggcgaagaaagccgaacagaagctggtcgaatatctcgacggcgaccggctcgcacaggcgaaagcggtcacggccgacaagctcgccgacccggaaaccctggaaaccctcgacaagctggccgaacaatattccgagggcgagcgaatccccgcatgtgccgccacggacacggaaacggccaacgccaccacatccaagctgcaagccatcgaaaagaagcacacgggaaatctctcgcggctgaagaaggcggcgggcgcggtgttctcctcacggctggcccataccgtcgaacagggcgaacgattgtattcctcctccgaaggcaaggtgcaggacgaatattctcgcgccctgctgcgcgcctccatcgacaagcgcgacgagaaggccatcaccgacgccatggacaaggtgaacgcctccatcgacgcgaagaccaaggccgacgaggaaaggaaagcgcaggaggaggccgcagcggctgcggcggcgcaggaggaggccgcagcggctgcggcggcgcaggcgcagagcacgccggcaccgcaacagtactcgtacacgccctccggctccgcttcgggctcgggttccggcccgtccggcggcggataccattcctccggcggttccgccggctcgaccggtggttccgcgtctccgggctggtcggtgcccgcgaacccggacccctcgcaactgcccggcaccgacccgagcctatgaaaggaccaacaccatgccacaactgaccacgttgatcccgtcgttcgcggcacccgtcaccgaccgcgtgtggctggtgggcgcgcacggcggtgccggatgcaccacgatccgccattcggatccggaacgtttcgccgacgccggccgcgcgctgccggtgagccaggatccctccatgccctcgcgcatcatcctgtgcgccatgggcacggggcgcggcctcgaatcgttgcgcgcgctgctcgccgaccagtcggccggactgttcggcgcatcgatcctgttgggcgcggccatcaccgaccccgtgccccgtatgccccggcctttggtggcggcgcgcatccaactgtcatccgccgtccgcgtgtggcggctgccccatatcaaagggcttgaactcgacgggtttccccggcgttatccggccgcgtactcacggctcgtgaaggacgtagacgccatgccccgcgccacggcccatgtcggctgacgatggtgcatgaacctaacacgaaaggaacaacccaatgctgcatgaaacatacgcgatcctcgccgagaccctttccgacccgaccccgtgcctgcctccgggattctcgggcccggtatccaccgccctgggctgggtgaaggcgctgagcctggtgatcggcgtggtcgcgctggtgcgcatcggcgtgcacatcctgcgccagcagggcgacggcgtgccagaccgcgacgacaccttcgacaagctcgtcaactgggtgatcggcatcttcctcggtgcgggcgctgtcgccatcctcgccgcactcggcctgtccgtcaccgcaagctgctgagaaaaagccatgaaagggattcgacgcatacggcagcgcctgtgcgcgctgccgctcgccctcgcctgccttgccggcctcgccgcctgcggcggacccgacttcggatcgttcagcaaggagctcacgttcggcgacaagcagatcagcgacacccagaccacctacgtgatgaagatacccgaaggcaagctcggcgacctgatcggccccagccagatccaatgggtcatcgaccagtacggcgacccgcccgcccataccggcgcggtcgcggtcggcaccaagaaggcggcgaaggatctgctgaggaagtctccggaactgcaatgcagggcattggagaacacgtatcaggaggagtcgtccgacgagggcaaatgggagtacaaggactcctcgtgccggaagcagcgcaagctctcctggctggagaagaccctgtggaacatgtaccaggtccaatcggattccacgatcgaatggctgtccaccagccgcaacacgctggtcgccgcgaacgacacggtatcaacgttgcaggcgaacgccacgccgaactacgattcatggttcgcaccggtgaaccggtacctgcgcatcgcgcagggcgtgctcgtcgcagccgccgcgatcagcctgatcgtgctgagcgcgcgcatcgtgtggaacatcggccagggcggcgagggccgtctgctcgaccgcatcggctggatactgctcggcgtgctgctcggctcctcgtgcgcgagcatcgcgctcacgttcttctcccgctcgtccggcggcaatccggacctgccgtcatggacgccgggcggcggcaccacgttcttcctgtcggactacatccgtatgcaggttgacccgttccttatcatcgcggccgtgtgcggcgtgatcgcggccggctggaagctcgtcacccaacaggagggacgtgacctgatccccttgggcaaggcgttcatgtgggcgatcctgagcgccgtgtgccttgccggactggtcaacacgttccaggccacattcgacacgtggaccgccgacgtgctcaggtccgcaagcggcatgatgaacgacgcctgggaatcgaaaagcctggccgcgagctcgttcttcaatctcggcgcgcccgtcgccatcgtgctcaccatcgtgatgtggatctgcgggctgatcagcaagatattcgcctacttccgcgccgggatgctgccgatcctggtgggcgtggcacccatgtgggccgccatgagctggatggagaccggcaagcaggctttcgccaagaccatcggctggctggccgcgttcctggcctacaagcccgtcgccgcactggtcatggcgaccggctcggcgatcatggccacggccgggcccggcgacgacagccaggccatcacgctgatgctcaccctgagcgtcatcatcctccttcccgccatgatccgcgtgatcgtgcccgccgtgcaatcctcggtcggcggtggcggcggcggaatcctgccctccatactcggcatgggagtcgccgtggccggcggcggcctgcgcaaggccatgggcggcaagggcggcaggaaaggcggcggcgacggacgcggcgaagcgtcaccggacggtgccaaacccggtgccggccgaggtttggccggactgctttccggactcggccggggcgacggcaaaccacagggaacgaacggcggcggcaagcacgccaaaccgctggaaggcaatcccacgggcggcgaaccacagaacaccggcgaccagccacagggagcgaaccgcaagggcagcgacggcaaaccgcagggaacgaacggcaatggcacgggaagcccggttccaccggcacccgatggcgcgccacccgacccgtcaggcggcaacaggccgcagggaacgaacgatgccggcgggttcgcccgcgagggcgcaccggacggtgccgaccgctcgaccactcgcaagggcaagacattctgacgcattaaggagattcggataatcatggcgtcgaacacgacatacggggattggatgcggccgatgccgggaggcatccgcaacatcggcataccgttgacgatagcgggcatgggcgtattgacctgcacgctgctggtcagcatggcgagcgtggtcgcggccatcgcgatcctcgtggtcggcatgggcgtcatcctcgtgctggccatccgcgaccgcgagcaccgcaacatggtggatcgcaccgtggagaaacgcacgtggatggccgcgcagcgtaccggcgctaacctgtatcgttccggcctgctcgcgccgatcgacggcggcaaggccatgctgccgggcatcctctcacgggtgggcctgacctccgccctggacgggctgggcggcgagttctgcctagtgcggcattcgcacaccggcgaatactcgctgctcctgtcatgccagccgcagggcgcgagcctcgccgacgacgacgtggaggactcgtacgtggcctcgtgggccgggctcatggaatcgctcgcctccgagaccggcgtcacccaactggccgtgaccgtggacacggcacccgattccggcgtgcgtttccgccgcacgctgagcaaacgcatcgtggaggacgctcccgagctcgcggcgcgcgccatggcgcagatcatggaccagtacgcagccggcggcgcttccaacgacgtgacgctcaccttgactttccgctacaccgaccgtgacggcaaatacctggaggccggggaggccgcgcgtcgcataagcctgctgctgccctcgatccgcgagcagatagcgcaggcgggaggcggtgccgcgagggccctgggcatggaggagatcactcgcatggtccgcgtcgcctacgatccggccgcgcaggagaccatcgaggaatccgacgagcccccgtacatcgcatgggaggattgcgggccgctcatgcacgaggccggctggagccattattcgcacgattccgggctgagccgcacatgggagatggtggacccgccgcaaagcaacgtgaccgccgacacgctcacccgactgctcagcccattggcggactgcgaccgcaagcgcgtcaccgtgctctaccggatgctgccgcccgacaagaccatgttcatggccgaacagaaccggcagaaggcagccaaccaggtcagccaggagaaacgcgccacggtgaggtccatgagccagataggcaaggccaaccgccaggccgtcgaaacgaaccagggtgcggtcatggtgttcttcgggatgctcgtcaccgtcaccgtgtccaggggcgaacaggaaagccaacgactcgaagccgcgtcacgcgccgtggaacaggccgcaggcggcgcgaagatcgacctgcgcccctgctacggggcacaggacacgggattcgccgcaagcctgccccttggattgaacgtcagatcatacactccagccggccccctcggccggctcctgtcctgaacggaggacacatgatgccgatgccatggaagccgtcgaaacggaagggaaccatgccaagcgccacggccacggaccccgtggcacgcatggaatccatgctgctcggtccgttgaaggccaaaccggacgagcccgtgcccccgatgccgtggcgggggaaacgctcgcgtggaggcggctatgcggccctgatgcccacgatagacgagttcttcggcacgtcgaaccaggtgtgcggcgggttctggccgttcggcaccgacatggccctgccggccgagggggtgccggtcgggcgaagcctgatgacgggtgccggcgtgtgctgcgacccgatcagctggttcaaggccggcatcatcaaacagccctctatgttcctgctcggcctgccggccatcggcaagagcacgttcgtgcgccgcgaggtgctgggactgagcgccctgggcatgaacgcgatcatccccggcgatctgaagcccgactacgcctcactggtcaacatgctcggcggccaggtcatccggctgggagcgggcatcggcgtggtcaaccccctggaccccggcgacctccattatgcgctgcaacgcttggagggcaaggcgcgcaaggacctgacggactactacaacgacacgagggcggcgctcatggaggtgcttttgacgatcatgcgcaccggccgcgaggccgacgacgtgggcggtgccaggggcgtgaccgcacgcgaatccgatatcctttccgtggccgtgcgcgtgctccacgaccggcacggcgacgacccgcagcctcccgtcatcgcggacctgcgagacctgctgcgcgaagggcccgacgaggtgcgtatggcggcggtctgggacgacccggaaaacgacgagctctacagggcgcaggttcgcggccttctggccgacctgcacggattctcgaaccgcatgacgaagttcggccgtctgttcggcgaccagaccaccgcgcgcatcgacctgtccaggcccgtggacttcgatatcagcgccctggcccagtcgggcgacgatgtggtcgccgccgtgctggcgaccacatggacgagcgcgttcgccgcgaagaacgccgccgacgtgctcgccgaggagggattacagccccggcgcaaccacgtgatcatcatggacgagatgcaccgcgctttgcgcgccagtcccctcatggtcgaaaagctcgacctgctcacccgtctgaacaggcagtggggcgtaggccagatcatgatcacacacacgttcaaggacctgatgtgcatggagaccccggcgcagaacaccaaggcgcgcggcttcgtggaacgcagcgagatcaaggtgctgggcgctttgagccgcatcgaggtggaccgctacctgcgcggcgaatgcggactgcccgtatcccggcgcgaggaggacatgctggaggattgggccacgcccgtcaacttcggctccgacgcctcgcacaagggtctgggccgtttcctgatcaaactgggaggactgcccggaatccccatcaacgtggagatgtgcccgctcgaaaaaagcgggttcaacgatacgaacctcaaatggcacgcctagaagggaaccctgcgatgacagaccacctcgccaccggcatgaaacgcatgatccgcaccgtggcacgctccgcatccctctccgaccggctcggcgagcaatcccggctgctgcggctgacgggcaaccgcagcactctcgacttccgccccgccgagcacggcgcatcctcatgggacttcgaaatgtcgataacccccaccgagcccaagccgtacggcaatgcggaaacccgtgaacccgtatggcgtgagacggtcgattccgccacctatggcgaatcgagggcgcgggtcgcacacgccgtcgaaacgttcagaatatacgacaacaccggcatcctgccggaaacggaaaaccggtgaaaggaccacgatgaacgacgccgcactgctcgactcgctgcacgccgcgctgcgcaatcccgacctcgcatggtacacggaattccatgccggcgaatccatcgtcgccggctacctcgattccctgacggacccgtatgacgacgatgccatacaggttcccgagggctggttccgctactcggtcgtcacccgtgaaggcgaccacgcccttccatggatggagcactggaacgaatacgagtattcgatcacccatcacatcgattggaacggcaaagggttcacgccatacgacctgtactgcacacaggacctcaccggcatgatcgccgacggctcgctggcctcgatccgggaggacgcgcgaaccatattcaaggaccggcccctgacggacgactaccttttcgccaactccatctggcccgaaccggaactcctcggcctcgtggacgacctgaccggccgcacgggacgaaacctgtaagaaccctgtagacgccatgccccaccccgccatggccttggactgatgatcggggtcatggcgggaacagcgggttgccgccgaggattgtcaaggagccgaacatgcctttggagaacaccgatgccgaagagcggatcacacgggaaacgatgatcggatggatcgagcattggggcgaatcgtatgacgacgtgcgacccgatgacggtgccatgcggctggcgaaccgcatcatcgaatacaacgcggcgactgaaaccatcgaggcgttgcggaaccccgatgccgtgtacgacgaactggcatccatcctccagccggtgctctcctcgatggacggcacctatttcgcgggctccgaatggttcgccggcgaagtggaccgcatggaagcggaccgcatcaacggggagcagccggaagaaacggacggcctggcctccgaagaaccccgcatcccgttcatcgtggagagcgaggccacagccgccgatacggacgaaccgccgttggacgagctgatcaccgcagccacacacgaatatctggactcaggcatgacctacgacggattctcggaacatgtgcgcaccacctggcgcaacgccgccgcctacgactggtcgaagctcatggccgaaccacgctccacgggcgaatggtcgtccgacgcgaaccggctcgccgtattgggcgtgatgatgcagttcgcgcccgaatcaacatgcatgatgatcgccagcgacatactggccgagaacgctcccctatcccttccggcattgcgcgaacgcatcaatacgccggacggcatggtgaacaccgacctgctgttttcccggctgatcgacaacggcaccacgcccgatccggcgcgcatcgacatggcgatggggatcctcggcccgttggaggccaacgcgccgacggacgcctgctaccggatcatcggcctgaaggccatgctcagcctcgccatgggcgacggtgagaaggcgcgggaactcgccgaacaggccatcggctacgacgcctcggaccggttcgcgtcaagcgtgctcgaccgtctgccggaaaccgatcccgccatggaggtgacgaacgtgtgggagaacggcgggcatttggggcgctgacgtagacgccgtaccccgcgatgccaccggtccggccggatgatgggagtcgccgccgccattgaaggcgctggtattccccgaatgaaaggaccatcatcatgccacagtcaatgcaagtggttcgcggtctcctcgccgcgaaccccgattactggccggcgaaaaccaacgcggacggcaccacgagctcggcgtacctgcgcgccaccgtgtatgaggaccgcccgcgagtccgtcagaaggacggcagctatacggacaatccgctcggcccggtgagaaccaccgtgaaattctggggccaggctgccgagctcctgcacggcatggatttccgccagggtgacgccgtggtggcgaccggccgcatgggcgatcccgacgccttcatcagccagaaggacggtaaggcatacgcacgcccggtcgtgatcggcgattccatgcagatcgattccatcgtgtcccagcgcatccagctcgcccgcgaacgcaaacgccagaacaaggaacaggccggtgccgtggccgatgccgggcgaacggatccatggacggaccaggttgacgcctcgcgcggcgaatacgttggcgacggcgttccccgcactttcaacggcgagcccttcgaaccgctgtcgggctatccgacaccgggcgcggctcccgctccggcggaccctgcggcaccggatttcctttccaccccatccgatttcacgacgggcaacgcccgctagccatgacgcaagccctggcgcatcgacggcgggaccgcttccatcggttccgccgtcatgcttgaaaggagaaatgaatcttggccgacgtcgatccgaaactgcaatcgaaccgagtgaaggatctgggcggcacggtccgtcccagccgcaagatcgaactggcgatcatcgtcgcggtgtccctgatcctcacgacgttcgccctcgtgtgctcccatgcggggcatcccttccagatcttcgcgctcatgtacctggtctccggccaatggtcgctgaccgcaggccagtgggcgctggccgtggccgtgctcgtcgtactggccgtggcgtgcggcgtgggcgcgtggctgatcgccagcaaggccgtgccgtgggcaaccggcgccaaggcacgcacccgcgtggacgtgtacgcgcctgccatgggccatggcgaggccgtggagaaggtgacgcgccagcgcgccgaggccatggcgtcaaggctcatagaagcggaccgctaccgcaagggcatgtcgccgggatatccgctggggctcaacatcgtggacaacacgtcgatgtacaccagctgggaggacatggctatcgttctggcgggcccgcgttccggcaaatccctgtgctacgcgatcccggccgtgctctcggcaccgggcccgtgcctggcgacctcgaacaagggcgatatcctcgacgtgaccgccccgatccgcaggctcgaccatccgaacggcgaaatatggacgttcgaccccgaacgcatcgcggacccgaaccggaagagcgcgccgtgggtgtgggacctgatcgcctcggtgcagtccatcgccgacgcgaaacgcatcgccgactgctggcgttacgcctcgggccagccgcagaccggcggcgacgacttcttccccggcaccgccgcccagcagctcgccgactacctgttcgccgcgcatctgggaggccgttccgtgtccgacgtgttcaggtggtgctccaacgagcgcgacacgtcgccggccgacatcctgagcgaatacccgcgctacgcgggcatcgcctcgcgcgtgtccagcgtgatcgcgctgacgccggaaacccgaagcggcgtgttcggcagccttcagaccatggtcgcgttcctcgcggaccccgagatcatcgactggatcgacccgcaccgggatacgaatgggaacatcgacgagcggcgcggcctgttcgacccctacgagttcgccacgagcgaggacaccctgtacctgctttccgcacagggccgtccctccaccgcgttgaccgccagcctgacggcggtggtggcgttcaccgcgttccaacgcgcccaatccgagttcaccggcaacaaccgccgtctgccggtcccgttgtgctgcgtgctggacgaggccgcgaacatctgccgctggcccgaactggccgacgtgtactcgtatttcggttcggcgggcatcccgatcatgacgatctggcagaaccccgaccagggcagggccgcgttcggcgagacgaacttcggctcgctgttcaacaacgcgaacatcaccgtctacctgggcggcatcaaggacgcgaagttcctcggcgagatcagccagctggtgggccagagggagatcgtgcgaggcagcgtcaacatcgacggcaccggccggcgcagcgtgaacaactcgatccagaaggagaacatcctcgacgtttccgacctgaccgaatggcccgtcggccgcgcgctgctgctcgcatcccaatcccgggcgcagatcgtcaagaccctgccatggacgggcaacaggcaatgggccgacgccctggcgcaagccaaggcgaaagcccgagaagagcagagaaaggccgcataatgagcgaacacacctcgaacaccacgtccggccctgatggggaggaatgggagcgcgcggtcggtgccgccaggaccctgctgtcatcggactgcggatggctggaactgttcacccgcgccatcctggaggagaagggcgtgccttacggcaagggactgcccaaccccgaagcgccgcacatccccgaggacaaggagatcgaagaggaaaccatgccgggccaaggcgagccgacgccgaccgcacccgaggtgccggcaggccggcacgcggcggaacccatccgatccgggattccggccgatgccggggaaaccggcaacggctacgagaacccgccggaagacgcaacggaccgtgacgacacccctccaaaggccggtgcggaggaatccgacacccgtatactgcccgcgccggaggggaagacggatctcggccgagacgaatccggcgacctcgatcccgcgcgggcaagggacgtgtccggccagttcggcgcgcgaatgcggcgcagcgagacctactatccgaacctcgccgcgttcgtggaaaggttcgtggccaacgtgttctgctaccaccagagcgcatccgtgaacatgcaatgggtgagcgactggtggcgctatccggcgctcgtgttcccgctcgacgccatgtggcgcgcctacgagaacgcgcgcaaggcacccggccagatgatgatcttctacatccaggcggcgtcgatgctcgaccgcgttttcgacaaggaccgtggcatcgtcgccagcctcgactgcaagcagaatctcaccaggaagggcgaaccgctgccctgcgaacgcccgaaccgggcatggcgcgaaccgatcctggaaacgttgtcggtccccgccgcaggcggcaaggaaaacaaggaaaccaccatcacgccaacaaggaggagaaacaatggctcaaactgatcccgaggacggcttcgaccagatcatggtccagagctggaacagcgtcgcccagcagctgcgcaccctgcacaacgagctgagcggcgaccgcgcgcgccgcagggaacgcgccgaacgcgccgtccagaacgaacgctacgagcagaccagacggcagcagcaatccatccgcctcgaacaatgggagatggacaacagggaacgcctcaacaaggggttcgagtccaccctgaacgcgaccgtgcttgccgacggcgacggctggaggaagatgcgcgactcgtccctcttgcaaggatggatggtcgccgaccaactggagggcaacgaccccggctaccgcaggcagatcatcgaggcgaaggcccggctgaaggacgaatggtcgaaacgccacccggaaacgcacatcgacgccgcagccgaccaattgaccaaccacgtgaacatcacctacaccgaccagtcgcccgcgttgcaggccaccctgaacgccttcaacacggccggcgtgcccgtggacctgcaacgggtggaggacacgcaggcgttccaggccgcgcacggcgacgacgccacgttcttcgtggactcgcgcttgaccggccaatggacgggctacgaccacgacaggatcgtcgaagccgtgatgtgcgcgccggtcaacggcgtggacgacgccgcctcccgaatcagcttcctcaaggaccagggcctgccggaatcctcgcacgcggacaacaaggccacaggagacgagcccagcaccataagcgaggtcgaacgcaccgagaacgctgacgccgcgccaatcgtcgaaacccccacacccgtgcgggagcatacgaagcccgccgccgatgaacgcaaaccggcatccggacccgagcccgagaccacgggaggcggcgacctgacgaccggggagcccgacggatacgaggagatgccactcgacctgaacgaacccgaggaatggaacgggcccgacccgttcggcgaatacagtcccgccatggaatcctccatgaaccccacggaccagccgatacccgaccaggccaacgtctcgacgccgcagatcctgcaacccgagaccaacggcaacgcacgctgacgccgatgccggcgcaccccttgccatgaggttcgtggggtgcgccggcatcggatggccgtatcatggtgtcaacggctttcggaaccggaaaggacgagcatggcacacgtgacgttggatctgtcgaaatatgatgccctgaccgcctacaagggtcttcccgacgagaaggaggagaacccggcgcggttcttccccgacacctcgtcggtccgccgttgcgtgcgcgaacgcatgtccgtcatgggtctcgacgccgccgaactcgccaggagagccggggtccccctctcaagcgccgaagagctcgtggagaccggtctgacctccatccgctacgtgtacaggatgttcgacctgctgcacatccgcaccgaaacgctgccgtccgcctacgcggggagactgctgtgagggaactgcacgcctgggagaacgggcatcatgtgggcgtgttctcggaagacgacgaggagcgcatatcgttcgcgtacgacgcgaacgagggtctgccgatcagtctgagcctgcccagaaccggcggatggagagaccaggcaccgcgtaacttcctggacaatctattgcccgacaatccgaacgtccgccaggccatgcgtgagcacctgaatgcctcctcggccggcgtcttcgatctgctggaccgggttgacgccaccggcggactggtgttctccctctccccggaacctccaatcccatcgccgacgcttcgtctgatctccgattcccagatagccaacgaaatcgaccgcatcgagcggaccaggaactactggtgggacgaggacagccactgccggttctccttgggaggggcgcagggcaagttcacactgtcccgcgtggacggcaagtggtattggccggatatgatgctgccctccacccacatcgtcaaaccgaagccccatgaccttcccgaggcgaccaaggtggaactggcgacgatgcgattgtcggaactgtgcggcatcgacacaccggcacgcggcgagatcacggcgcagcgcaagacggcctatatcgtggaacggttcgaccgtcgcctggaggaaggccgaatcgtccgactgcggcaagaggacttcctgcaagcgttgggattgccgacccgcgacaaatacgatccgtcggccgatgactgcctggatctcctgcaacgcatcgatgcgtcgggttccctgtcctaccggtggctcgaaaggctggccttcaacacgtcgtccgccaacagcgacgcacatgcgaagaactattccctgatcctcgatcccgcatcggggatacgcctgtctccccagtatgatgcggtcgccaccaggtattggcccgagttcaattgggaactcaccatgccgttgaacgaggatcacgccttcgcggagcacaccacgccccaggattgggaggatctggcgacacgtcacggtctcgatggttcgagggtggcggatatggcccggcgtatggcggggaaggtcctcgccggcatatccgaatcctgcgagggcctggacgcgcggatggccgatcgcctgaacgcgtgctggacgaaggcgaacgagtccatcgagccgatcatgccgggagacgagccggcgaactctctcgatccagcatcggctttgcccgattcgctcggttttccttcctcgggccgtaccatctgagctttttccgggaagcgtcctaacggcggggccggttctcctcgtcagaggcgaccatgctccatagaccgtattccggcgcgattccgtagcgttcgcgcagcatgtcgaacgtgtgcaggccctcgcgcatcgctgcccggtattcgtcgtcgtccgccgcgttgttgaggctggcggcgatgcagaacgcttcggatacgaggcgttccatgtcgtgcgtggacaggttctccaggtgccgttcgcgtccatcatcgaggaagggcgggcggttctccatcgcggcgcgccattcctgcacggccagggcgcggcttctggcatcgtccgcccagtcgtcgcgcagtcgtttcaatcgcatgtcgtcgccgagctcgaaggcgttgaaccgttccgtccacccgtccgtgctgcgccacgtgatcctgtagccgaccacctggccggggtcggtgaacgagtctttggcggttcccctgcgcagcctggggtcgatggagaagccttccctgcgcacgcggcgtatgaactcgtcctcgctgcgcgatgccttggcgcacgcctccacgatccggccgacatgctggcgcggcatcgttgaggcggcgaccgccgtgacgagccggcttctctcgttgccgtccaacgcatcccatccctcgtcgtcgccgtactcgtttcgcgccttccattcggcccattgacgccattgcccgtactgccagctgacgcgcgtgccggtgtcggagcgtgcgagctcgaccagttcggggcgtgtcttctccatccgcctgcatgatttctgcgcgttgatccggtcgtggtacgggtttatccacccgtcgtcggcggcgagctgcaccatgatgtgcacgtggtcgttgccgttggcggacagtccgtggcggaccgcgagccatgtgacgccctgatcgtcgtcgccgtcgatgatgttcatgcgcgtcagataatcgcggatgacggcctcccattcctggtcggtcagtattccgtggccggccttgatggcgagcgagcagtgccacacgcgcttcctgccatgctctcgttcgggattgttcttgcctcgcatgtcgggcgggaacggatcgtccttgcgttccctgacgcggtagcgtcggtcgaacctgcggcctatctccgcatacgacaccgccggcttgccatccatgtcaaacgagggaaacatgtcgccgctcgcgcacacgagatgctggtcggtgtgttcattgcgccgtcccttgccgaacaggtagcgcaccaggccggccgggtccgaacccctgacgatattcggtatcatacgatgattctccgtccgcgcgcccggcacggcggcgcatggcgtctatgagagatatgcgtcctttgccggcacggccacttcgatagaattatcggaaacggacaaggagctttgatggaaccggtgaggaacgatacgacggcggataggcgcacggccgtggaactggcgaagcggctgctggtcgattcgatctggcgcaccgccaagatcgaggttgatggcgtcaccttccccgacacgcaggagatcttcgacgggcgcgcccccgagggtatgagcgtggacgatatagtcacggtgaacaacatcaagcgcgcgtggaggttcctgctcgacaacatcgattatccagtcgattggcagtacatccgcgaatacaaccgcatcatcggcgaaggcctcgtgcgcgacgccggccgcttgcgtgaatacggcgtgaggatcggcggcacgggatgggtgccggagatccccaccgtcgaatcctcacaggaaagggttcgcggcatcctggaggagtcagaaggggaggacactgcgatgctgctgttcggcgcggtcacgcggggacaatggttttcggacggcaacaagcgcaccgcgctgatggtcgccaaccaccagctcatacacgacggcatcggcgtcttctcgatccctcccgaagacaaggcacagttcgtctctatgctcctgcgctactacgagacgggcgactactcccggctctccgattggctctcacagaacgccgtcggccatgtgcccggcgggctgactttggcccaatcgtctggggccgcggaaaagacgaatgatgccgcgaacgggatgggcatcgtgcccggtgttcccctcgatggcctcgatggaggttccggcttactgaggtgacggtcgtggcgtccgggggtgctcccgaactccatgggattatttacggtcggcttgcgtgatgatgacttcgagccggcctataagtttccggcgctgccgcaccgtgtgcgcggccgttgcctcgtcgcgttcgctggcgtgcatctcgcggttcacgttgtgcgtgatctggttcacattgacgccgatacgacgaaccatggcgtctacgcagccgatgatttcgcggggtgtcgggccgcgcccttctcatgtgctatcctgggtttctcgggaatcggaggaaccgtatgagtgagatcaggatagcggatttgttcgccggcatcggcggcatccgcatgggaatggtgcaggcgctgggcgatgccgcgcacgtggtgtattcgtccgagtggaacaagtacagcgtgcagacctatgaggcgaactggcacgacgagaatcccgtggccggcgacatcaccaaggtcgacgagcatgacgttcccgacatcgacctgctgctcgcgggattcccgtgccagccgttctccatcgccggcgtctccaagaaacagagcatgggccgtcccaccggcttcgaggacaagacccaaggcacactgttcttcgacgtggcgagaatcatcaaggcgaagcagccgaaggcgttcctcctggagaacgtgaagaacctgctctcgcacgaccgtgggcgcacgttcaagacgatatattccgtgctgaccgaagaccttggataccacgtcacctacaagctgatcgacgcggcgggcttcgtcccccagcacagggaacgcacgtacatcgtgggcttccgcgaggagaacgggttcacgttcgatgacgtgaagcccatcgcgcacggcaacgtcggcagcatcctcctgcccgcctcccaggttcccgacaagtatgttctgagcgacaagctgtggacgtacctccagaactacaagaagaagcacgaggccgcaggcaacggtttcggatatggcatggtcgatgccgccaccgaccacacgcgcacgttgagcgcgcggtacggaaaggacggcagcgagatactggtctcacgcggcgagggaaagaaccctcgaaggctaaccccgcgcgaatgcgcgcgactgatgggctacccggattcgttcagtatcccggtatcagacacgcaggcataccggcagttcggcaactcggtcgcagtgccggtcatccgagccataggcgaggcgatgaaaccctacctgtccgactgattcgcccgaggcgtttcctgtccgattggtctatgctcatggattatgagcgattacggaagaatcggcgactacatcggcccggtcgcggccaagaaactgtcggccgtcgatatcgacgccaacagcagcaaccagcacgagttcggcggcaacgacgcgctcagaagactgctcggcaccggcgaggatcgtagagcctcacaagggcacggcatacccaccgcgctcatgtacctgagcgacgatgacgcaccggcggtcgccgacctcgaaaccacatggtacgacgcgcggcgcaacaacccgaaccgcagcgccgaatggcgtctctactacaaggactgcgagccaatccgcatggcccgccccggcgacctcatgtgcttcggtatgctcagggacaatcgcctgctgatcatcatcgcacagcatgacagcacggccgaagcccaagccaaatggctcttcggcatcgacgacgaacaggagggcgcgttccgcttccacgacaatacggaacgtgagctggacgccttcggcgcgcagatcttcgaagctctcggcatcaacgtcgaagtgcgggatgacacgtatctccccgagatgatcggcagatggggatacaggttccccagcaacgaggagttcgcggccttctcccaatcctccttgacggacgtggaccccacgcacgatgaccctgacgacgtggtgatcgaatactacgaccgcagctacctgctgttcaaactctatgagcgggcggtcatccaacacgactacgatgccgcgccattcgtatcggatggcgtcatcgacgttgactcgttcacttcgttctacacctccgtgcgcaaccggcgcatgagccgcgcaggcaaggtcctcgaaatccacatcgcccacatcctcgacgcgcgcggcatcgaatacgaggcgcaggccaagacggaaaacggaaagaaacccgatttcctgtttccctcgcaagccgcctacgaggatccggcgttccccgaggaacagctgcgtatgctcgcctcgaaaacctccatcaaggatcgtttccgccaggtcgccgacgaagccaaccggatcagggacaaacacctgttcaccctgactcccggcgacgtgacccatcccaagctcgcccaactcgatgaactgcacatccacctggtcatgcccaaggtagtcaaggaatcctatgacgacctgatccagggagaaaccatgacgttctcccggttcatcgaagaaatccaaggactacaagcggaccgtccgcaaagcctgaccctcctctgaccggttcgcgtcatcaggcactcccccggactgcccgatgacggcatcgagatggtctatcagctcccggcattgccggacggcgtaggacgccgatgcctcgtcctcgatggtcgcgttcatctccctgttcgcgttgtgcgcgatctggttgacgttgcggccgatgcggcgcagctggtattcgatctccctgagcgcctggacggtgggcgaatcatgttcctcctcctcgacgtacaggcttccctccaacagctttaccgcttcgatgatggtgagggataccgtctggttccgtttcctcgcggcggcgcggatcatcgcggcttcctcttcgttcaccatgagatgcacttggatggagcgctgcgcgccgccgcctttgctgcttcttttacgcattattctttctcctcctccatcggccttcggcactcgggttgttgctcctgcgccgacgggcgcgggaggtgctgcgttcggttcatgtacatgaaccgtctagcttgcttaccttcgatttgatgggcatctccatgtggatgtccatggacatatccatgtgggtgtccatggacgtgtccatgtgggtatccatggacatatccatatgagcgcataggaaaacgcatgagggtggatgatcgttcggggtgatgccttcttccacgaatgggaaggggctcttcctttttttggaatgtcatcttcccgcatccttcgtcttgagctccttgagcagcatcgtcgcgttgtcgcggatgctcgcgtccgtgagcggggagagctcgtccgcataggagcggcagaggagcgcgtacacccgttcccgcacccaggcgctgcgcgcgatgcccagcttgaatgcggcccggcacagcatctcgtattcgtcgccggtgagcatgacattgagctggcgtccctgcttcagcggatgttcggggtcggggtcggtgcggtacacgtcgttccaatcggtggtgccgggggcgagttccgtgtagctgaacggctggatggcgtatctcacgaaacgggatttgggtatgcccgtcttggtggaggcctcggcaagcagattgaacagctcctggtccatgaggacccggaaggcgtggctgtatcgtcgcatggtttcatcgtctccttggtcgttgccgtgcccggcgcggcatggtgcgtcgggcacggatggttggcgtttggtcagcggtcgaagtcgaacgccgtgccgcgttccttgtcgatgcggatggccgcgtcgaacttcttcccggatttggatgtgaagcccttcagggtgacggattgtcccgcgaggagcctgcgcgcggtctggtcggtgatggtcttgcccgcgatgcgcgcgaacatcttccatccgcagcctgcggtcgtggcccacttgccgtccttggtcttctcggtcttgttcgtggaacactgccacatccggccggttttcctcaccggctggccgcagcgcgggcagtcgccccattcctgcgcgtcggtgttcgcggttcgtgtgacggcatcggccttgaggttcgcggtcgcgtcggcggggattcgcaatgcctcccggtggaacatgtccatcacctcagacgggtcccgtttgccgtgttccacgtcggacaacgcctgttccatccgtgcggtgagcagcacgtccttcaggcgtggctccaccacgtcggtgaggcgttcgccttccgtggtggcgtgcaattgccggcccttgcgttccacgagtttggagcgcacgagcttttcgatggtgtccgcgcgggtggcgggtgtgccgatgccgccggaatgtgattcgtcgtcatcgagtgccgccttgaggtttttgtcctccacgcaccggctcgcgtgctccatcgcggccagcagcgtggcctcggtgaacggtttgggcggccgggtctcgccttcctcgaccgtgaccttcccgaccgggcgaatgacgccgccttccatgaggttcgatgggatcacgttccttcctcccgccgggttcgcggtttcctcgtcttccggttcgggcccgtggccggtttcgacggccttccatcctgcggatacggtctcgtcggaacgactggagaactccctgtcggtgtcgtcggaaagccgggccttcacctcggtgacgatgtgcacatggtcgtcgcccacggcctcccacatgcggcgcacgatgcgtgtcatcaccttgcgttcgtcatcgtccaggccttccagcttcccggcgtccaattgcatggtcggcagtatcgcggtgtggccggccaccttcttgtcgttgacggtgagttccgggcgcgggtgtccgggtatgccctcgcgggtgacgaacccttgggcgagacggccggattcgaggagcgccgtgagcgtttcgaggtcgtcgtgcgtgatgtaccggctgtcggtgcgcggataggtggcgagtttgagttcgtagaggtgctgcaacgcctggagcgtgcgtgcggcggtcatgccgtacatgcggctcatgtccttctgcaatccggtcaggtcatacaggcggggcggccggtcgttcacccgcctccggttcacggacatgatgcggaagcggccgtgttcggcctggccgcacagcagcatcgccgcatccttgctgtcgatccgttcgctggagagccgccatccgcccatgtccgcgatcacggtccagaacggcaccggtttgtggttcctgatctgccggtcgcgttccgcgatcatggcgagcgtcggcgtctgcacgcggcccacgctgaaccgtgcgttgtagagcagcgagtacgcgcggctcgcgttcatgccgatcagccagtccgccttcgacctgatctccgccgaccatgcgagcccttggtattcggattcgggtttcatcgcccgccacgcggcctggatggcctccgcctccaggctcgccacccacaggcgcagttccggcttgtgagagccttccatgtccgcgatgcggcggaagatggcctcaccctcgcggtcggggtcgcaggcgttgacgaggcaatccacatccgttcggcggatcaattgcacgatctgccggtagcgggagccggcaccgcgctcctcgctgatcttccaccgccaatggccggacgggtccacaggcagcgtgtccagactccatttcctccaatccctgtccttgtagtcctcgggcatggcaaggtcgatcaggtggccctgcgcccatgtcacgagcagctggccgcactcatagcatccgtccctttggacgggcgcggcgcacaacgcctgcgcgatggccgtggcgaccgatttcttttccgcgatgacgagtctcattcgcgttccttccgttttttgggattccttgattcttgtccgacatgcgaggaccggcgcgggaatcccttcccggccggccctggatggaaaggcgtcgccaaggtcaggcggcgaagccgagcagcggcgcgaacacggcggcgatggccagcaccgcgatcagcatgaggatgacgccggcgatccacgcgatggccgtcaccagcgtgcggctccaggtctgtccgccggattccacgatcatcgggctgcccatgcgtttgccgatgatcgcgcacacgcccgaggcgaccacgcacaacagcacgagcaccacctggagcatcccgttgagctcgaccagccacgtccacaggcccatgaaccagccggcgagcatagagagaaacgattccattgattttcctttcacctgattggaacgacgcttccgattctcggccgcaaaacggccggccacggggcacggcgtctacacgccccgccttccgccatggggaatgtagacgccatgccccgtggaacgcgcgacgggaaggcagactcgccttgacggaaaaacgagcgaaaggaagatcgtcgtggcgaacaaccagaacaccatgcgcgacatgaaacgcagcatcctcaaggcggtgcgcgacagccagaagacgaaacaggatgcgatggacgagtacgtggcggcgcgcgtcaacatcaaatcattggaggaacgtctggaagaggcccgcgagaaggccaccctgctgcgcaggaaggcgaaggacgcgggaaacaccagcgccgaactgaaaacggcggacgacctcatagacgcgcggtggacgggggcggaagacgggtcggcggaagacgggtcgcccgaaaacgcggatccgggaaccgtgaaccccgagcgggagcatccggccatggaagaaaacatggaaggcggcatgccgggtgagccgaaccgttgggaaggcggtgaatcgtgaaccggccggaaccgcgtccgctgccgaaaccgctgcgcgtcctgtgcctgttcgtcgccgcgctcctcgtgtgctcgctgggcgtcatcgtcgccaaccaccagccgtcaacggccggcgacgaccacggttccgcgacggacgcgaaacaggagtccacgggcaaaaggaaaacggattcgggcccgcgacggtacgccggcctggaggcggcgggaatcccggttcccggcgactggtctcagcgcaccaccgcgttccccgttgacacccacaaggacggcacccgcacgctctccgaaaacgcggacggcatcacgctgcacaatggttccggcccgatcgacaccgcattggaaacggtggacgcgctgctcgatccaaacggcagcgacgacgaatggcgcaagaacgtgttcgcgctgctcggcgacgacggtgccggggagagccatccggtctccgacgcgccgcgctggtggtggacccagcgccgcttccacgccggatccgtatgctcgggccaatacgatgacaagtacgtcaactacgcctacacctgcacctccgacggcaaatgggagggctcggatacggatgccatccagtcccagccgttctggacgacgaaggaaaccagcttcccgatcccggaaggcggcggaccgtcatccacgacggatccgcagcagaccgtcagccaggcgtacaacaccgtgctcttgccgatggacgacggcaactggcacgtcaccgtctactgcccggccgcgctcgacgcgtcattgctggacaaggatgccaacgagctcgaccccgatcaggtgaaggccggcgacgaggcgtacacggtgatctccgccaccggatacggcacggtccagcatccctgccggaccgtggaggtcgtggtcggcgggcagaagcccttctggtcgctgaggaacacgcaatgagccgggccagccgccatcggatcctcgcggccatgctctcggcgtgcctgctgtccctgctcggcggatgcacgccgttgaccgtgctcgcggtcctcggcggctgcaaggacggcggctccaacggatcgtcgggaggcgtcacgggaagcgtcacgaccggcgaggtgcgtgacggcatgaccatcgcgcagaccaaggcgtggttcaacggatccgacgggcccgacaacgtgtgccaggcctatccggacgggcaatgcacatggtgggcgtgcatgagaggccataaaatcggattggacgtgggctcctactggggcaacggcggcgactgggccgccagcgccaccgccgccggatggaagaccacccgcaccgatcccgtggccggcagcatcgtcagctacccgcccggcgtggccgacgcggacaccctgtacggccacgtcgccgtcgtcgaggcggtcgaccggacggccggcaccgtgaccatcagcgagatgaacgggcgcggcggcctgggcatcgtcaaccaccgcacgcacaggatcgacgtcggcgcggtctacatcctgcccaacggcagtgtgtccaccaatggttccgccggcacggattccacgtcatccggttccgaatcgtccgattcgtcgtcatcgtccgactcgtcctcctcttcggatccggtggaggcggcatggacgtgctccagttccgactcgggctccacggacgtggtggtggactacgacggcgacggcacccacgccacgccggaacaggcccgggccatcgcccggaagatgatcgcctcgtacaaggactggggagacggcgactatgacgcgctcgtatggctgtggaacaaggaatcgggatggcagtggaatgccaccaacccgagcagcggcgcgtacggcataccccaggcgttgcccgcgtcgaaactcgcctccgcaggagacgactggaaggacgacgccgccacccagatcaaatggggattgaactacatcgccggccggtacggcagccccagcgccgccaagacgttctggctcgcccacaactggtactaaggagcgggacacgtaaagggaccgagcatcaaatctcggcggaatcatctgccccgtagacgccatgccccgcgcgaccgcccgtatgggctgatgatcggagccatgcccgccggacggcgcggcaccgatcatccaagggaaggaaggacgcatcatgctgatggaacccgatgaatacacgtcccaggaacgggccctgaccgacaaggcgaaggagctgatcgagcagcacgagctcgactggggcaacggggaatgcttcatccaacgcgacgccggccacagcgaactgtacatgacgctggaggcccccaaccacgccacggtcacggtcacggtgccggccgaggcggacgagaaggggctgaggcgcgccatggcggacgggctcctcgacttcgaccccgacgaggagttcgacgaatgctggtcccgcgagttcgcggcacgcaacgggttcacgccctccggcttcctgtccggcctccaggaagacaaagcgtatttcggtctccgatctgaggcgttgcttcatcccggtcaaagcaacgccgggcaaggcaacgaaacgattgcggagatccgctggacggaggaggaccttcggcactggctgaaggaccatgactggcccgacaacaacgagaacatggacgcgatgcgcggcatgatctcggccagggaattgcgggaccgcagcatcgaggagggatgggagatcatcgacgcgatggtggacgacggccggctcgcccgcaaagacgaaggcgagaaggccgaaacgtccgaaacctacgatcccgcgaacccggccgacccgttgagcattgccgatacgtctgcctcggccgcagccacacgataaaagacccgagcgaaggagcatcatcatggccggattgaaggactaccagatcagcgtgtacgtcgccaacctgggcaaatacgtggagggcgtgttgcagggcgcgtggatcacgctgcccatgcccgccgaacgcttgcaggacaccctgaagaccgaggtgggattgggcggccggtacgaggagtacgcgatccacgactacgagggcggggaaggactgctcgccaccgtggcgaatcccgtcgaatacgagtcgctgacggacctgaacctcatgtgccgcgcgttcgaggcgcgcgaggacgacgacccggacgtgtacgagaaggtgcggatggtccgcgacgatcttgacgcggccccgcgcaccccgttgcagtacgcgaacctcgcgttgaactcggacgagatcccctatcactcttatgatgcgccgtcctcggccgaatcgaaggaggcgaagtatgcctggaccgccgtgaaccaggggtgggcatcggatgccgtgcgatccatgttcgatacggggctcggctatctgatcgatatggagatgtacggccgggacctcaagctcgacggcgatgtgtcgcttggcgacaacggctatctggaggacgcggactggccgagcgatatcgacggacggtactcgcgcgaggagatcgccgaggaggtcgaatggctggatgatttcgacgcgaagaccggttcgccggccgcgttcgatctcgcctcgctcgtccagccgggcgaacgcatcgcggactacacgatttccggcaccggcacgaactggggagccccctcataccagtgcatcgtggaggagggttccaccgatatccatgccgcgcttgaggacacgatgcaccggatcatcgacgcgcgcgccgctactggcgacgccgtggacgtgctgcgcgagaccatgggcgcaatgcccgcagcgtccgtcggcgaagacgacggcgtgagcccgatcgaccttgatctgggatatgtgctgcccggtgccgtcacctcgttcgcggaacgcgcgcaggcgtgcgacccctcggacccgctgaatatgaccgatacggccggttccggcctttccaagtgagaaagggcgagcgagatggccttgacgccttttgacatggagggtgtgaaccgcgacctgctcgcggccgggaatcccgccaagcccgacatgcaatccatcctgcgcaggaacgcgcgcgatctcgtgctggggaacgcgattctggtctcttccgccgatgccaaggaattggagttcggcgtccacatggcgtattccgacgcggacggcggcttcgacaccgatccgagcgaggacgtgtggttcgaggcgtcctcgctcccgattcccaatgaacgccctgatctgcctcccgacaacgcgctcaggatcagggtcacggacgtgctgaccgaatacgggttcacggacattgacgtgaaagccccggacaggacgccggaaggcatctggatcggtttcgaggccatgcagccagtcaggctcgacgtgacctcggcccaggaagggcgttccgtttccttcaccctgacagcagccgaggccaacgattggcgttccggccgtctcgacgcgcacggcctctcacgcatggccgtcgaacgggttctcgccaggccgggcgacacggtgacgctcgcctacggggattcgctgttccggccggcggtgatgtgcgacggttcgggaaggcttcccgagcatcgcgtcaaggccggtatcggcacgttcgtcatcggccgtgaaagcgaggcggtcatgcccgagatactgcggatcgaccgcactgttgacccacgagacccgctcgtgatcgaaaaggcgttcggaaaggagaacgacatggagaacgggaatgtccccgaatactggaaaggcctgatggacgaggccgatctgccgttggcgggcatcgtgcgcgagcacggcggcgggttgatggacttccaccgcatgaagggcatcgaacgcctgaccggttcgagtgactgggatttctactcctggacggtggaaaattacgacgatgacctgctcgacgtgtgcgaacgggagaacgccgccgacgtgctcgccgacttgcaggcatggtggaaaacgagccagcccgacatgcggcaacacgtggacgagatgatggcgggcatcgacgcggccatggaaccgctcgacaagcacctgtacgccgccgccgaaaaggagttcaaggagcgcgcgttggacccggacggggaatgctaccaattggacggcggcacgttcatctcccaggaatcattcgacggcatctgcggcgaccaacgcgaccgctacatggcatggaagaaccaggccgaacccgccagactcgtgagcgcatgggacgaccccgcacgcctggaccggctcgtgggcgacctgatcgacgcggacgatggcggcggatgcttctacaccgacgcgcagcccatcgactacacgcagggcatggattacagcccacagcagctggccgcagacagcgggctgggagatacggtcccgctggcgtgtgagtccaacgcttcctacagcctcgcgcaccaccccgatatcaaattcaccgccaccgggtctcccgacggcagaaaggcgctggaggtctcggctcccggttccgcccgtcatgcgctaatcacggccaaacccggaacgttcgacgtgagcctgcatgacgagcgcggcatcgtgtccggcgaatccttcccttacgaggcaaacgattcctggacgtaccggctttccggccaggcgttgcgcggcgcgctggacctcgccgtcggctgggccgacccacaggaaacgtctcctgagaccgcagggctcgacctcgcgttggatgacggcatggaaacgacacacggccactgacgccgtacggcaacgacgaacagaaccaaggagcacacgatggacatgaattggatcgacgagattcgggatcccgaaccccgcaaacggtacatctacaacgctgacgactacgacccgcaatacggggacccgtattaccgtgaacacagcacccgcgccgacagcctgtggcggctgtacgaggagagcggcacgtcgatcacgttcgatgccttcgcggacgaatcccgtcaaaccgattacaggatggagaccggcgctctgcgtgatttcttcaatggatcccagtcggcgctctcctcgtacaggaacccgatgggaggcaacccgctgatcgcgttcggaagcataggccgatgggacggcgaacgcacgggcatatcctcgttcgagaccttcgatgatctgatgaacggcgatgattccccgttcaaggactgcgagatcgaccacatctgggacgagaacggaatcctgaagatgcgcggccaccaccacgacggcagtgtggaggtggagatacgccagctcaccgaccagggatgcgaggcattggaatcctacgaacaggcatgggctggcgaaccgttcgacgccgcaggccgccactacgacggcggcaaggaatccgtggaccgcttctggaacgacctgaaaaccgatcggggcctggccgtggaaccccggtacgtggaactcgcgttcggagggttaagggtcaaaaagtgtgtccggaatcgcggattttcacggattgacctgtaggtttccggaaagtatatgctccggaagcatatatctagcccccgacgggaaatcctcggtgtggcagccgtgatgtgctatgcgcggcgtggtgtggtgtcgcaatgtcgaagaaccaaccacgctgccactgcggcggtgaaatgaaacgcaacggcaccaccagcaaaggcaccaccagatggcgctgcaaacaatgcggcgcctccagcgtcaaacgtcgaaacgacatcaccaacgcggcagtgttcacccagttcatcgagcattgcaccaccgcaatatcactcgacgacctagccaaacgaaacggtgttagccgcgccaccatgaagcggcgcttcaagtggtgctggctcgttgatgtgcctgaccccaccgccggccaccacaagcggatctacgaccaggtatttctcgatggcacctacaccgccggtggctgcctgatcgtcgcggcgaccatcgaccacgtgatcgcctggcactggtgcaaacacgaaaccacccgcgactaccaactgctgcttgaacgcatcgaagccccactcatcgccgtcatcgacggcggccaaggcgcatacagcgcaatcaaaaagtgctggccgactacgaaaattcaacgctgcctcgtccacgcccaacgcgtggtccgccgctacaccaccaccaacccacgcaccgatgccgggcgcaccatctaccgacttgcgctgaaactgacccggatcaccacactggatgaagccgccgcgtggggtgtgcaactgcacgagttttcaacgatctaccgggaatggatgaacgagaaaaccatgatcaaagaccccaaaacaggtgcatggacccgcgtgtggacccaccacaacgtgcgcaaggcctacaacagcctcaaccatctttggcggtccgagatgctgtttgtctacctcaacccgccagcaggagtccttgcgcccgagcggatcaaatccaccaccaacagcttagaaggcggcatcaacgcccagctcaaactgctcgccagaacccaccgcggcagatcaggcgaacgacaacgccgcatgctggattggtggctctacttaaaaacggaactgcctgacgatccagtacgaatcgccaggcagtccgactggggccagggccaactcgccaaagtatccaccctgacccaaaccgagaaccaagccgaccacgaaacaggacgcccagccctctacgacaacgctatcgacaccgactacacccactcaatcggcattcaaaaaggccaaatctaacccccgcgacacgccgagccagacacacattttgacccttaaccctttaaatggatataattagacccatgttgatttcaggtaccgctttcttgcggttgcgcaccaaccgctaaggcggtttcctaccccgtaggttaaaaaccgctccggtcctttagccgggcggctatttgtcatgcccggctccctttcaaatccaaggagcacaccttatgtctgcatacggacacggccgtcacgagcatggccaaaattttctcaccaaccacaagatcatcaactccatcatcgaccttgtgaaacaaacctccggccccatcattgagatcggaccaggaagcggtgccctcactcacccgatggcccacttggggagggcgataacggcagttgaagtggacgcaaaactagctgccaaaatcacacaagaaacctcctcggcggcggtcgaagtggtccatgatgatttccttaacttccggttacccgccactccctgcgtcattgtgggaaacattccctttcacctcaccactgccattcttcgaaagttgctgcatgcgccagcatggactgacgctgtactcctcatgcagtgggaagtcgctcgccgccgggccggggtaggcgcaagcacgatgatgacggctcagtggtccccatggttcacatttcacctgggttctcgggtaccaaggactgctttccggccacagccaaacgttgacgggggggatcttagtgatccgccgggtgggtgacccgaagattccgatagagcagcgcaaagcctttcaggcgatggtgcacaccgttttcactgcccggggacgcgggataggggaaattctccgaagggcagggttgttttcatcacgttcagaaacacaatcatggttgcgctcgcgaggaatcgaccccgcgaccctacctcccagattgcacaccaacgactggatcgatctcttccaggtgactggttcctctctacctcaccatcgacccatttcaccatcgggaagtagtcaacgacctcctcaacggaaaaaccgaagccggcggcgttaatccccaccaaaaccgaaatccaccagtagtactaaaagggctcttccggttttagagtgcattgattagttcgccgggggttcgggcgtggcacaagatattggggtccttggctttgtaggaaaaaggtatctaatccatccgtacaaaactaaggacctactgtgcagcctaacggaaatgtcatcgtcgataccatctgccgcaccgcaaaactaggaactactatcaccggtgccacagaaaacggtgacgtcactgttattgaagccgaacccgtcgagccgatcaatgaatgccctacctgcgggcagcctggagtattccgcgaccacgtcatccgcagcctggtcgatctgcccatcgtcggccacccaacaacttcatgtgcgccttccacgctaccggtgcaccaacaagcgttgcttgcagaagatcttccgtgctggccttgcctgcgcgcccgacaattcaaagaccacggaccaggtgacccactggatcctgcaacgactctgcctaaatcggatgagcgttgccgctgcacccaagtcattaggcctggggtgggatatgaagtgtcccaggttttgttccgtttgatgaaacccgtttttgaaacaacgtacggagcacaacgcacgccgatgccaaagcttccgcaacatcgactacctcatcaaacccacgacagtgggattcacaccctcaatccccacgcgtgcaatctggatgcccgcccatcgaatgggacatcgatgccagggtgagggacttcgccgaacgcatgggcgacgaatatacgagcctgtacgagcaggacacgaccagcatcaagggcggtgatttcgaacgtttcggcgcgttcgcggacaatcacctcgacttcatacgcgccctgacgaaggccaggggcatggaccccatcagcagcgaccgcgagataggcgcgttcctcaacacgttcgacaagctcgccgcgatgcccgaaccgacaccggcgaaacaagaaaaagacgagctttccgccggcgcatgcgatccggccgacccgttgaacctcgaacagtcatcgtcatacggcatgacccggtgaacgtaagaaacgacacggataagggccatggaatcatcggacgacaacgatgattccacggcctttttccaggactttctcgaaggcaagaaaatcgtcggactgtccatgtgacgcgcctgcgcttgtagacttatggaagcatcgattaaggagccgatatgccgaatccagcgctgactgagaaaatccgaaaccttcctcctctcttggactctctggagcgggacgcggaggtgtccgacttgcttcgtcgttccgatgccgcccgagaacggttcaggcagatgtttcctttggatggggtggagcagtcagcgcttgaggattaccgtaaggaatggatggcccgctatgtctacaactccaacgcgatcgagggatccacgctgacgcttgaggacaccgaactggtgttggagggcgagttcgtgccgaccgactcgccggcaagatacatcttcgctgcccgtggcgttgcggatggcatggcctatgcggaacgattcgctgaagaggagcggacgctgagtgtcgagatgatccaaaagctgcatgaagtcaccgcattggacatgcagcccgcgctcaggggtcggttccgcccctacggctaccaggcaaggatcaccgccacccgagtgaagaccgccgacccacttgaaatctacgaggacatggaagcgctcgtggacgcggtgaacggttccaaagaccacccgatcctcaaagctgccggattccacgcgatgttcgagaacatccatccattcacggacggcaacggacgaaccgggcgacagattctgaatctcatgctcatggctgccggctaccggcccgtagcaatcaaacatgatgccggccgcagctatgggaaaagtctggaagcatggcaggttgacggcgatcccaagccgttcatttcccagcttgtccaatgcgttgatcaggaagagcgcgccgtagcggaaatcgtcggcagattaagagagaaccctttctcggaaaacgccatcgacgggattagtctcgaagacggtccggcacgagggcgttccctctgattggaacgcttcaggattgtgataggtgtacatgaatatgcgtttttacatatattcatgtacacttatatgcatgaagaggagcgaggcgattgatcagctgcgcgagatggatgccaagtactcgtgctacgtgtattgcaagaacgaactggccgtcgtgctgggtgagcaggggcagaaactgaaccgaaccctgtccagcctggtatcggcgaaggcgttggtccgtgccgcccgtggcgtctacgtgttcgcgtattcctcccatctcggcgaggggacacttcatcaggtcgcaaagcggttgcgttccggcgagctggtgtgggaaagcctcgaaagcgctctgtcgcgctggaacgtgatcagccagattccggtggatagggtcacgttcatgaccacgggccgtgagggcgagttccgcaccgcgtacggggtgatcgagttcacgcactgcaagctcagctggagtcgcatcctgccgaacctgatcgcccgcgatgacggactgacgccgctcgcgtcgaaacagtgggcgtatcgtgacctgaaggccgtcggacgcaacctcgatctggtggacatggacgaattggaggacgatgatgactggagctgacggcacctatgactacaaggctatggcggccgggatcgtcttggccgggggcgagggcatgggcaatctgcttcccgtggtcgagaaggaacttctgcattatcgaatcctggatgccatgatgcgcgagggtttcttctcctcgctggtgttccagggcggcacgagtctgcgcctgtgccacgggtccccaaggtacagcgaggaccttgattttgccggcggcacctcgttcgacatggacacccttaaagggcttggctcctgcatctccgattcgctctcggggatgggcgatgatgtgacggtccgggtcaaggagccgagacccgacgccgatgggctgacgcgcagatggcgtatagcgattcgcacggccggtcagcgcaaggatctgccgagccagacaatcaagctggaggtggcatcgattcccgcgtacgagccgcagcatcgtcccgccttggtcaactatccgatgttcccggccttgtcgggtcagatcatcctcgatgtggaaagccccaccgagattcttgccgacaagctgctctcctatgcctgcgcatcgcacctgcggcgacgcgacctgtgggacatgtgctggttggcgtcgagaggcggcgtcgattcccgacgggcgatggagcttgcggaattgaaatcatctgattacggcgaagaaggactttgggcagaccgtgctgatcgcgtggcgggggtcgccgatgtgatcggctcggatgccttcgccgacgagatgcgccggttcctccccgccggcctgatgacatccacggtcgaatccccacgttggagcgcatgggcgatcgaacagatcgggacgttgtacggcactccaggcactccatcgtcggccgatgcggttcccggattccctattttcggtgcgtcgaacgactccagtccaacccgctgaacgctaaggaggtctgcgatgtcgaatctggactataacttgcctgagccgacaaaggcgcaattggagtacgcgcgttacctcagccgtttccaagcgccgcgtgaacgccggactcttttcgcccgcaccgaatcggatatcgcagccgccttccgtgaagagaccgcgaaccattcctggaacgccgacgaccttgcctcccaggccggtatcgatccccggtttgccgatgctctgctccagcggggcgaagccccgattgaagcggtgttctccgcagccgatgcgctggggatagacatagccgcgttgccgctttccagtctcgggaacactcggtgagcggtgttggtatacgccaatatgcgcaaagaagcatgttggcgtataccgtttgttcatccgatcctcgcggcgctaagggaataggtggagacgctgccggctgttccgacgacctggttcatgggcatggtcagtctcatgtcggtgcgggtggtggattccacggcgttgcgcatttcgtcctgcacgaggccgatgtaacgcatggtggtggcgatgttggcgtgccccagcatacggctgacaagcacgatgttgcagccgttcctgtagtagacgcatgtggcgaacctacggcgcaggctgtgcgacgggtatccggttaccgtcttgatcctcttcgccacgtaatcgacgccgcagtgtccctgcacgtctccggggaacagccatacgccggtgcgtttccgcaatgccgaagcgagctttgccggcacgggaagcatccgctccttgttgcccttgccgtggacgtggagcaccatgccctcggcgttctcctccagatcggtcttcaggttgattctggtcatttcgatgcggcgcaggccgcagaacgcgcccagcatgacggccagccgcgcgttctcgtcgggtgatgcgagtccttgttcgatgttctcctcgggacagatgcagccggacggaagggtcatgggcacggtgggcacttcgtccgccggattgcggcgggcgagccctcgcttcatgctccattggtagaagaccttgacgcagctgcgtactccgcgtctgccttcggttcccatgccggctaggtagaatatgaggtcgtcttcggtcacgtcggtgatgcttttatcgacggctttggagaatcgaacgatctggtaccagcgggtgcgcagggtgtcgttcgtgcgtccgatggcgtccatccagtcgatccatttctcaatggattctttccaatcctcccgtggctcgacgtgttcgcagctcttcctgttgtcgttccaatacctcatggggctccttaagcgcatagaaaagggaagtgacttcttcatcacttcccaaggaatactattgcgcgtttctggccgatgctcttcggaaaaccagctgcaaggcgaacatgcgcgatgacacgccgatttgaaggaacagcaaggctggtgtattgtctactcctgttgcaaaaagccctacggctgcgagccagaaccgtatatcggacggtcgctggttcaagcccagccgcaggagccatagaaaccctcaacggaaacgttgagggttttttgcttcccgcgctcatcccgcacctgcgcaccgatgcatcgcatgcgccgtcgtatgcgcgcctctgcgtgccacactatgcgaattctgatggtttttaagatggtgtggcaagggacggagacgagaacaatcccgaatcattgcaaaaatggctgtcctacgattcgaatgtctgccataccgcgcgatgtgaaggctcacatcgcgcggtatggcagatggaaagccacacaatgcgattttgacgcgaaatatcgatggtgtggcaatgtggggacgcaagtgactatccgccgcattgctgaggatgaccacccccagtcgcttcgcgacagctctccgggccctgcaagtggggatggcctgcggccacgggcctcccggattgcacttgcctacaaacagttcccgctgtttgtaggcaagtgcaatccgcgaggcggaggggctacatgcagattttgttcatgggcatggcggaatcgatggggcaatcgggcgaggaaggggcctcgccggcctctacgaggttcacgccgagcatggcgaccatcgcgccattgtcggtgcacagcttgagccgagggatgcgcacctcgactccggcccgctcgccgtattcgagcagcttcgcacgcagctgcgagttggcggagaaccctccgcctacgatcagagtcttggaatcatactgctcgcacccgcgcatggccttacgggccagaaccgtggccacggagtcagccagcgaagcgcacacgtcgtcaatgggaacgtcccgccccgccgcctgctgttcctcaatccaccgtgcgacggcggtcttgacgccggagaagctgaaatcatacggatgcgccgcaccggccttcccctgagtcaggccctgcggcaccttgatggccttgggatcgcccagctgagcgtgacggtcgatatgcggaccgccggggtacgggaagcccagcaaacgcgcgaccttgtcgaagcactcccccgcagcgtcatccaacgtggtgccgaccacgtcgacatgccgcgcgacatcgcgcacatgcagcagcgacgtgtgtccaccggacacgatcaacgccagcgtatccttaggaaacggcccgaattgcagctgcgtgacggcgatatgcccgatgacatgattgatgccgtacaacggcttgttcgccgcccatgcaagcgctttggcacccgaaacgcccacggcgaggcatccggcgaggccggggcccgccgacaccgctatggcatccacgtcgccgagtcccaacccggcgtcggagagcgcctgggacacgcacggcacgaacgcctcggcgtgcgcgcgagaggcgatttccggaatcacgccgccataacgggcgtgctcctccatcgacgaggcgacgacgttggaacgcagcgtgcgcccctgtacgattgcagcggcggtttcgtcgcatgtcgattcgatgcccagtacgatcggttcgctcatggttgcgtctcctgtcctgtttgtttcgtcatgtcgccggcggcggacgtatcaccggcagcaccagccacaccgccattgccgctgaacccgacgatgcgcggttcaaggtcaagcgccatcacatacgcgtcgatgccttccggctggtagtaccgtttgcgcagtccgatgcgctggaatccgaaccggtggtacaacgcgatggccgggtcgttgacgacgctgacttcgagcagcatccgtctggctccctgtcgacgtgcgcgagatatcaggtgattcatcatcgcgaccgcgatgccctgcctctgatgggtcttgctgacacctatgtccatgatctccgcgtcgtcgccgtcataccagtatccggcgaatccgcggatggcgggttcacggtccgtgtcgcgtccatccgcctcgtccacgtcgaagacgtatacgcgtgccggcgcgtcgagctcctgcctgatcgaggcctcgctccacgcatggttgccgaacagctcgacttccagcgcccttatcgcgccgacggccgtctcccgcccgatatcgtccagttcgcgcagcatcagtccgccctctgcgcgcccgcatggttcagcacgtgtttgagcgggctgggtacttcggcatcgggccggcgcagatacagcggttcgacgggcgcttcgtcgtccgcatgttccagcgccatctcggcgaacatcgccaagccggccgcccccgcatccagaatggatccctcgaccaccgagccgagagcatccaggctttgccatgcgtcggcgtatcgggccgccccgtgaccgaccacgtccacgatgtatcgcatgccgccaatctccgcgcgacggcgtacctcggcgttgacccgctccacgatatggccggggtagtcgatgtccatagcgatccaatggcaggaatccgtctctgagcccgtcacgccagcctcatggttcagggagaagtacaactgtttgcgacgggcgtcattcacgcacagagtgatgtgatgttccggctccagtctcccgtccgcctggccattttgcgccgtatgcgacacatccgcgaggaatccggccgcgtccgctatgacggcatcgccgcgcagggcggcgcgcaacatggcgtcctgcgggtcgaggatgttctgaccgatcagccgggcccccgtggcgaaggcgagcgccttggctgtgaccagccccgccctcagtccggtgaacggggccgggccgacgccgacgacgatgcagctgatgtccgcgggaccgagcccggcggcatccatcgcacgggcgatgttgacctgcagtttctcgacgtgggtgcgcgaatcggtctccacgatgggctcatgccccacgactcccacggtcgaaccgtacgaggtgtcgatcaccaacgtgcaaccatcagtcgcctgcatttgttcctcccgttcatacgcaacctgtacgagtctacatcgtccgtcagtcaccatcatcaggcggtcggggtcgtgaatcgcgagatacgcgccccatcccacgccgggccgaccggtaccagcgtgacgactctggtgccatcgcttgtcggctgcctctgcgcggttttgtcgtcctgcccgtcatcgagcgggcggtcgatatggacttccagacgttccggagccaacgtggaggccatctgctcgccccattccatcaggatcacggtgttggctccggggtcctccagctcctcgtcgagaccgagcgattccaactcgtccagcagtctttcctcgacgtcctgtccgggcgcataggcgtcgccgccgaggcggtacgcgtcgacatgcaccaggtgggcgtgcgacccgtcggcgaatcgtccgtcaagttcgcgggcgatggtgaacgtcggcgacacgatgggttccgttatgcccaatccggcgccgatgccctgcgcgaacgtcgtcttgcctgcgcccagcgggcccgacagcaacagtacgtcgccgccgtgcagcagcaaggccacacgccggcccagttcgcgcatgtcgtcgtcggtgggcacgcgcacaacgacgggatgcgcggcgtcggctccctggttccgtgtcacgccggcgttgcccgtttctgctgtttccatcgtttctttcattcccgtccctgccgttcctgtttcaatttcgatgtcgtcgttcatgtcatgcatgctctgcgggcacccggccgtggtcgcctcgccgcagggcgccgttctccggcgcggtcagtcccttcctttgtggctgatcagttcgatgcacctctccagcgcgtatacggggtcgcccccgttggttttgctctgttcgtccgcccaggcgagcatgcggatgcactgcccgagtcccgccgaggtccaacccgaaagctgtctcatggcgtttttcagcacccacgggttcgttttcgcctgggcctgcgtgatggtgccggccttgactgcggatgccttggcgatggtgcgcagtttcatcgcgagcgcgccgatcagcgcgatggggtccgttccctgttcgacggcggaacgcatggcgatgatggcctcggccgtgcgaccggctatggccttgtccgccacggagaaaccggtcacctgcgggttcgaggtcaggtaccggttgacgagatccagggtgatggggtcgtcatcgaaatcgaagcacagttgggagcacatggcggccatttctccggtccgctcgccgagcaccgcgacgagctgctgggcggccaatggctcgacgcggcggtgctccccctcgaatatctgcagcacgaagttgagtttcgcctccggtttcttcaggtcggcgaccgtctccttgcacgcgcccgccttgacgagttggtcgagtagccgtttgcccttgatccctccttcatgccggcagatgacgatgctggatgtacccggatcggcgcatgcctgacggcagtagcgcaccatggattcgctcagcttgtcgtcggcgttctgcagattgtcgacgacgaccacggcgacatcggcgagcagggaagggctgacggcctcatcgaatgcgtactggtcgcagccggtcgcatccaagtcgatgcgctcggcgtcgggccgatcgtgcagcgcacggcggatgagatcgcgcccggttcgcttattgagatatgcgtcaccgccgaacacgatgatgaacggggcttgcgagcctgccttgtttgccatggtctccatcttcccatacagctggacaagagccgtcatgcgctcccgtcatcgatgcgacgggaatggctcccgccgcgactttcgtgtgcggcaccggccggtctcctccgtcggtgtcgccgtcgaacatcgttacggtctgcgaccaccatatccgtatccggtcacgcagacggggacggaacgactggccgccgtcgccggatccgtcggatcgcagcagacgcaaccatcgggtggccagtatcagcaccgtggcgcacgccgattcgaccaacaccatcagcaatgcacccggtatgccaccggcccacggcatggtcgcgaactcgttgtccgacaccatcgcggcgacgcgttccatgacggacgtgccgcatcccgcaatccaggccaagacgtatccgcattgcggcatcagccaggatatgaacagcgcggcgagccctgccatggtggcgaatcccacgaccgggccgacgagcagattcgccggcaccgaggcgagaggcagttgcggatccatcaggatctgtatcggcagggtgagcgactgcgcggcgatggtcatggcgagcggagccgacagcaatcggggcagcatgcacgccagccaatcggtcaaagggccggcgaacagcacgatgcccaatacggccgcgcaggacaacgcgaaaccgtagctgaccgacatcgagggagcgatgagaaggacgatgatcaccgtccagctcagcgaactcaccgactgtcttcgacggccggccgccaccgcggcagcgccgaacagtcccatgagcaatgcgcgcagcaccgaatcggacgggaacacgactatcgccagcatcacgtccgacaccgccatcaccagtcctgtcgcccatcgaggggcgagcacgcgggagcacagcctgcgcaccagccccgcgatgaccatgaaatgccctcccgacaccgccatcaggtgcatgatgccgctgcgccggaactgctcctcgagtagcgccgcatacgcggcatcgacgccgccgacacgttccgtccccgatgacaggccttcttcagacccatgtgacgccacaccggatgcggtatcgcgcacccggaccgcatcctgcccgagcacgccgacggtcagccccggcaccagcacgcgcgcctgatccgacaggcggtcgcaggcgcgcagtagcccctgctgcatggccttgacgatgcgggccgttccggaaggcgcagaaaccacatccggcacgcgcatatcgtcacaggtcagccacagcggctgacggccatacgacgccgtgctcagcgtgccgggaaaacggtagaccgccgtgtcggtcagcgccgaacagacgtctcccgacaacagcacgcggatatcggcgcgcgaaggcaccggcgagcgttccgacagcggattcgccggggatcgccgtatggacagcgacaccacgcgcccgtcaacctggcaatcggaacccctcaccgtcgacgatacggccggggagcgcacccgcaccacggccaccacgtcggcgggcccgtcacgggcctggacatgcgccgcatcatgccagcgcacactgtccgcggtcaccgccgcggcggccgacagtagtccggccacggccatcacggccacggcatccccgagcgaggctcgcaacgggcgtatcagcccgtgtgacgccagcgacggcacaacacgaggaccaccggcagcagcatcacagccaacgcaccaatcgcataccccgtgaccgacatcgggtcatcatccatcaaggtcagccatcgccaccattggtgagccgccgccgaagccatccacgcggcgagagccgccggcagcatcctgaagtccctaccgccgttttcgcggcggatggcgaaggcccgcgatgacgggcgttcccgatgcccatcggtcgagtcgcgacgccttccggtatggttcctccgacggcggtcgtggcagccgccaccctgcatatgcccgtcatcccgcatgtaccgtctcctcatcccccacctcgcacacgcacccacggccgtatcttggtgagcgtcttcgcgccgatgccggagacatccagcagctggtcgacgctggtgaacctcccgatgctgcgccggtgatcgagaatgcgctgcgcggtcaccggccccacgccgggaatggaatccagctgctctgcggtcgcggtattgagatcgatcctcgtatctgcggtggcctcatcgtccgaaccgtcactcccctgctgcgatgatcgcccgttctgcgcagcctgactgcccgcggaggactccacgccgtctccttgcgattcggcgtcgcccgccccaccggaattctcctgatcggagcccgttccgccagagttcgacccgtcgccattcacggagtcgctgccgtcacttccaccgggtaacgtttcggcgatacccgtttccttccctcccgcgttctgcatcgcggcgttatgggattgagccgacacgtaccgcagggactgctgcagcagcatcgtcaggctcgcgcacagggccgtggtcagcaccagcatcaccgtcaccgcgtggaacgggcggaatctcagccgcggcacgtcccgcttcgcggactggcctcgcatgccgtcgtcagggcgcacacccatcagacggcttattggctcgacggcaggcgtggtggaatcggccacgtcggcatgtttctcggtatgactctcgccatgcgacggcaccggtctggaaaaatcccccggtggcggcgccggaggaggaggcacgcccgttccggcatccgtcgcgacagatgttccgatcccgattacgtcgggcatggcaggaatcccggcgtggcggccatcgtccatgccgcgcaaccgtcgagtcgccgtttgatctcctgaatgagaaatgcccatgcttccagcgtgagggaacatgggcatgaagtccagccgaatcggcctatgtggtcgaaggctcgggagttatccacattttcggcgtgtcgccggcggaatcactcggcggggacgatggagacgatcttcggggccttgacgatcaccttgtgcggcgtcttgccacccaaccggtcggcgaccgcctcaagcgcctgcttttcgaggtcggccgggtcgatgtcaaccggcacctcaagcttggcacgcaccttgcccttgatctgcaccacggcggtgacggtgtcatggccgacgtacttctcgtcggcgacgggccacggctcggcggacagggattcgtcatgcccgagcttggaccacatctcctcgcagatgtgcggcgcgatcggtgcgagcatgaggatcagaggctcgacggcggcgcgcggcacggcgggcagtgaggtcaggtggttgttgagcacgatgagcttggcgatggcggtgttcggacgcatgccctccatctccacggtcacctcggcgatcgtgttgttgagcagcttcagggtcttgacatccggggtgtcctcggtcacgtgcgcctcgccggaggtctcgtcgaccacgttgcgccacagtcgctgcaggaagcgcatgccgccgaccacgttgcgcgtgttccacgggcgggactcgtccagcgggcccatgctcatctcgtacaggcggaacgtgtccgcaccgtagttctcgtacatgtagtccggggtgacgatgttcttcaggctcttgcccatcttgccgaactcgcggttggcgtgctcgccgttccacgtgaacgtcggctcgccgtcagccccggcggggccttccacgacctcgtcggccggcacgtactggccacggtcatcggtgtaggcgtacgcctggatcatgccctggttgaacagcttgtggaacggctcggccgaatccacgtagccgaggtcgaagagcaccttgtgccagaagcgggagtagagcaggtggagcacggcgtgctcgacgccgccgatgtacaggtccacgccgccctcgtcgcccgagtacttgttgtggttcgggcccatccagtagtcgaactcgtccttctcgaccatgtgctcggtgtcggacgggtcgatgtagcgcatgtagtaccagcaggagccggcccagttcggcatggtgttggtgtcgcgatagtaggtcttcttgccgtcgcccaagtcgagctcgaccttgacccagtcctcgttgcggctcagcggcgcctccgggttggattcggcgtccatcgggtcgaaggtgcgcggctcgtagtcgggcacgtcgggcaggttgatcggcaaagccgagtccggcagcaggtgcggggcgccgtcctcgccatagacgatcgggaagggctcgccccagtagcgctggcgggagaacagccagtcgcgcagacggtagctgaccgtgcccttgcccacgccggcggattcgagccaggcgttgaccttggcgatggcgtcatcgacgcgcaggccgttaaggctcagcgcgtcgcccttggcggcggtggcctcgacggaggagttgatcacgatgccgtcgtgggagacgaacggggccttgccttcgtaattggccaggtcgtcgccggattcgggcaggggcttgacggtgtagatgaccggcagaccgaacttgacggcgaaatcgtaatcgcgctggtcgccgcccggcacggccatgatggcgccggtgccgtaatccatgaggacgtagtcggcggtgaacagcggcagcttggctccggtaatcgggttggtggcgtacaggccggtgaacaggccggtcttctcgccgccctcatccacacgatccttggcggtcttggcctcggcagcgagcctgtaggccttcactgcctcgaccggggtggcgtaaccgcccttccaatcctcgggaacgtcggccggccattcggcgggcacgttctccagcaggtgatgctccggggagacgacggcgaacgtggtgccgaacagggtgtcgggacgggtggtgtagatctccatgtccttgctgccgtcggcggtggccacggtgaagtgcacggaggcgccgtgggattcgccgatccagttgcgctgcatgagcttgaccttctcgggccagtcgatgccgtcgaggtcctcgatgaggcggtggccgtacttggtgatgcgcatcgaccactggcgcagctcgcgctggaagaccgggaagttgccgcgttcggacttgccttcggcggtgacctcctcgttggcgagcacggtgcccagacccgggcaccagttgaccggggacttggagatgtaggcgaggcggaagtcgttgaggatgttctgctgttcggcctggtcgaggtcggcccacgccttgccgtcggactcatggccggggatggccttctcgccggattcgaacttggcgacgagctcgctgaccgggcgggcggagcccttggagccggaggggttcacggcgtcctcgtcgtaccaggaatcgtagatgcgcgagaagatccactgggtccagcgcacatagccggggtcaatcgtcgcgaaggagcgacggtcgtcgaaactcagtcccatgcggtgcagctggcgggacatgttggcgatgttggcaagcgtggtgacgcgcgggtgctgcccggtctgcacggcgtactgttccgcgggcaggccgaaggcgtcataacccatggcgtgcagcacgttctcgcccttcatgcggtggtagcgggagaccacgtcggaggcgaggtagcccagcgggtggcccacgtgcaggcccttgcctgacgggtatgggaacatgtccatcgcgaagtatgccgggcggccgtctgcgttgcggcccttgccgtccttgaggtcgccgttgacgttggcggcccagaacgtgcccttgtcatcccagatcttctgccatttgccttcgatgtcctgcgcgagtgccgcgttgtaacggtatgcgggttcggtggaatcggtggacgcgggttgcgtggtcttctcgttgtcactcatagacaaggattatcgccacgcaactggacaccatcctcacgcaggtcatggcatgccgcgcatccggtcgataatcgacgtgcgacgccgacggggcgagccgcgcgcagcccgccggccttcatcattcgtcgccctgctccgggtccgacgacgccgtgtccgacgatgccgcgggatccggcggattgagcttggagtcgacagtgtagccgatctgccggcgcatgccccgcacggcctgccgccacgtgccgtcgccgatcatgtcgctcagtatgtcaccgatgctgtcggcgagctgcgtgttcccgtgcttgaccgcgatgccgtatcgctcctcgccgaacggagccccgaccacctgcacgtacccgttgcctttcacggtcgcgaggccggtgaggatggcgtcgcccgcggctacggcgtcgacgtcaccgatgagcagcgacgtcaggcactgcccgtaatcgtcacgctcctcgatggacgccttgggcgcctggctgcgcacggcgtcggtcacgtcgctgccggcaaccacgcacgccttgcgcccgttcatgtccttgatgccggtgatgtcgcccgcgtcggcggccctcaccagcagatcctgccggacgattagatacgggccggtcatcgtcaccgccgactcatgccgttcggtgatgccgaagctggacaccaccatgtcgacctgcgcgctttccagcatggagacgcgggaacggggcgtcaccggcttgaagacgatctgcttgtccgcgtatcccagcgccttggcgacgtaacgggccacatccacgtcgaagcctgaatacccgccgttgtgccatacgcccagaccgggctggtcggaggcgacgccgatcgacaccgtgggcccctccggctgccgtatcgacacgccgttcgcatcattccgggaactcgaggagccgcaggcggtcagggatcccgcagtccacagcaccgcagccagcgccgccgaaaagcgacgcatgatgcgccggtgccccgccttcgtgtgttgcagccctgtcatgccgttcccgtcatttgaacatgcgcgaacgggtcaggaaccacgcgacgacggcggagagcacgacggatatcgcgatgatcagcgtgaagccccatgtcttgccggtgaacggcatgcccagctgccccggcacgaagttcatgccgtacatggagaagatcagcgtcgggatcgacagcgtgatggagatgatcgtgaagatgcgcatcacgttgttcaggttgttggagacgatcgaggcgaaggcgtcggtcatgttcgcgagaacgccgctgtagatgttcgccatctcgatggcctgcttgttctcgatgatgacgtcgtcgagcaggtcctcgtcgtccgggtactgctggatgcgcgcgagcgtggtcagcttctccatgacgatctcgttcgatttgagcgacgtggtgaaatagaccaaggtcttgctcagctcaagcagcatcatgatctcgcggttctgcatggcgtgacgcagcttgaattcgagcttgtcgctttcacggtcgatgatgcgcaggtacctcaggtatgtgctggcgttgcggtagaggatctggaggatgaagcgcgaacgcatgaacgtgttgaaccctcggatcgttccctccatgaacgggtgcagcaccggcgtgtcctgcatgcatacggtgatgatgaggtcttcggtgacgatgatcgacagagggatggtctcgtaccagtcacggcccccgcgctcctcgacggtcgggatgtccacgatgatcatcgtgtaatcgtcctcgacgtcgatgcgcgaacgttcctcgtcatccaacggggcgcgcaggtcggcgaggtcgacgccggtctgctgggagaccgtggcgagctccacgtcggtgggttcggacagacacagccaggagccgttctcaggtttttcgatctgctccacttggccgttaatcgtgctgaacatcctcaacatgtagtctcacccacctctcataaccgaacactaccgaacatgaccggaccgcgggcggcatgtcacgtcgtctggaagcctcaacaaggatagcccttatgccacgacttgcaaatccgccgcggccggccccgccgccggcctcacccctcgatcggcttccacatcggcatgtgtgggccgtgcagggactgcgggccgttctcccaatcgcacagagcagcgaccgccggcccctggttgaacgccgtcatcatccattcgacgccgcccgaaggccggtataccggtctgagcgtcgaccagaacgcgttgcgcatgccatccaggttgctcaggttgtcggggtccatgccgagcagggtctcgatcgtggccacatgccatgagccgtgcccgacgagcatcagggtggtcggctcatcggcatgctccgcgttgatgccgcgcaccaggtcgagcaccgcatcggcgccgcgcagtcctgtggcgatgcggctctccacgccgaacgcgagctcgccgccggtgtggacccgccacgaatcataggcgtcggcatgctccgctcgaatctcgtcgcgggtcatgccctcccactgcccgaagctgcgttcgcgcaggcgcgcgtccgcggtcacgtccagccccagcatatcggcgaacgcgtgcgcggtctgcaacgcacggaacaggtcggacgagacgacgaccatgcgtcgcgaggatgcgggtacctgccggtattcctcgatgtcgctggatttcgccgcccccggccccggctgggccagcgtatccggatgccgggcgatgttggccaccttcgcccagtagtagcgtcgcgcaagctccgacgcgctctggtcggcctgccactggccgatgacgtcgaggggcacgtcgatctgcccctgcaaccgcctcgccacattgaaggcggtccgtccgtgccgcagaaacaccacttcgtcaatcatgttcgtccttaccgtcgccgcatgaatccgtgccatcacacatcctacaggcatcgacctatatccgatcggctgtaacaccgatggcggaatgcgtccggcgtcacgatgcacccgcgactacagggatatcgacgggaccacggccgccgggcgctcgtcgatcgcggacagtccgctcacatcggacgcgtagaaccgcgtgaggtcggcggtgaacttggcgaggctcgcctcgctgctgtagagcatgtgcccggccgggtagtaggcgaaggccacgttgcggcgcagcggcttcggcagcatcaggtgatcgatgtcgtattcggtctggaagaacggcgtgcacaggtcgaagacgccgttgccgagcagcaccttcatggtcggctggtgcgcgatggccgcggccagatcgggcaacacgttcggttgggtcatgacccagcccgattcgccgggcatccggtgccaccacatccagcccttgcccggctcggtggcgttccagtcgaagtcggcgaagcccttgcgctccggcatgcggtcccagccgagctcgtcgcgcagataggcgttgcacaggctcgaatacgcggggtcgagccaggcgtcgtcgacgacgaacgtctcctcgtcgttcatgcggtcgaggtcgtagccggcgacgcggccatcgtagcgtccgacgatcttgtcctcgtcatgcagcagcgccttgcggaacctcggatcggacacgcgcagattggaatcgtagacataccgctcgtccagtccggtcagctcggcgtatcggcgtgcgaccttatgccgggtctcgtcgtcaagcgagtccccggcggccagggcgagacgcagcggccccgcggcgaaggcacgggcggccttcagatgctcgtcgagcttgacgtccgacgcggctcggccgtgatatttcgccacggacgcataggacgggaaatatccgacgtagaattcgtcgatcaggtcggacgtgaacgtgtagtcgagcacgttggagatgagcgtcagtccgttcagcgccacaccgtcctgctgaagccggtatgcgagcgccgcgccgcgcgtggtgccgtaggattcgccgagcacgtatttgggcgagttccagcggtggtgtttgctcaggtacgccctgatgaacgcgctgaagccggcgacgtcgccgtccaccgaccacagttccggcttggccgcgtcgaggatctcggagaatccggcgccggccgcgtcgatgaacacgaggtcggagacgggcagcagcgtgtgcgcgttgtccacgagcgcgtagggggcggccggcaccggagcggcgtcggggacgttgatgcgcttcggggcgatcgaacccatgagcaggaacgtggtggatgagcccgggcctccgttgaagatgaacgtgaccggtcgggccgggtctgtcttgccttcgccgtttacgaggtcgaacgcggtgaagaagatgctcgcggccttgggtaccttcggtgtgtcgatgagtatcgtgccgacggtcgccgcatagtcgagttcgccgccattgacggtgatgctgtgtctggtggtgtgctcgcatgcctccggcagctgcttgccctgggcgggtgccgccgcgacgggtccggcgttgccggcgttctgggtgttctgggtgttcgcgtcgctcatatctgtcgctccttggatgtcagtgcaactatactccggccgggcaggccgtcctggatcctggccatggtttgccgcgtcatcggcgccgcctattcggcggcgtcatccgactcgacggtaccttccggctcatctgcgccttccgtctcatcgatgccgtccagtctggcttcgtgcagcgtggtgtagccggtgtcggggtccttgcgggtcacgtatgccttggtggagacctccagtatctcgcccgtcttgctttcaggggcggagacgatgacctggaaacccagtctcggcagtacggacagcgcgcgccgcgtataccggccgtcggccttgatgagcgcctcgtcaaggaagagcgtcgtgtaggaaggcttgagcttgttgtccatgccgccgccgagcaggtagatcagcgccgcgccgtacacgaacgaggtcagctcctgcagggcgccgccggaccgtccgccggtcgaggtgatgcgttcgacctgcccgtccgagtggcgcacgagcgcgtagaacgaggatcggcaccgcgggtcgaggttgcgggcgccgtagcttttcacgccgttgacgtccctgatctgcccgatctcgcggcgcagcatgtcgatcatcgcggcgcaggacgcgaacgcgcaccgggccccgtcaagatcgtcatccgtctgtgccgccttgcggtcgttgagggtgccgatcacgcgggtcagggccgaccagaacgcgcgctcggggcgccgcacgtccgcgtgcagggacaggctgccgtggcgcgggccgaactgctggccgtccagcatcgcgttgatgcgttccagctggtcgtggatatctccggcgtcggtgtctatcgcgcgtttgatggtcaggaagctcatcagcagcttgtcgaggcagttgtggtattcgacggcggtggcttcgacggtggcgagcttcgaaaggctttccaactcgtcctggtaataccggtagtcgtccacgctggcggcgatcgtatcgtcaccgcccgcatacatctcgatataagcgcccatccgcgcctcgacggcggtgcgggccgatgccgcacgaccttcgagcatggagacgcgcgcctccaggtccttgccgatgccggcgatgatacggtcggcgaaggtatccccctgagccatacgctgcggcgcccccgcgccgatgatcatgtgggcgcgggtcgtcgcatcccccagaccggagagacgctgctcatacgattcggcgagcgcctcctccacctcgtccgtcaggagagtccgtccgttcgtgacggcttttggcgaaacgtccgccgcttccccatcgagcggccgcgtctgcggttgcggctgcggctgcgcggcatgctcgtcgagccatgcctgcgctgcgttcaccgcctgatcggcgagctcggcctgccgttcgatgtcgatgcgctggcgctgcgagcggtcgagctccttggacagcgactcctgcaacgtgtcgagttcggcgagcttgggattgttcctgaccgaggcgatggtgcgttcgatgtcggcgatcgccgccttcgcgctgttctcgtcgatcttctcccatgcggtgtatgcgagctggtcggcgagttcgcgctctcgctgcaggcggtcggcctgttccttcgcgctcgcgtacgattgcgcggtctcgtcgcattggcgttgcgcgtcctggatgcgcgtgcgcagttgcgccaaatagctttcgttgacgaatccgatgacctgctgacggtccttgatgccatgctggccgcgtttgccggatttgatctgcccgtcggcctgcacctgccgcacggcatggtcggagtcgtcgatgccgtcgacgcacagggcgtcgagacgctcggagctggtctgctcgcgcagccagccggcgaacggggaatcctcgcggtagcgcagcttcgaggacagccacacctctccggccgttccgccggtcgcacccgtgttcgcgccgccgggcccgttcccggctcccccgcgttcggtgtcgacgaactgccaggtgcgccgcgccatggcgtgcgggtcgatggcgctgaccttggctgcgaatccacgctcatggcgcttgtcgacgaggatggtctgggccatggatccgtatgcggcgttcatggcgaggcgccaatgctcctgatcctcgcgcacgtccatgagctccgcgacgtacggcagttcgctcgggcccagcccggtggcccggcacagcatggcgcgggtctcgtccatctggcgggagatgcgggtgcgctgcgatttctggcgttcgtaatcgtcgttcagccgctgcagcgtctgcttgacggacgcgtgcgcggcgtacgtctggttgcgcatgtcgtccagcagtcccttgcgctgctcatatgagcgcatgaacgtcacggcctcgatgcgccgctcgtcccacgcgtgctcgtctttggggaactcctcgccggccgcctcgaacatgcgcccgatgcgctgtctgccggcggtgatgtccgccagcgcgcgttccgcctgccgcatttccgcgtcgagccgtgtcaggtcgccgccgtcgaggcctcgcatgcgctcgcgcaccgcgtcgatgcgggtgcgcaggctttcgatgcgcttgccggcagcccgcgcctcactgcgtcgctcgtcacgcagacgcctgtcgagcggctgccgttcgttgacctcgccgatcatgcggcggatcgcccatgctcggatcgtcgccgagccggacttcgtggccgggttcaccgcgtcgaacgagtggaccgcgtcacgggccgactcgtagtcgtcatagctggcggtgatggcacgcaacttgcccatgcgtctggtcttttcctccatgcttcggaagttcgcgtcgtaacgctcgtaatcctccacggtcgcacgggccaggtccagcgcctcgggcacgcccagcacgccctgtttgaagatgtcgtcaaggcgggagggggcgtcggccgactggatgcgggccagcagacggcatgcctccgcgctcaggcccatgacatcccaaatatgggtgtggaacgcctcggcgttcgggaaggtgacgcaccccggatacgtggatttcagctgcgtgggcgtgaacgacgactcgcggaacacgtccatgcggcgcgggtcgatcggcttgtcccatgccaggtacagccgtcggacgtcgccgcgcccgtcgccgggcatcagatagaggaacttgccgcaggacagtatctgaccagtggtgaagttgcggtaggtgtcgacgatcgcgccccatatggaccggggcgcgccggactcgtcccggccgcgcaggtacatcggttcgtcgacgccgtcggagcctcccacgccgatcatgccgcgcaggtaggtgtagtcgcttcgttccgaacgccccgaattcgacgccttgttgaagggcgtgccggtcgggtagagcagcgatatctgcgcatcgaccagcgtcgacttgccggattcgctcgcgccggcgagcaacgtcaccggcagttgcgagtccgtggagggacggaactcatggtagccctcataggatccccagttgacgagcctcctgctttccatcatccatcggtcggcgatcatctgcatgtccttgccgctcatcgtcactccccttcccgtgcagtgccgccgtccgaggcggtctcgtcgtcaatgtcgctgtcgttcgcgccattggcatcatcggcgcccttgatgtcctcggcggcgtccgcatcggcgtcatcatcgaacagcggagcctcgaacagttcggcgtcgggtcccgcatcgtccgaatcgccatcgtcatcggcgccgctcgcatcggcgttcgacgtatcgccggctgcagaccgcgagccggccggggccatgtcaccggccggctcgtcatcgtcgtcccggtccgcgactgcgagccagctgtccgccagctgacggtccagcaccaccggcaccagcggcgtgatgcggtacatcgtctcgtcatcgtcgagctgcctgagatagccgtacgtgcacatgacggacacgatcgcacccacctgcctgagcacgccctcctcgtcgttgcgcgaggcgaggtacccggcgccggtggcgagcgccgctcggatctcctcgaagctgaccagccattcgtccggcgcgacgtgggcgttctcgtattcgagcacgcggatgcgcaggaacgccagcagcgccgcctcctcacgtttgaggctcgcacgggtcttgagcgcgcgcagcgtcatgtccggcccgctcaccgcggtggcgtacatgacgcggtagtgctcgttgacgaccagatcgagcaggtcgttgttgagcgaacggatgaccgccgcgcggttgtcgagcgccaggtcatagaaacgtccgctgatgtagcgctcgcgtttgagcatgatcgccaccatgcgcgcgtcggcggtcatgtcgcccgtgtcgccctcgaacagggcgtatgggttgaccgcgccttccgcgtccgcgccatcgtattcgacgtccaccgcacccatgtcatccgcgccggtactggcactgtcggtatcggcactgtcggtaccggtcatgtcgtcgtcaatcatgtccatgtccgcgtccggctgggcggcgtcgttcgtcaggtcgctcatgtcagtcctccttcacgatgtcgtgcaattcatcctcttgtgcgagcactgggccggtgatccagtccctcgggcttccgtctgccgatatgcaatgccatgcgacgccggctccgtccccgcagccgagctctcccaggaaaccgacgagctcgctttccttccgctcggctttcggcagcccgttgaagctggcgacgatgtcgatggcgccgttcccgtcgtccgcgtagacgggcgattcgaggatgagcgcggccatgcgccgcagccgcggtcccccgttgtcgatcatcgaacgcaggtcgggcgcggtcgcatcgcccggtgtctgcgggacggacaatcccggggtggtcgttcgtaccatcgggcgcgcggggcgcgacggcagcggagggaacctgccggccgcggtatcggtccggtacggtctcgcatcgtcgccctgatgcgccttcgcgtcggcgttgacgtgggcatacagacggttgagcttgccgagcatcgtgcggtatcgggtatcggtctgctgtcgcaccagacggctgatcgcctcgtcggatacgcgcatctggcgacgcaccgcctcgatgccgtcatagatgcgcgaaagctcggcacgcacctgatcgagcaggacgccggactcgccggccagatacggcgtgtgggcgatgtcgcgcagggccgcgtcgatctgctgccgtccctcgtcggtgatgatcacctgaaacgcgtcctcgaagcgtcttccgctgtcggactcgctgaaggacctgcggtattcgtcgtggtacgaggtcaggatgtcgtcgacgctcatgtcgcccgcctgcatgcggcggcggagcgcgtcaccgttgtcccgttcggtcagcacgagttcacgcaggtctatgggcacgccgcgcagcgtgttgtgaatcactgcaatcacgtcctcgacctgcgattcggtgagcgccgcctgccgctgaccgtggcgtatctgacgtatctcgtgtttgcgcgccttgatctcccggttgagcaacgccacgcgctcgccggggtcggcggtaagctgcatgcgcgcatgctcgatctccatgatgatcgagttcgcctgcgcgcccgacagcgtgcgggagtcatcctcaagccgcgacagcgcctcgatcgcacgatgggcgcgggcggtgagacggtacaggaaccggtgcgacgcggcgtcatgcgagttggcgagccatgcgtaatcgtcatcgccctcacgggtcaggtcggcgaggatgcgccgggaggcgtccgcgatggtctgatcctccctgagctggtattcgccggagtcgacgagccgggacaggctttgcgagaagctttcctccagggtctcacggggcagctcgccggtcaacgggtcgaaggccgcgcggagcagcgccacgtacatcatcgaattctgacggagcagcagtctcagcacgccggtttcatagaccggcctcagccgttccatctcccgtcggatatcacccacgaaaggcctcgctttccactcgtcctggctcggcgcgcgtcacgttcgccggacaaaccacgctagcacaagacggcgctatcggcgtctcccgtcgcgtcaccgccacggagaacgcggccgcgcccactggtacgctcactgcacgagaccgcgcagcagggcgatctcctcgcgatgcttggtctcggtcagttccttggtttcgaggatcatcggcaaccgtgacagacgcgggtcgttgaccattctggtgaagaacggaatgccgaggtggccgtcgccgatgttggcgtggcggtccttgtgcgatgacaggccgaactgggagtcgttgacgtgcaccgccttgacgcgttcgagcccgatgacgtcgtccagctgccgcatcacgccgtcgaagtcgttcaccagatcataaccggcgtccagcacatggcacgtgtcgacggtgacgcccacgttcgccttgtcatcgacgccgtcgatgatggtcgccagctcctcgaagtttcgcccgcattcggtgcccttgcccgccatcgtctccagcagcaccatgatgcccggctccagcccgaacacgcggttgaggccgtcgctgatcagagagcatccgcgatcgggcccttgccccacgtgcgcgccgggatggatgttgatgtatatctcctgcccggtctcacggatcggcgtcagcagtcggatgtcctcggcgagcgcccgtatggcgaactcgcgcttgtcgggatccttgccggcgaggttgtagacgtagggagcgtggacgacgagcgggccgtaatgctcggccgtcaactgccgcgcgaatgcgacggccccggatgggttgagcgccttggatggccgcccgtacggtgagcgcgggaagaacgcgaatgtggtgccgtgttcctcatgcgagcgtttcagcagcgcgctccacccgcctgccgtggacaggtgcgatccgatatacagttccttcatccgtgttgtcccttcattcgtatcgtttcccggcgatggttcccggctgtcgtggcgggtcggcgccgttttcatttcgccgcagtcgcatcctcaagataatcgcgcagcaccagggcatgattgacctgagggtccttggcggcgtacagcaaggtcacgtcgggatactccgcgcagatgcgcagcagttcctcggcagcagcgttggcatcgagctccgcgatgtattgggcgcgaaattccgcgaatctggcgggatcgtgcccgaaccacttgcgcagctggggagagggggcgacgtccttcatccacaggtccaatgccgcgcgctccttcgtcatgccgcgaggccacagacggtcgaccagcacgcgatacccgtccgacgcctccggcgactcatatatccgtttgattgcgatgcccatgcgtcccatgattggcttgcgcacgcgggatgtcaagcgtacataacgcaacgggatgccaaaacttggagatacgaccgttttcggtgggaaaggccccatacctgcgagttttggcatcccgccgcacgcccccccctgatacggtgttattcttgtccgtacccgacaggcaaacgaacgagaggcatcgccatgaacaccatcgagaccgaacgactgctgctgcgcccttggaaggtcgatgacgcggctgaggcggcatcgctgttccggtatgccagcgacccggaaatcgggctgagatgcggctggccgccacacaccagcgtcgaaggcagcatgcatgacatacgcaatatcctcgcggtcgaaaacaactgggccattaccatcaagggcggcgcgccgaacagcaacgcgcctgtgggcagcatcgcgctcaagcccgtcagccaccgcaccgccgacgccgttgccgccgatcctgaactcaccaaacgctacggcaagtaccttggcgacagcgcgctggaactcggatactggatcggccggccgttctggggcaagggatacatgcccgaagcattgaccgccgtgctcggctacgccttcgacacgctgcgcaaggacgcggtatggggcggccactacgccgagaacacgcaatccgggcgagttcaggccaagtgcggcctgcacgtcgtcgccgagtcgaaacaggattatttcccgctcatcgaccgtcactatgactgcgtctaccgcatcatcaccgcgggcgaatggcgcgatgccgaacaccccggcagatggcgaaggatcgcctgattcacgaacgggcgtctctgcggcaacggcatataatgcaagacatgacgacccgcattgttcccatcgaaccgcagtggttcacgcagaaggccgaagtccaatcgcgtacatggcgcgagctcaatcaggggcatatcccgcaggacatcgtggatgcgatcaccccggcattcgcactcaagctgacccgtggccacgccgccgaccccaaccaggttgtgctgatcgcgttggctgacgaccgtgtggtcggattcatcgaactgctgcgcactccgcggcccccgatcaatcggcccgaggccgcggaactggcgtcattgtacgtgttggaatccgagcatcgccacggagtcggccgcgctctggtcgaagccggacggcaggcagtcggcaacgaccggctcgtcttgtgggtcgtcggtttcaacaccaacgctcagggattctaccgacacatcggattccacgagaccggactgacccagaccgaggatatggggccggaactcgaaatgatcaactactagccggccgctggtccagctgtcgttcaagctgctgcgcaagacgctgaacgtgaatgcgagtggcctcgttggcgaagtctgcgcacgccttgctgccgtacagcgccgctccacacggatcggcaaagcgtgggtcgccgcacagagcagagcggacgacgccgaacatgtctgacaacggcatggcggcctgttcttccgcatcctgcggcacttgggccttggcggccttggccttgatgttcttgtccataatctgcgcggccagccgttgcacttccggcgaatccgacgtgactcccgtatcgaacaaccgcctccattgctcggcatcggcgagcatggaatcctgcgactgcctcagtcggctttcgcgaatccgtgagagccgactgcgctcctccgcatccagccgcacccatcgctcagcggccgcgacgctgccaacaggatagatctttacgcggcgtcaaccgaaagacgcgacacgcgacgagtcgaaagatttcgccgttctcccccgatccgggacgagaacaccgaacaaatatcattcccctcccggcatgaccgacaatcagatcatgcggaccgtaccacactaggccattttcacccgaatatgacgtggtgtggcacgcggtggaataacggcgaaagacggcgaatgacaaaacgctgcaaaatggcggttccgataaatcaacgctggccacaccagcgaatgttaaggaaaacatcgcattgtgtggcagaaccgttgccgcacaatgccgatctgggtcattttcgcgctggtgtggccatgcgctcctcattcaggtctcagcgtgacaatacccgcgcacagtgatgggattcactcgaacagcgtcacccagtcggggtcgcgatggccgcgcgagtatcgagtttcggcgtcgggtatccggcgccgagcggccggcgcatctcttctgccggcacgtcggcctgcatggcgagcatgtcgaccgctatcgcgcggatgcgctcgtaacgctcccgatcgaggggatccttgcagtacgccaatccggtctgggccagtgcctgcagctctctggcctgctccagcaacgtgcggtctgcggcgatcatggtccgtccgtcctcccatcgcaaggtctcatatccgcctaagctcagccattccattacgacgtaattgaccgtcagcatgccgattcccgactcagtttccatcatgcgtaccactcgggccgtctcagtcccagaaacggacgccgtttgcgggctaccgcggtctgagagatcgatgtcggcaatgaaaggaggaggccggcaaggatctcggcatcctcaacctggccaccacgctcggccaggcggtggggccctccatcacctcggcggtcaagaccgtgaccggcacctttacggcggcatttgccatatccatcgtcatggccccgtgcgcggccggcttcgtgctgagccttcgaaaagtgcgatagccgtgacggcttggatgagattcgagaactacgttctgatcacgccttgccacccatcatgtcaatcgtgcgcccgtcacctgtatttgtcgcgagtcgaactgttgcaacgcgtcgcctatcgatgcgagcgatgccgccgaaacatactgccgacacgccatcgaacaaatgtttgagcatattgatagattgccggtactgccgagattctggaatgctatctgccgagtctcgagctgctcaatgactatgacacgggcaatgcctcccaagggcgacgacgacgccctgctcgtggaaggtaacgccttgacggcaatggcgctgatgatcgcgctatccgcgcccgccgagaaggacacgatgatcgcgttggtcgagaacttcctcatacgccatgaggcaaaggagagagcacaccacgcatcagcaagttcggcgacattctagaccaccgtgaccatgacagtctcctgcgcttgtgcgtcaccgaggccacgctgccgcacaagcgccgaggcacgaacccggccatcacaccaacggttcgcgtgcacgcagttcgcagatggtgccggtctccttgcgcacccattcggctgcttgcaacgcggcgatgttccataatgcgcacggcactccgcctaggtccgggtgcgctccccagaacgtgaggtcatcgacgtatgcggtgatgaccgacccctccgtgacgggcatgatcgtgtgatacaaacgatccgccagcgtcgccacgaattcattggccatcgcgaacgtatcgatgagatgctgttcggcggtcaccggcgggccgaccaactcccaggcttcgacgtccgtcgcgctccaacgcgcagcctcgccttccacttcacgctgcaatgagacgaacagcctggcgaactcatccgaggtcagtcctgtgacccggcgtcgggtcgacaattcaatcggagtcatcagctaccgttcctttcgtttcacccacccataccattatcgtcgaaaacagcaggcccggactgactgtaaggtgattgagcagctggacatcagcttcggttcttaaatcacagcggcttgacgaaatcctcgccgttgaaacagccggcgatggcgttgcattcgacgacgagtcgcggatcgatggcgagcgtatgatatgaatcttcgatcgccgtctcatgctcgatgagctcggcgcgaccgccatgcgcggcgacaaattgcctgatcacctcacacttgctgttcatagccgtctgccgtcttgtttgccattgagtccaacagtcgcacgaccttgaaatgctcgaacaccacaagagagtcatcgttcagcgaaaaatccgggtcagcgaactcgttgcggtattccggcgcgttccagaaggactcgtgggtatgcctccatgcggcagccgtggtgtcgccctcgccctcatcgatggcgtgccggtcggtgatcttcccaagcggaataacatcaaccgcggtggtgacgagtatggccaccggccgttcactggaatccaccagtgccgagcgttcgccgacctgcggcagcggttcgtcatcctcttcgtattcaatcatcaatgcggcggtcgcggtcttcgttccggcaagaatgagccctaccagacggtcacgttcaggtccggggaacatgaattccgccttgggcaggttccccggttcgggtgccgtgctgatgcgcgtatagtattccagcccatcctcgtgatcgatgcgagccccgcaatgctgctgcaccgcaagactcgcccggttgtccttatgaacgctcaggtacgcctcgtcaatgccgagctcacgcgccttgtcgagcgtgagccgcaagccgactgtggcatatccacggccgcgatattgaggggcgatgccatagcctatatgcccggctccgacacgcagattgtcgttcaggcgatgccgcaaattgaagattcccacatacgcaccctcatcattgatgagaacgtacttgctgctcggcacccagccaggctgcagaccgatgccacgcgattgttcttcaagctcatgcacatacacggcgaaccgctcgcggtccatgccggccgcctggttctcgaacccgttctcgtccgccggaaactcagagaacagctcaaacgtccgctccggatccgcccgccacacttccgtcaaccgcattctcgccctttcgtttccgccatactagcccacccggataacagggtgcggacgttttcttggagactgggcgaaaggatatcatatgtccgttgccgggcggcatgcggcggaagcgggccgccgaactgttcggcgcgggcgccggcctgcggcgcctgtcggacagggagaagaccctgttgatcgaccggttgaggccggcgtgttcgctcggctcgatgacatgcttgcccggcatcgcgccgggcggccggggcgttcgccgcctccgagggcgggtacgggtaccgaagggtcaaggccatgctccgaacccgcgtctcggagaaggtgctccgcagccccatgccataacctgcaccgtccaagccggcgaaaaccacaccatcatcaccatcgataacaccaccagacctccagaaaacgccgcggacgcagaggacctgatccagccgttccaccgcggcgacgacacccgcatggccaacaggcccgggcacggactcggcctgtccatcgccaaggcatgcaccgacgccatgcaggccacgctcgccgtcagcaggcccgcacccggcaccttccgagccgaaatcaagctaccgaacaggccgacgcagcgctattgcccgcagcagaaggaacatggacaccgccctcatgccaggcaataggcataatcctcctcattcagccccgtttgcatcttccccgcgacgtgtgtggcggtcgcaattagacattctcggtgcacagattcttatcatagactggacgaatgtgtaaaagattcgcgctcgacctggattgggacgccatcgcggcgcaattctcggtggccaaggaagacgtgcgcggcgacgttctcccccgcccctcgtacaacatcaccccaacgcagaacatcgccgtcatcgcgcagggcaaagacgggcatcgacacctgaccggcgcatactggtcgctgattcccagctggagttctggcaagaccctgccctaccccacctacaacgcgcgagtggaatccgctcacgtcaaatccaccttcgcggaatcgacccgctcccggcgcacgatcattccggcgtcggggtattacgagtggaaggggcggcgcccgttctattttagcccggaaatggaatcgacggcgcttgcgatggccgggctgtattcgtggcggcggccttccgcggcatccctatggcagctgacggcgacgattctcacgtgccctgcggtggatgggccggcgacggtgcatgaccgtatgccgctgctggtgccggccggtatgacgtccgagtggctggatccttcaatcgacggcgcccgtctgctcgcgccgatgcgcaaggccggtgccgagctgtccgcgcggctgcatttccatgaggtcgctccgccggagggcgacgggccgagcctgatccgtccaatcaaccgcgaggagcccatgcggctgttctagttctgccgcagatcggcgcttcttccccgatacggttgagcgcacggccggcacgggcagcctccgccgacaggctgagccgcggcggacgacggagccgcgtgtagacgaacgcaacaggcgtttgcgtccttaagtgcgcgccgaaacgacgaccgcgcgcacttagggacgcaaacagggccatttgcgttgctatgtgcgcgcacttgccggttcggcgcgcacttaggaacgcaaacgcacggaaaccgcgactcatcgtcgacagcccaagccgaccccgccattttcaccgacccagccggcccaaccaacccgtcatctcccaccggcccgaccaacggtgggcataccctgagcacaggaacattcggtgaaagccaacggagggggtcatggacgtgtcggacgtcatcgcgcggcgggagttcatgccgacgtacatctggctggatgtggcgtttctgattggtttcgcggcgttgctggtgtggcgccgcaaatacatgacgctgctggtcgggctggtgatgggcggcgtgtatttcgccgtgggctatggcgcgttcaatctgctgacgcattcacgttcgatcagcggcggcagcatgttctgggtgctgctgtggatgagcgtaagttatgggttcacgaacttctcatggctgtggttgtggctgagccgcgaccgccatctggcggaatggtcgatgctgattctcgtctggtggttctgctgcccgttgatgtcgcagacgtttacggcccggttcgcgtccggcatgcagccgattgtcatccaacgcacgaccggcgcgtaccacgggtggatggccgtcatcctgtcgcgcaggcgtatggtcggtcatgcggtgtgccgccgatcggcatggatacctgccgatcaggctcgggaccgtcgaagatatccgaaacacctgatgtacgaacgtaccggcatcagcccgacgctgttgtacagtcgtacaacaatcgttcgcaccgcctgtcagcgatggttttcgaaccatcccgcccagtcgacaacggcctcgatgttgttgccgtccggatccagcacaaatgcggaatagtaccccagatgatacgggcgcggtcccggagcgccgttgtctcggccgccgacggcgagcgccgcggcatggaaaccccgcacggcctcacggttcggggcgaggaacgcgatatgcgtgggcggcggcgcgagcgcggcatcatccagcgcagacacgtagaagtcggagtgcggcgtcccgtcatccacgccgaaacccaacgtgggctcgtggtgggccttgacgatgtagccgagtggcgcgagcgcatgctcgtagaaagcgatgctgcgtccgacgtcccgcacatgcaatgtgatgtgatccaacatacctgccactgtacgcgcagcataagtcacatgacagcagtattctatccgcttgttatccgatatcatccgcccaaagtcccatcttgggcggagcaaatgggactttggggatgatggggcgcttcgcgggatggccggaacggcggaagacacgacggccatggcaacgggcacggcaaacggccacggcaggcaggcacgcggcagccacggaacatgcttctcgccacgccccgcacaaatcatcctgcgggatgccatggcatcgcagcatcatatggcacgatagacacgtaacgacacgcaaaacagatacactgcgcggaaacgactctggaggtgagcagatggccggacgacgaacggctcggcgaacgcgatcagtctcgcctcgtgatgggcaaccgccgatccggcatgagctgtcgccgacatggcacgcacgacccgccgcgcgtcgggaacggccgcgtcacggcatgcgacggaccgtgatcatcgtcgcggtgatgctgtgcgcggccatcgccttgttcgcctcgattccacgactgatgcgcttcgtatggcccgcttccggccctgaaccacgccgggcgtcggacgcctactgttccgcgacgctgtcttccggcgacaacaaggaaatgctgtccgttgaacaggcattgaacgccgaaatcatcacgagggcggcagtcaaacggggcctgcccgatcatgccgcgaccgtcgccatcgccacggcgatgcaggagacgcggctgatgaacctgagctacggcgaccgggattccgtgggattgttccagcagcgtcccagtcaggggtggggcgcgaaagagcagctgatggacgagacgtatgcggcgaacaggttctacgacgagctggtcaaggtgccgaactggcagtccgtccccgtcgaggacgcggcgcagtcggtgcagcgttcgcaatatccggataggtacgccgactggaccaatcttgcgcggacatgggcggcgggtctgaccggcgagaccggcgcgggtgtcgcgtgcgcgctggagccggcgcagccttcggacgcggacatggatggtctgaccagtgatttccgcaacgaattcccgaccgtcatggtatcgcagccgtcgagtctggagccttcctcgaagacgcaagacgacggcggcgacaaggccgccgacaattccgcggccaatgacggctcgggcaagaccacgtccaagacactgacgttcacaatgtcggccggaaccgacaccgaaaacgggaaaaggctatgccgccaagcgacggcctggctggtggtccatgcacggcgctacggcatcgattcgttgcgcgcgaacggcatgcgctggaaccgcacggacggcgtgtgggccggcaccgagaccggagatctcaccatcacggcgacgctggcctgattccggccgctgtcatgacatccacacccgccgcccggctggtataagacacctggttccatctcacggacagcgcgcacagtcaacccgtgcgtgcagctcattcgcacatcgccggcgagtccggcaaagcgagacgctgcgcgacacgcccgaattgcgtagcagaactgcaagcacgcatcccggaaaatggcctttttccgtcattcccgcagaacatgtaagacagtcctgctacacaattcgggcgtgtcgcacgatgaacccctgtcagtcactcactcagcgacccgatttcgccgcgcggatctcatcacataggcaccgatcggaacggtcatcagaccgccgaccacgaacagcagacgtacatcgaccacatcggcgagcgggccgaacacgagcatgcccgcaggcactccgaatgccgagaccgaggtcagcagacccaatactcgcccctgcatggacacgtcgctctccttttgcatgagcgtgtacgtgggcgcggcaagcctgtcagcggaattggagagcacgacgaaaccgaaatcgatgtggcgcgcaggggcgtcatccgagctctcccccggacgacgaagacgggcatcatccaaacgaatcagcgcgacgaagcctatgccgacaatcgccgtggacacgtcgacgagcatgatcatccacaatggcatcaggttgacgagggctgcggcgattgcaggagaggcgatgctgatcgccgtctgcaacgtgccgttaatcgcgttgacgcgcagcaaccacgcctccggaacgatctgcgggatgaacgattgcacggccggggtctggattccgccgcctgccgaacgtatgaccagaacgacaagaatcagcccggtatcgccccagccgacggccatacttgccgacaggcatatggtcacggccgcgatgacggcatcgggaagcatgaccaacagtttgcggttccatctgtcagcccagacacccccgaacacggagacgattgcctgcggcagggcggcggcgaccatcgctccggtcatgaccatgccggagttcgaccgcaagaccaggtaccagaaaatagcgtattgcacgacgctggagccgaacagcgacagcgtctgttcgacggtctgccgtccgatacaatgcatcacagggagagccgtccatgtcgttcttgttccgacaccgcgatcctggatcacggcatgtctaccgctacgggccgctgcgcatcacgtgcgtcgacagggacgtgccgatcgacgtgcgcgtcaacgcccatctgatgtacaaggtcgtgctctcttgggaggacaaggcccgatgcgccacgccgttcgacatgatcgcccgtgatctcggcgagttctggctactcgaccagtggtccactggtaggcctgcacggctggatccgttcgccgctcaattacggttcgagcagaaccatcctgcgactgttcaccagcgcattcttccatgccgcccatgcccgcaggccacggtatgtccagctgctcgatgagcaccgacacgccgcccgccaccgggcgcagcccgtcgccgatagactggagcgatgggcaaatcgaagaacaaaccgccgttgcgcgcacgctggaagaccatggaagccgccataggcatggagatccgggagcacaaaggctcgttcgcggtgtatgtcgtgctgcgcgtgctggtgatcgctgtcgcggtgctgaagttcttcaacggcgactatgaggccgtgttcctgtgcatcctgacgttgctgttgctgctggcgcccgcgttcgtccaagtacggttccgcatcgaactgccgtccgcgcttgaggtcatcgtattggtgttcgtgttcgcggctgagatcctgggtgagatcagctcgttctatgagatcttcccgttctgggacacggtgctgcacacgatgaacggcttcctcgcggccgccatcggcttttcgctggtcgacctgctcaaccgttcggaccgtgtgaagttcgagctgtcgccgctgtacctggcgattgtgtcgttctgcttctcgatgacgatcggcgtggtctgggagttcttcgaattctcgatggacatgctgttcggattcgacatgcagaaggacgccgtcgtgcattcgatcagctcggtgatgctcgatccggcccacgccaatcacgccgttcatatcaacgacatcacgcaggtggcggtcaatgggcgtgacctcggccttggcggctatcttgacatcggcctgatcgacacgatggaggatctcatcgtcaatttcatcggcgcggtcgtgttctccgtcatcgggttcatctatgtgaggaaccgcggcaagggcgtttccgtcatcagccggttcgtaccccgacgcaaatcccacgaccgcgattacctgcggcttgcgggcggcgacggcgatgtgtcactcgcgccgggagcgcaggctcatcaggcgcaacgccagtcccagcacgatccacaccaccacgatcacccatgatgcggatttgagcgcggccggggagaacggcagcacctgcaatccgatgatgacgagctcggccgcgatggcgagcacgatgttcgccgtcttcggcttgccggtcttgcggtcgatggacgcgaagctcttgggcaggtagccccgccctcgcgactgggcggattgtgtgttcgtctacgcgctcgcaggtctgatcggcaccgtgcacaagatcatctgggcataccaggccaaaggcatgttcgagtactgcaacggatcgatcctcacccccttcaactacgtgtacggtctccgcgttggccatcgtcatcgcgctgcgccgtatcgacctggggtggaaggtcgtgctggtcggcggtctcgccggcggcatgctggagctcgcgatgagtctgatccaacagtatctgctgggcagccggtcatggaactatgcgaacgagccgctgaatatcggcgggcgcaccaccgtcccgttcatgctgttctgggggctgttgtgctatctgatcgtccgtttcatcctgccgctcgtcctgtggctcgtgcatctcatcgacgacacgtggcacacgcggctcgcgaccatactgctggcgtggattctcatcgactccgtggtcacgccgcccgcgatcttcctgtacgggcagcgcgccaacggcgcggtgttcgacaactggttcgcgcagcatatcaggcggctttcgatgacaacttcatgcgcctgcatttcccgaacatgcgcgtgtgagagccaccgcgggtcgagcggcaccatatatcggccgcaggctcgttcggcggtgatggcttatgggcgtcacgccaggctggcgcccagttgacggatgccttcgagttgggccgcggcggccttacgcttgtcggacgaatcgtcgcccatggacaggttgtcgacgtacaccagctcgacgtccttcaccccgcagtacttggcgaaggtctgccggcagatctgattgtccaacgactcgccgatgccatcggactcataccattgccgcgagccgccggtcagcatgatgacccgcaccgtcttgtccgcgagcgcgccgggggtgccgtccggatgataggcgaacccgcggcagatcacgcggtcgaacagtcccttgaccatcgccggcatcgtataccagtagatcgggaacaccagggcgattacatccgcctgagcgagccggcgctggataagcaagacgtcctcgggcatcggggcatggccgagataatgggcccggtcggccgcagaatacacgggattgaatccttcatcgtacaggtccagcacgtccgccgacgcgccgcgctcgacggcgcccgccgcgaatgccgcacccacggcatccgtcatgctgtccttttcggggttgctggtgatgacaagtatgttgttgctcatgattccattgtcccggaaagctggaccgacgacgcggcgagcgacgtcagatcaagtcgtacggcatctgtccgcggaccagccagaacacgcccatgaccaatatcaccgcgcccgcccacggcacgcgcccgcagaacaccacgcagcatatcgcggcgaaccgcaccgcatagaacgccacgcggcgagcgccgctcctcggcgtggtctcgcaggtcatatgcgtgtagctgccgccgagagtgcggccttgtctgaaccacggaatcacccattcgaacagcaccagcatgaccagcatcgcgatgtccccgaacccgagcgggccgagcagccgcatccgctgcacgtcggcgccaggacggcccgaaatcatcgtgaccagcaccatcgcggcgacgcccacaggggtcgcgcacaccacgaccagtcccatgtcgatgaggaatgccacgaaacgacgcacgaaccccggccgggtgaccgtctgcatatccgtgcgccgcggcggaaacagccggtcgaacagcatggcgcaaccgtatccgatcacggcgcccgacgtgttccatatcagatcgtccacgtcaaacagacgatacgagcaaggaaacacacccatcacccccgtcagctgcatcgtctcgacaagcagcgacgcgagaaagccgaccggcagggcgaccgcgaatttccagcggaacacccgtttcatgatgaagccgagagggacgaagaacaccacgttcatcacgatctgcaggatcgccgtcagcccgtcggcgcggatatcaccgatgaactgcagcggattgagctgcggatgcagatggtgggtggcgcagtacgctgcgggatcgtccggcatcggatacagcgtgaagcacagcaggccgatcagatacagcaccgtcgcgtacgccgacagcgccgcaccgaagccgagccggttgtcccggtggtacagcatggccagcacgggcacggtcacgatgaacgacaccagcggccataacgccaccgacatcatgaacggcgccgaaaagctctcgaagaatcccatatcgtctgctcctcccctgttggtttcactgtagccgagtcgcaggccgccgggccatccgccatgagaccgatatggacggcaagcgcctcggccacgacgggcggcattcatcctcaggaaggagaagagaaccgcagaaaaggtaagcacgggaaacgcggcgagggccggccggggcccgggcgggtgtcctcctcggcccccggcgccccatattgtgacgaccggtcacccgaacacacggcgacgggctacagtggggagtagctacataggcaggaggcgcaatggacattcttttcgtgaccagcgatccggcgttggcttccgcggtgaaaggcacgctggaatccgcccggcacacggtgtctgccgcgtcggatgtcgattcgctcgccggcgcatggccgcacggcacaccagtggatctggtcatcatcgacgacctgtctgcgcatgatctgttggatgagaccagacggagcctgtcccggctcatggacggcaaggccggcgacggcaccggcacggccgtgcgaccgcgcacgctgctgctttccactcccccgcgcacgccgaaggcgaacccggacgacacgccgcaggtcagacggcagaccccgttgccgacgatccgcaaaacaggccgggacaaggccgacgggcaggccgcccggccggccgcgcccccatcgtctctggacggcgcttccagcgtcccgcccattcacgcggatgaaacgatcgtcaagccgttctcggacgtcgaactgctgtcttacgtgcgcgcgctggaatccggcggagccgcggacgagaccacgctcatccacggcgacctcatgctcgacacgcgcaatcggcaggcgttctatcgcagcggcaagcagccgctggcgctgtctgcgcgcgaatacacgacactggagacgctgatccgggcgaacggcgaattcctcagcttcgacgagctgctggagaaggtctgcggcacgggcatcttcgagcagcgtgacatcatggacggcacgctctactcattgacgcgcaagatgcggcgcatgggattcttcatcacgcagcgggggcatcgttaccgcatccgctgacattaagccgtcgccggccctccgtcgccgttccgctgccggccgcagccgacagcgttgcacgaaagccggtatcgaaagaccagaaaggcgcggttcgggcatgcatcgcccgaaccgcgcctttctggtcacatgccggtcatcggtctcgccgacgaccggcacctgtcgacggtcagtccttgtcgatggtcttgcctgcggtggcgccggaggacaggtcctggatctcggtgatctcaagcaccgggatggcggcgggcttcttagtgcccttctcctcggcgaccttgacctgggcgtcatagatgtcgtcgtcggtgtgcagggtcacggtgccgcggaagcggtagcccttcttctcggccaggttggcgacggcgacgaccagcgggctgccgtcctgcaggttgcggtagtgctggccggcggtgcgctcgtggtaggcgaggtggttgtcgtcgagcacgaacatcgacatcttcgggccgagatcgaggttgccgtccttgtcgacggtggtgatccacgcgaggttgttttcgatgaacgtcttcatgtcggcggtgagcgttgccatagtgcacgatcctttcgtttggtgatggtcacactggttattccacatatcagcctacttcaaacgcctgtggcctcatagcgaaatcagccgactgtgaataatctcacctgcgccgcgcggcgtctcagcccttccacgcgcgcaacacggatttcggcacgcgagacgcgtcccagcggtagtggccggtgacgcccatgcggcgcgagaacgcaagataatcgttctcacgccgctgctgattcatattgtgcagcacgtaggagaacccgtcagcgtcccgcttgtcggagatcacgccgatatgcttgacacggtcgaacacgacgatgtcgccctgctgccattgcgcatgatcgttgacatcgttggtgagggtgattccgtatttgccgaagaacacgtcgagcaccccggtacggcgaaagtcgatgttggggtcgggtttggcggccaccgacgaataggacgcgcggtccgcggcgatgtccgcatcgaccatggccttgaggtcgtatcccgcgttccggaaggcgcgccacaccacatcgacgcaggcgccgcggtcggcgggcgggtatccgccctggtagtagccgtcgtcgtatgccgggtgcgccagcgcatccttgcgggccccgcgcatgatgtccgtatagtcgtccacaccgttgccgttgaaatccaccgggctggtcaacacgggatacctgcgctgcgacacgtcgggcggcgtcaccgtcgtgtcgggctctcgcgcgtgcgagtacatggacgaggccttcacgccgaacgccttcaccccgctgatgatgccgtcgcggcgcgaccatagccatgaacccgccaaaacggcggacacgatcaggagcgccaccatcgcggcggccaccgcgcggccgaccgcgcgactggccttgcggccatcatcgcgaccgtcctctcggccttcctcgcggccgtttccgccgcttccgcccgcggcattcccgctcgaaacacgatatcgccgaatcataatcgttccgcccttcatagtcgtgcgtcccgcatatcccgcgcccggcgtcgcgggcggatggccgcgcgcggcccccggcccgggaatccgggcaaacgacggacgacacaatgcacgcagacccgcgccgtggctaggatattggatggaatatgttgggtgaagccaccgtcctcatcgcgacccgtcatcgtcttcattatggacggcgtcgagcggcagcgcaagcctgtataaggagaatatgtatgaacatcgtcgaggcaatggagcggcgccacgcggtccgcgatttcagcgaccggcccatcgatgacgatacgcttcgcgcgctgaatgaggccgtggacgcggcgaacgccgacggcgggcttgacgtccagctggtgcaggacgacacggatgcgttcgggggatgcccgacccattatggtcgcttcaagaacgtccgctattgcatcgccctgatcggctccgacgacgaggacccggcacagctggaccgcaaggtcggctattacggcgagcgccttgccctgacggcgacgcagctggggatggactcaagttgggtggtgttgcacgagacgcacgaccatgacggacgctggcggctaggcgagggcgagcgcatgcccgccgccctggccttggggtatggcaacagaccgggccgggcacatcgcagcaagcctatggaagagctcggggccgtggagaacggcgacctctccggtgctccggattggttcctgtcggggcttcgcgcggtggcgctggctccgagcgcattgggcaagcagccggtgcgcttcaccctgctggaggacggcaagacggttctcgcgcagcctttggagggcgttcaggccgatatctgcctgggcatcgcacggtatcatttcgaggtcggctccggccatactgatatcgtcgtccgctgatttgaccgggccggcatggccgttctcccgaatcagtcgcacgattgtgcagattcagctataaccgtgtaatttttcagcatttttcgccgcaagataagtcaagttcgagaaggaaccgctagcgtcgttcaacatgaagaactttttcaagggaatttcgctgtcgtctatcgcggcaggcgcgttggcggcggtcacctcgttcctgttatcggcgaaaatcggcatcgccggttcggtgatcggcgtggcgatcggttcgattgtgtcggcggtctcgtcacagatctatcagaacgtactgcacgaatccggccggaaactgcaggatgtcgcggggacgacgggcgacgaggacgacggcgctacggagacggcggctgatacggatacaaccgcttccaccgacgccaatgcgcaggaccatacagcgatcatcgccaatccggtggcgctgccggcccccgcatcacacgagctcggtcacggtccgcggaccgtcgcctcggatgctgcacggcggctgtcgcacggcgatgagacgcaactgatcggcaacgccccggtggacgccgatgcgacgattgcgagcgggatgccccccgtgccggcgccaccgtcctcggcccgcgccgccacgccaagcggcatgcgcacgtccgcccggcctgccgcagccagattcacggcctccaggtccgctaccttcaggtcagaggccgatcgggcgaagcgcaacaagcgcaccgccatcatcgtcgccgtcgtcagcgccctggtggcggtaggcgcgaccgccggcgtcatcctcgccatcacccaaggtcagggaaccgatactgtggtccgcgactgggtgcgccagtcgaacaccccgaccgagcccaagcagcaggcaccgcaggacgacacgaccgacggcaacagcgacaccaaggattcgacaacgaaggacggcaccgattcgaccggcaagggctcgaccggcgacagcaacagctcgaccaacagtggcaatggatcgaccgattccactcagggcaacggttccgactcctcctcgtcgaacgggtcttccagctccaacggatcaaatggctcgaacgggagcaacggctccgactccaccggaaccggcaacggaaactcctcaggctccgactcctccgggtcgggctcaggcagcaacggaaccggcaacggatcgggccactccggctccgacggagcaagctccaactccggttccaatggttccggttccgactccggctcctcgtcgagcgggtcgtcgtcgggatccggatcgggttcttcctccggtggcggctccaccggcaccggcaagtccggcaaccaggcgtgacatcaagcagcccactcgtatccggccgcttatcccgcggaagtcccaccagacagccacatatgggactttcgccggataagcggcccaccggccacgttccccacacccatatgtcgccccttatccgacgaaagtcccatttagccatcctcagatgggactttgggcgggtgagacggatgacgcgggtgacggaggctgtacgacacgcccagtttggttttcataccgacttgaggtaaattatcaatcggctcaaaaagcagccgataaatgaatttggggctatggcgcagctggtagcgcatctccatggcatggagagggtcaggggttcgaatccccttagctccacagattgaaaccggtcgatttcgaccggttttttcgtttacgcacgctctccggcaggcaaccaaaagaaaacgctccgctttctcgctttcgaggggttgattccacactcaaggaacatctatctgcgtttcagggggttgccagattgcgatatccggagtattccggccggattgccattgaagtcatgcggttcctggagcttggatacttggccggcaaccccttgaaacgcagatagatgtttcagcgtcaccgaatcaaccccttgaaagcgagataggcatccattcaccgaggaatcggcggatgaccgtcagtcgccgtgctgcacgcgcatgagcaccgtgccgtccgagccgctgacgaccgcatgaggtgccgggtcgagcgacagctcgacatgcaaacgctctccgccatggccgaccgcatcataggcgtaccgcctgttgtcgaccgtcaccggcgtcgtcatggcgtgggtgagccacggattgcgccggcggatgccgatcagcccttggatcaggcgatacatccactcccccgtgccaggcaaatcatccggcgatgcggggaacgccggccgcaccgcgtcatcgccgcccatgcggtcctccttgacgccgcgaaacacctgctcgtcgccgtaatagatgctcggcacgccgccgacggtgaacagcacggtcatcgcaagggaggctccggcatctcctacacgactggcaatgcgtgtcacgtcatggttgccgacgaacgtctgcggcgcgaacgactccagaaactcattgtgccgtttgaggctccaatccagttcatagaagttcgcggattcgagcgaactccaaatcgccttccacagctcgtactgggtgagtgaatccatgccggattgccggacaatcgcggggtaatcgccatgaatcacctcgcccatgatccacacgtcagggaattcgcgccgcacggcgggcagaacacgcgtccagaacgccggcgacacggcgtaggcggcgtccagccgccatgcggaggctccacgccgcagccaatgcaacatcacatcggtgacgagccgcacgacctcttccgagtcatgattgagttccggcagttcggggtgcccctcgaaccggcgatagtccactcccccgcctgcatttcgcgtgatgtggaacatcgactcgtggccgtggccggcgagcgcgtccctaaaagccgggaacgagcgcccaacatggttgaacacgccgtcgagcatcacgcggatgccccggctacggcatgcatcgatcagcctgtcgaatgcggcgtcatcgccgagccgagaatcgatgcgatagtagtcgaccgtgtcgtacccgtgggtctcggacgcgaacaccggccccagcagtaggccgttcgcgcccatgtcgatgagatagtcaagccacgggatgatggcgtcgagtcgtggcgtcaacgcccgctcgccctcgttggacgggcgtatcggggcgccggtgaatcccagcggatacacctgccaccagatggtcgtgtcgttgacgctcatgccatagccgctcatcgcattctcctcatccggcacacccgttcccgtttcccgtgaccgggtgtgccgcagcgatcatctggccgggaaatccgggtatccgtccccgtcgaggtcgggtccgtccgggccgccgtagtagccgtcgccggtgcccatgaactcgcgggtgctgacgcggttgacattgcgggcggcatccaccgcgtgctgcagttccttgcgcacggcgaaaccgtcgatgatgttcttcagcacgatcttgccgccggtggactggtccatcgcgtcgatgagaatcgtgctcaagccgaagatgcgctgcagcagcgtgcgcgagatcgtgatgtcgacgatgcggaacagcttgacggtgtcgaagctctgatgcagcagaccgctctgcgtggccagctcgtcggccgtcagagtgtacgtggtgaacgtgaacggggtgcggcaccagttgcgcttgcgctgcgtccagatgatgtcgccgtctgcgatgttcttggccatgatcggtctcctcctgctgtcgatgacggtatgctcccatcgtagcccgtcattcgggacgcgatgtgtcctctgccagcgtacagggaacggcggatagagggacggacggggagaacgcagcatcaggagcctgctatagggccggatgctcccactgatcggtgtcggcgagcgccggaccatgattgtagtcgacgagccgccaccgcaacgtgccgtcgggcatgtcggctgcgacgaaccgcacccagtgcgcgttgcccatgctgaccacgtcggcgaaatcggggtggatagcccccaatcccagcacggtctgcacggtctgcgcgatccatgagccatgcgagaacacgtacagatctgtgtcggctccggcgctgaacgaccattcctccaatgccgcgcggcctcgctcgccgacggcggccttcgtctcggcaccatgccgcagttcgccaccgcgatattccgcccatgcacggtagtcctcagggcattcgcgctccagttcggccagctccttgccttcccattcgccgaagttgcgctcccgcacgcgggcgtcggggtgcacgaccagtccgagcgggtcggcgaaggcgtgcgccgtggccatggcacgactcaggtcggatgccacgacgagctgccggcgttccgggtgcgattcgacgtatagggagcgcagtgcctgcgcggtctgcctgacctgccattcgccgatctcatccaaggggatgtcaatctgcccctggaagcaatgccgggcgttgtatgaggtgcgcccatgccgtatcagcgtgatggagcggacgtgctccggcatcgcctgcggcgaggagacgtcactcatcagcttcgccggcatcgtcaccgtcactgccgttgtcggcggattcgtcgcccgtcgtctcggggtgttcgagaggcagctcgacgacggggcagtcacgccacagccgttcgaggcgatagtactctcgcgcgtcctgatgcatgatatggataatgaaatcgccgtagtccagcagcacccactgtccttcgtcgacgccttcgcgcgagcgcggggacagatgcccgcacttgaggtacacgtccttctcgacctcttccgcgacgccgatcacctggcgctcgttcatggcggtggcgaccatcatgatgtcggtgatggcgagcaggtcgctgacatcgaacgcctcgatgtcggcggctttcatgcggtcggccgcgactgcggcgacgcgcacggcatcaatggaactctggactgctgtcattggatcaacgctcccaagcgggcttccagccctcgacgatgtgttgtgtgttttcggaatagaccatcgaatcgtccggcacggcgtggcggatgaccgaaccggcaccggtggtgacgccgtcgccgacctcgaccggcgcgacgaacaggttgccggcgccgacgtgcacgttcgagccgatgtgcgtgcggttcttgtgcacgccgtcatagttggcggtgatcgtgccaccgccgatgttggtgtgctcgccgagttcggcgtcgcccacataactcagatgcggcaccttggtgccgttgccgatgtgcgccttcttcatctcgacgaacgcgccggccttggtctcctcgcccagctcgttgcccggccgcatgtaggtccacgggccgatgttcgcggcacgcccgatatgcgagccctgcacgcgggagcgttcgacgacggcctcggcgtccacggtcgcgtcgatcaacgttgtgtatgggcccacgaccgcgttctgaccaatcacggtgtggcctttgaggaacgatccgggcagcacggtcacgtcctgcgcgagttcgacgtcgtcttcgatccacgtggtgtcggggtcgaggatcgtcacgccgttgagcatccagtgctcgcatacgcgacggttgtgcgccttcgacagcgcggcgagctgcaggcggtcgttcacgccttcgacgctcagcgggtcgggcgcggcgaacgccccgaccgtgccgcgcgtcttcgcggtctccagcgcgtcggtgagatagaactcgccctgcgcgttgtggttgtcgaggttcgcgatggcctcggcaagcagatcggcgtcgaacacgtacacggacgtgttcacctcctgcaccgcgagttcgctccggttggcgtccttctgctcgacgatgcgcagcacgtggccgtcacggtcgcggatgatgcggccgtatccggtcgggttgtcgaggatcgtggtcagcacggtggcgccgtcgccgctctgctcgtggaacgccacgagcttcttcaacgtgacggagtcgagcagtggcatgtcggacgcggcgatcagcaccgagccatgcaggttgcgttcctgggtcagctgcgccatcgcgcactggaccgcgcggccggtgccggggatgtcgtcctggttgacgatgtcgacgttcgcgtcgtaggaccgtgccgcctcggagacgcggtcagcctgatagtgcacgacgacggccagtgtctcgggctccagatgtccgactgatgtcatgacgcgctggaggaaggtcttacccgcgaattcgtgcaggaccttcggcttggacgaacgcatgcgtgttccctcacctgcggcgaggatgattgcggcggatagtgccatttcggtgcgactccagttctctgccgactgcaggattgctgcccggccgcggattgccgcggaaccgggcgcgaaagttcccccacctggactcgaaccaagacaaagggttccaaagacccgtgtgctgccattacaccatgggggaatggcggtgaacccgccaagtttttattatgccatacctcgcgacttcgtcaaatcgaagctcatgcgaacaggaagccctgcccgtggtgctcggggtacgtgtcgaagagctccgcgacggaaccgtcctcgaacaccgcgcggatggcgctggcgagcagaggcgcgatcgacagcacggtcaggccgtcccagcgcttctcttcgggaatcggcaccgtgtcggtgagcacgatctcgctggcaccgcagttcttgagacggtccacggccggaccggacagcacgccgtgcgtggcgaccacggtcacggacttggcgcccgcgtcacgcagcacgtggcaggctccggcgatggtgccggcggtgtcgatcaggtcgtcgacgagcacgcagtccttgcccttgacatcgccgaccacacggttggcgaccgccttgttcgggcgcgtgatgtcacgagtcttgtgcacgaaggcgagcgggccgccgccgaggcgttgcgcccactgctcggccacgcggatgcggccggcatccggggagacgaccgcgacgttgcccagctcgttggagaaccgatcgcggatatagtccaccagcaccggcatagcgatcaggtggtcgaccgggccgtcgaagaagccctgggactgcgcggcgtgcaggtcgacgctcatgatgcggtcggcaccggcggtcttgagcaggtcgaagatcagacggcaggagatgggctcgcgtccgcgatgcttcttgtcctgacgggagtagcccagcagcgggcataccgcggtgatggaacgcgcggaggcacgcttcaacgcatcgatcatgatgagctgttccattatcgacttgttgaccagatccgcgtgggtctgcagcacgaacacgtccgcgccgcgcaccgattcggtgtagcgcacgtacatctcgccgttggcgaaatcgtatgcggtggtctccagtatgtcgatgccaagctgttcggcgacgtccgaggcaagcttcggatgcgtacggccggtcacgaggatgaggtttttatcgggctttccttcgaggattgcactcaccatgtctccaaacgtttgtgtttcgctgaagtggacaatgtcatagtaaccgtgcacaccgaccgcatgtcacatgcaggccagccccggttcatgttccgttagcgttcccggcacgactcgccggcgtgtcccggtcagccggaacgcctgcggtacaggccgtgcttgccgatgtactgcacgacgccgtcagggacgaggtaccataccggctcgccgtgcgtcgcgcgccggcgcacatcggtggaggatatggccagcgccgggatctccagcgtgtccaccttgccgtcgggcagccgcaccccctgtggcgacgagtagccgggccgtgtgaccgctacgaaatgcgccagatcccacatctggtcggcgtccttccactccatgatctccgccaccgcgtcggcgccggtgatgaagaacagctcggcgccgggatgctgcgagcgcaggtcgcgcagcgtatcgatggtgtaggtgacgcccggccggtcgatgtcgacgcgggacacggtgaatttcgggttcgacgcggtggcgatcaccgtcatcagataacggtcctcggcattggtgacctgcttgtcgagcttgaagaccggccggccggtcggcacgaaaatcacctcgtcgaggtcatacacccaggccacctccgaggcggcgaccaggtggccgttgtggatcgggtcgaaggttccgcccatgatgccgacgcgcgggcgcatgtgccagttgccgcgcgtggagaaccgcttggctccgtccggtttttcggatgacaggtccgacatgcggcgctccggctcgacgagatattggatttcgggcgaggggtcggcttctgcggccaatgggcttgcctcctgcggcggccttcgcgtcgtcatgcctccgagacctccggctggctgtccgcctcgtccgtctcgcgcttgccctggtccgcggtggtgttggcctcctgcgggtcgatcttgcccatgtcctcgtcccattcgtcctgcacgacgcggcggatctcggcgaacgtgggcagggggaagccaggctggtacaacctgcgcacttcggcgacgcgctcggtgatacggatcagcgtgtcggtcatgccgtcgacgtcgcccttgcgttccatggcgctgaagcgacggatgtactgctccatcatgctcatctgttcgcgcaccgtcttcagcttcgccgcgtccagttccacgacttccggggagtcggtctccggccagccgatgagcacggcgtcggcatattccagcgatgcccgctggctggccgaggcgatgccatcctcgatctgcaccaggaacacgtagcggacgatgctgagccgttccgcggcaatcttcaggcccaatgtctggtcgttgagatcgatatcgtcccggatggtggaaatcaccgttcgttcctcgctcatactcgcacctgccccgttccgtagccgatccatttcgtggtggtcatctctttgagtcccatcgggccgcgggcgtgcatcttctgcgtggagatgccgagctccgcgccgaagccgaacacccctccgtcggtgaaacgggtggaggcgttgaccatgacgacggccgagtcgatgcgcttggcgaacgtttctatcgcggagtagtcctcggagatgatcgattcggtgtggccggtggaatgcatgttgatgctgtcgatggcctcgtcgagcgaatcgacgatcttgacccccatggtgagcgccagatattcggtgtcccaatcctggtccgtggcgtgcttcatggcgaggcttgggatgccggccgcctcgatgatggcgaacgcccgctcgtcggcgtgcagctcgacacccttgtcggcgagcgccttcgccgcggccggcaggaaccgttcggccacgtcgcggtggaccagcagcttttcggcggcgttgcatacgccgacgcgctgcgtcttcgcgttgatgatgatggggatcgccttgtcgaggtcgccgctgcggtcgacatagatatggacgttgccggctccggtctcgatgaccggcactttggaattgcgtacgacggcctggatgagtccggctccgccgcgcgggatcagcacgtcgatgtggccgcgggcctccatcatcgccgtggcgccctcgcgtccgtattcgtcgacggtgttgatcagcgccgggtcgaatccgttcgcggcgagcgcgtcgtggatcaccgccagtgtcgccgcgttcgtgcgctctgcgtcgtgccctccgcgcagtatggcggcgttgccggatttgaggcacaggctggccacatccacggtcacgttcggccgggcttcgtagatcatgccgataacgccgatgggcacgtgcacctgattgagccgcagcccgttctccagcgtgtatccgcgctcgatctcgccgaccggatcgggcagcgaggccacgtggcgaacgccttcggcgctggcggcgatgcgcggctcgtcgaaccggagacggtcgagcttcccggcgtccatgccgcgagcggctgcggcctgcatgtcctgcccgttggcggcggcgatggtcgaggcgtcggcgtccagcgcatcggcgatcgcgtgcagcagggcgtttttcacctgggtgtcggcctgcgccagatcagattgggcgcgtgcggcggcgtcggctttcgcgcagacgccggagaacacctcgccgttcaattcatctttcgtcataaagcccagaataacgcagattgcgagctttgcggggcattcgtgtcatcatgtcaatatgggggcacgtgtcctgcggccgcgacgcacgccagggtccatgccagtatgcggtacccgccgccgccatgcccacgcctgacggtagacttgagccgaacttcatcccattcagcagcaacgcaaggattaccagtgaccacgttccacagcacgcgcagcaccaccgactcacttacctccaagcaggccatccgcaagggcatcgccgacgacggcggcctgttcgtgaccgattccctgggcgagacgaaggtggacatcgcttccctgacaggcaagccgtatcagcagatcgccgccgaggtgctcggtgcgctgctgccggacttcaccgaggccgagctcgcgcagtgcatcgccgacgcttacggcgagcagtggtccgacaggcgcatcacgcccctgaagccgctcggcgacgactacatcctcgaactgttcaacggcccgacctccgcgttcaaggacgttgcgctgcagatcctcccccgtttcatggcgcacacgacgccggcggacggcgacaccgacgagaagatcatgatcctgaccgccacatccggcgacaccggcaaggccgcgctggccggattcgcagacgcgcccggcaccgcgatcaccgtcttctacccgcagggcaaggtgagccaggttcaggagctgcagatgagcacgcaggccggcgcgaacgtgaacgtgtgcgcggtcgagggcaacttcgacgacgcgcagtccgccgtcaagcgcatcttcggcgacaaggagctcgccgcgaagctcgccgccgactcgcacatcgtgctctcctccgcgaactccatcaatgtgggccgtctcgtaccgcaggtcgtctactacttctccgcttacgcgcagcttctggagaaccaagtcatcaacgtgggcgacgaggtcgagttcgtcgttccgaccggcaacttcggcgacatcctcgccggctactacgcgaagatgctcggtctgccggtcaagcacctcgtggtcgcctccgacaagaacaacgtgctgttcgacttcctgaccaccggcacgtacaatcgtcagcgtccgttcttccagacgatcagcccgtcgatggacatcctcatctcctcgaacctggagcgcatgctatactacatgtccgagggcgacacccgtctgatctccatgctgatgaatgacctcagccagtggggcacgtacgaggttccggagccgctgctcgcgaagatccgccagctgttcggctgcggctgggccgacgaggaccaggtgcgtgagatgatcgccgactgctggaagaagaaccgctacgtgatcgacccgcacacggcgtgcgcgtacttcgtggctcagcaaatgccgcgcgacccgttgaccccgcgcgtgatcctgtcgactgcgagcccctacaagttcccgcgcgtggtcaacgaggcactgggcctggatgccgacggcaccgatttcgaatgcatggatgtgctgtctcgcgagaccggcaccaccgctccagccgccctgcgtggacttgagaccgccgatgtacgtttcaaggacgtcgtgcccatcgacggcatggaggattacgtcgaaaaggccgcccaggcgctgtaacagctcagcccgccagcaggggcataaaggggcttacagctctttggcgcggtagaagcggatggccagagcggcggagatgcagtagacgcccacgcacagcacgacggcaatcagagcggcacgccaccatacgctcatgaaatccgcgacgccttgcagcaagccctgccaatcaaacggcaatctggacagcaacgcgacgagtgcatacagcccgactatgaccacaacgaatatccgcatcatcgcccggaacgtgaaccggtacgaaaacgccatcagaatcgatccgacgatcagggagaacgcgaagatgacggcgctcggtatcatggcaccggcccagccggaatccatcatgtcgccgaaggcgaagaagacgctgcatgccatcacgtccacggtccacatcgcgcaggtcaccagcagaaacaggaaccgtccggccacctgcgacgtacgggcgatgggaatcatcccgttcatggcccgatgaccgccgctctcctccgcaacattcacgctcaaggcggacatccacgacatcaccgcagccatgccgcatacgccaccgtagacgctgacggcgacctgtccgggtgcgccggtcacggtcagcaccagcgcggccacgcaggacagcacgggaaacagcaacatgaacaacatgttggacaacccgaacaaatccactcgcacgcaatcgaacctgcactgcctcactacggaactccagcgcatctcaccactcctttgccttgtacacgcgcacggcgatcgcatacgagaccgcatacgccgcggcggagaccgcgaccagcatcgcggacagccagaaacgatgcgagacgacggcgtccaccacgcccatcaccttggcgatcatcgatacggggaggactgacgggatgaacgccccgatcaacgtgacgacatagaacacccacaccgtgatctgcagtccgatgatcttgtcccacaaacaggaaacgggcatgatcaccgcaataatcagcacgatggccagaccgcccacgccggccacccacagattgcccgtgaatgaccaatcacggcggacaagcggctgcaccccatcgatcaatgcaatcaccacggccccgtacacggccagagccagtcccatcaagtaccgcgaggccatctggttccgccgcgatgcgggcgccaacccgcgcagccgatacccgctctgcatgtcgatgagcggcacggtcagcaccatcatggcgggcgagaacaccgccatgacgacgcccaaccggaaaccgaagccgtcgacgaacgccccgccgttgaacatgatcgaaaacaccggtgcgagcagcaccgaggcgaatgattgcatggcgccgtcgcccagcagatacgccaggtccagatgcaatgcggtcgccagcccacgatttccccgccgtgcccgtacggcacggaatggcacggtctcagtcaacgttcccatggccgacctccttgagtgcagacgcggcctcgggcgaagacgcgacggaatcacggacgttggtcaggcggatgatatcgtcgatggaggccggctcgacgacgatatcggcgacggctgcgctgacggtgccgaggctgtcggagcgcaccagtgcatcgaaaccggtctggtatgtgtgcgagccaagcaccacgccggcaggcagctgggccaactcgcccggcccgcccttgactatacggaacgattcctcgaattcgtccttcggcccggtgtagtagagccttccaccagtgatgtaggtgatgaagtcggccgcacgttcgaggtcgacggtgatatgggtgctgaacagcaccgaatgctcgccgtcctcgatgtaggcatgcagcatgtccatgagttcgtcgcgggcgagcacgtcgagtccgctggtcggctcgtcgaggatgagcagtttggcgtcatggctcaacgcgatggcgagcatcagcttcatctgcatgcccctcgaaaggtccttgatcttcttcttgccgttctgagctcccccgagaccgaaatcgtccaggtaccgccgataccgctccccgttccatgacgggtagagcggggcgacgatgcgctcgaccttcgagaccttccactgttcgtacaggtagctggagtcgaacacgacgcccagccgttccttgacggcctcctcgtcaatgatgttgtcgaggccgagcacctggatgctgccgtggtcccgtcggatcatgttgaggatcagcttgatcagcgtggattttccggcgccgttcgggccgatcagccccatgatgtagcccttgggcaggtcgaaggtcacgtcgtccagcacgaagccggagtcgtagtgcttggtgacgccggtgaccgcaagggccatcgtgtcgggttcggatatggtggtcatggctatggtccttttttgggaaactctctcgtcccgtggcctcgcgtatcacagcgacgccacggtgttcgcaggttgccggccaatgccggcactcactgcttgcggtactcgtcttcgagcatgcggcccagttcactcagcgcgatgtcggcggctttggccgcgcgtatcgcctcggccaggttttcgcggacctgggtttcgagctgacgtcgcatcagctcgttgcccttgtccatcacgaaggtgcctttgccctggaggttctgcaccacgccctcatcggccagttcgttgtacgccctggtgacggtgagcacggagacgcgcagttccttggcgagtttgcgcagcgagggcaaggcctcccctacctcaagctcgccgctcatcacggcgctgcgaatctggttcttgatttgctcgtagatgggttctccggacacggatgagatgatcagtttcatctatgcccctttccatgtgtctccagtatcacagccggattactgttctactgttacatataacagtagaacacttatggacaactgtcaaggtcgagagcataacagttgcgcgtcggttcacagactgcgcggcgcctcgctgaaatcaaacagcacgccgtcggcgagaccgcagatatccggccagtccccgtcagaagaatcatcatggatcgcccatacccgcatgccgacggacttggcggaccgcatcgccaccagcagatcctcgaacaccgtgcactgctccggcaccacgcccagacggccggcggccagaaggaacacgtcgggacggtccttgccgacatcgttcgcatcgtcgacgctgacaatctggtcgaaatagtcgaaaatgccgacgtgcttcatcgccggctcgcgcaacgccggcggcagggacgtggcgacggccagcttcgcacccgaccgcttgagatacgacaggtattcgaccgcatgcggcttggcctccaccaccgtcgaataggcgacgcgcgccatgtcatcccactcctgcatcagcgcctcgggcgtgtcgggcaggccgaaccgggcgatcgtgtattcggcgatctgccggaactgcatcgccgccaccttgcccatgtagtcggcagggacctcgatgccccgtttggcgaggaaatcgatgtcgacctgatcccatacgcccatggaatccagcaacgttccgtcaagatcgaagattgccgccttgccgtggttgtcgtccatgatgttccttccgctattgccggttatccggtccgtacgtgcgcgctggccgtcccggctatgtcagcgacgatgatgccaacagctcgcgcgcgtggtcgagcgacgcctcggattcgctgccggacagcatccgggcgatctcatgggcgcgcgcgtcgccgcatacctcggcgaccgtggtcgtcaccgcggactgcccgccgtccgaggcgcccttggtcacgacgaactgcgcgtccgcccatgaggccacctgagccaggtgcgtgacaacgatgacctgcgaggtccgcgcgagacgggcgagacgccgtcccagctccactgcggccttgccgccgacaccggcgtcgacctcgtcgaagatgaacgtcatcggcccgccctcgcccgcgggagccgcactcgaacgccgatccgcggcggcgagctccaatgcgagcatcaggcggctcagctcaccgccggaagcgcttttgcccatcggcagctgcggggatccagggaacggcgtgaacaggaattcgatgtcatcgcggccgttcgcgttcagcggccatgtcgaggcctcgccggcggaatcggatacgggtatcgcctcttccccgcgatccgtgacgcggatatcgagccgcgccccggccatggccagcgacgacagctcgtcggtgacggtggcggccagcgactgcgccgcggcccgtcgcgcctcgctcagcgccccggcatcctgcagggcccggtcgaatgcggcttcgcgctcgtcctgcagctgggcgaccttctcaggagacgcgtccagatcctcgacctcgaacgtcgccttgtcgcgccatgcaatcacgtcctgcagcgtcggcccccagcgccgggtcagctcgcccagctcgtggatgcgcgcgttgatggcatccaggtcctcgacgctctcctcgccgtcaagctcacgcgacagcgagaacacgatatccgacagatccgcgttcagggattccagacggtcagccaattcgccgaaatcaccgtcgacatggatgtcgcgcaatgaggagatcgcctgattcagcagatcagacgcgctcgatgaatcggcgtcgacatccacctgggaggcgtcaagcgccgcaagcgcccggctgacaccctgcgcgatatcggcggcgttctcgatgcgggcgcgacggcctttgagctcctcgtcctcgccgggctgggggtcggcgcggttgatgcgctggatggattcgcgcagatagtccgcacgctgtctggcggacgactcctgatggcgcagccgttccagacggtcatcaagatcgcgcagagcatcccatgaatgacggtaccgcgccaacagatcatcatcgccggcgaccatgtcaaggaactcccgctgcctggatgcggcggcgatgcgcaactggtcggcctgcccgtgaatcgtcaccaactgcgacgccagtgattccaagaccgagcggggggcgctcttgccgttcagcacggcacgggaccggcccgacaccggcaccgtgcgcgacaagtacaactccccgtcctccagcacggccccggcatcgcgggcctcctgcgccacgccgccgcggtcatccacggcgaacacgccttgcgcccatgcctccgaagcgcccggggacacgcgcccgctgctggccggtccgccggaaatcagccggatggcgctcaacagcatggacttgcccgctccggtctcgccggtgatcgcggtcattcccccggccggcgtgagcagggcacgatgaatcgggccgaggtcatgaatttccagttcctcaagcatggtcgaccccctgctcgccggaagaaggcaccgcggccgtgtccgccgcaccccttgcacgcgtgcgctgcgccgaggaaccaccgttcctcgcgtgctcgcgccatccgaccaccggcagatcgaatttggtgaccagacggtttgtgaacggcacaccggacagccgggccagccgcaacgtgctcttcgactcgcgcacctcgacgcgggttcccttcggcagggcgcactgccgtcgtccgtcacaacagatccagccttcggatgacgaatcgtcgaggatgtccagagtgaacgtcgagccggcgccgatgatcagcgggcgggcgaacagagcatgcgccgccagcggcaccaactgcagcgccttgacgttcggccacatgatcggccctcccgcggagaacgcgtatgcggtggatccggtcggcgtcgacacgatgacgccgtcacagccgaacgaactcatctccacatcgtccacccggaccgacagctcgaccatcttgccacggtcggcgcgctccaaggtgatgtcgttcagcgcccagtcctgcagcggttcatgtgcacccggcagccacacatctacatgggcgatcatgcgctcgtcaatcgaatagtcatggtcggcgacgcgccggatcgcctcgctcatctggaaactctcgaattcggccagaaaaccgacatggcccatgttcacgccgagaatcggcacctgcgtgcaatgcaccagttcagcggcccgcagtatcgtgccatcgccgccaagcaccacgacgatctcggtgtcctcgtcgaccttgtgggtcacgccgccgaactgcggcgcctcgacgttgtcgatgatcgacacctcgaacccgacgttgcgcagccggtcgaccgcctcagacaccaccgtgccgctttcacgcagacgcgaatgcgtcaccaccactgcatgccgagcgcagaccatcgcacacctcatcatcatccgaaacgaccacgtactgtcatccacaatatcccataaggcgccacgaaccgtttatccgccgaaaacgaaacgcaagcgccgccggcggcgcgtccatgaagaccgatccggggccgggcgggcccgcgcccgcgatgcggacgacggcggcatcagcgccaaagaatactaaaatggcgagtgcaaccagtctgttgccgcgcttgacgcgcgccgacgcatacgaaggagcggggaccatgtcaaatctcgtttttgacgagtcctcagcgaaccgcgaggcatcgcacggctacgcgtggtggttctccggcgacacgttcgagaaggccgccgccgaggagcgcacccgcaggaaacgcagcttcattcaccatctcacctcgcatcccggccgtctgaccatcatctacttcctgctgctggtggctctgtccaccagtctgttgctgctgccggtctcctcacacgaagaggagccgaccagcttctccaccgcgttcttcaccgccgtgtccgcactgtcgacatgcggcatctccatcgtgaacgcgaccacgcactggaccgcgttcggccaggtggtgctgctggtgtcggtgcagatgggcggcttgggcgtcatgacgttcgcatcgctgatcgccctggccgccaaccatcacatgaaagccacgcagaggctgctcaccgccaacgagctcggcaccacgaaactcaacgagatccgcggcgtgctcaccgtggtcatcaccaccacgttcatcatcgagtccgtcacgttcctcgccctgttccccggcctgtacggcatcaacaggggcaatgtccgccataccgcccgggaggcgctgttcttcgcggtcatgtcgtacaacaacgccggcttcacgccggacggcgccggcctgcacgtcaacaactgggcggtcggcatgccgatcatggccagcgcgttctgcggcacgctgggatttcccgtgctgctcaacctcatgcgctgcgcccgccaccgcactcccccacgccgttggagcctgcacaccaagatcaccttggtgacgacgttctcgctggtgctgctgtcgctggcgtggttcctgctggtggaatgggacaacccgttcctgttcaagggcgccgacgtggagacgcggctgcgttacggggtcgtcgcggcggtaatgccgcgcagctccggcttcgacctgagctgggtgccgcaggtgagcgagccgacgaaggtgttcatgagcgtcatcatgttcatcggcggcggcagcacctccacggccggcggcatccgtgtcacgacgttcgcggtcatcctactgatctgccgtgccgcgttcaccggacacaccgacatcaacgccttccggcgccggattccgacgcgcgcggcgatgaccgcggtgagcatcaccgccgcctgcctgttcctagtgctgagcgcgtcgctggcgttgatgctcgcctcgggctgctcgctcaccgatgccctgttcgacgcctgttcggcgttcgggctcggcggctattcggtcggcgtggcgcgcgaggacaatccagcggcgttgttcatcctcgccacggcgatggtggtgggtcgtctcggtccgatgacgatcgcatacgcgatcaacaggccccgcgccttggaatcgatacgataccccaacgagcccatcgtggtcggctgagggcgccgccgataccgtctgcatccgacggatgccgccgactccgcctttgtcggacggccagggatggccatatcatgacgtagaagcggtaccgttcaccgccgcccggagaatcggcggcgtccatgacggcggcaccggcgcatcgccgcgcacggcggcggaaaggatgatggcatggcacgcaacaacaggagcattctggtcgtcggactgggacgattcggcagttcggtggcgaccacgttggattccatggggcaggacgtgctcgccgtcgagcagctcaacgcgtccgatttcgacaccgccgtcgtcgcaatcggagacagcgtcgaggcgtcggtgatcaccgccggaaacctgctggacgccggcatcagcgacatctgggcgaaatcggtgtcgaaggagcacgcgcgcatcctgcagcgcatcggagcgcgtcacatcatcaacgccgaaacggatgcaggcaagcgcgtcgggcatctggtgtccggaaactatctggattacatcgagatcgagggctcgcacaccgtcgtcaagatccacacgccttcgcacgtggtcggctattccatcgcggacgcgaaggtcaacgaacgctacggcgtcaccgtcgtcggcatcaaggcgcccggcagcgagttccagtacggttccaaggaactggtcatgcaccgcaacgacgaactcgtcatcatgggcaagcaggacaacatcgacaagttcattcgcggctgaccgatgccaggcacccctccatacccccgtatgaccacatactgaacgcaggcacgtgccgcagcgccatccaattggtacagtcaaaaaggtgttgcggcacagtcgtcgcaacgtatcgacacggcggcggcgagggtggcgcaatgggcaatatcacgatggttgacgggcatgtgcccgacggctcgtatcaaaacgtgacggcgaacggcagctgctcctgcgatgccggcatgcgattcgacggtttgcgtgcccgcggctcgttcgatgcgatgaggctcgacggcgggaacgtgcattgcgaggggcgtctggtctgccgcggcgacatgcatgtcaacagaatcagcgggcatggcgaactgcatgtcggaggcgacctgcgttgctccgctctggatttcaccggcaagatcatcgtgcagggcgatgtcatgtgccctggcggcatgaccgttcgcggactgctgcgcaaccgttcatgcatcgtcacgagatacctgaatatgcagggcacgttggacgcggacgagctgcgcaccgaacggctgcggatgactcccctgtcaagcgccatgttcgggcgcagcggtatgacggaattcacccagacgagcaacgccggacgaatcatcggcggcgatttgcgtgtcagcaggctcatctgcaccctgatgcagggcgtcttcatacggttgactgacgaatcgcatgtggaacgcgcctcgtgcatcacgaagctcgccatggacagcacgtccagcgtattgctggtatccggcgccgccaagcgtgtgtatctgcgcaatacgtgacacgaacgacgaatccgcgcgcgatgcggcgtttttcagtcggcctttgcggcgatgtcatccatgcgggcgaacagcaggaactccgtgttcccgtgggtgccctcgatcggtgacggggcggttcccgcaaccgtcaacccatgctggttcgcgcaatcgacgaccgtctccagcgcctgatcgcgcagatgccggtcctccacgataccgcccttgccgagattgcccttgcccacttcgaactgcggtttgacgagcagcaccactgaggctccgggcgcggcgatgcgcgcaatgaccgggatgacgtatgtcagggagatgaaggacacgtccgacacgatcatgtccggccgatacggcagattcgcggcggtcacgtcgcggatgttgacaccgctcatctcgatgatgcgcgggtcgcgcgcgatacgactatcgagctgaccatgccccacatccagggcgatgacctgagcggctcccctgcgcagcagcacgtcgcagaagccgccggtcgaggcgccgatgtccaggcagcgcaggccgcgcggcgaaggcaggcctcgaccggagaactcgtcgaaggcgccgatcagcttgtacgcgccgcgagacacgtagtcgtcgcccttgtcgacggtgatcgaggacgcggtggccacgttcgcggccggtttggtgacggcgacaccgtcgaccagcacatggccgtcacggatcagccgctgtgccttggagcggctcggcaccaatcccagaccgacgatgagcgcgtcaagacgttccattcctgcacctttcacatccggtggtttccctgccagcgaccttgtctttcagtggttctcgtcgagctcgcgctgcagctggccgagcacgtcgcggaagacctcgatgcgctggtcgtcgtctttgccgtcaaggtcggcgagctgtgggtaacgttcggtaatatcgtccggcatggccgctccttatgcccagtgtttcatgtgcccctgcacgtcacggaaaacgccgccggccttgcggcgggcggcgatgatcacagtgagaattccggcaatgagaccgaaccgatgtccccgccgttgtcggcgtacgtccatgcagcggcgcaggccgcgcgcagggcgttgatgtcggtcgcgtcgctcaccgtcagtgagccgtcttccagccgggcggtcgcgtcggcgcacgtccagacgttgccgtcgctcgcatcggtggatggctgggcctcctgcagtccgcgcaggtcgcggacgatataggacgggcgcagatgcgccggcgccgtcatcagctcatgcgggttggtgacgccggtcagcaccgcgagggaatcgtatccgccgcggttgccggcctcgatgtccgtatcgagacggtcgcctatcgccaggcacgattcacgactgaccggctccgtctcgtttcccgcggccagcagtcgggcctcgtcgtacatggcagactcgggcttgcccgcggatgcgataggctcgacgccggtcgcgttgatgaccgcctggatcatggaaccgcatcccggcgcgatgccgagctcgcggggaatggtcaggtcgcggttggtgacgagatacagcgcgccccgctccaccgcgtacgagacctccgccatctgctgccacgtcatgtccggataccatccctggatgaccgcctccggggtgtcctcggcatggtctaccacggtgagtccttgaccggccacttcctcgcgcagatgctcggcacccagcacgaggatgcgcgctccggccggaacgtgccgggccaccatgcgggcggccaccacggacgaggtgatgacctgccgcggttcgacgtcaaggccgaagcctcgaagctgctcggcgacgacgcgctggaaacgggaggagttgttggtggtgtattccacctgcattcccgcacgctgcgccgccctgatggaatcggcggcgtgttccaccgggttcttgccccggtagacgacgccgtccagatcgagcagcgccagccggtacgtctgagatatgggacggtcggtggatttgagcatggcgttcatgcacgtcactcgtcctgcgcttccgcagccggttcggcggcatccaaagcttccgcttcgtccgtctgcgcatcgtcggcttcggcgggttccgcgtcctcggcttcatcagcggcttcgccggtgtcatcggcgttctggtcggcggggtcggtgaaggattcggcgccttcttcggtctccttggccgtcagctcctcctcgtcggccagcgggccgtcaagggacgcctcgtcttcggcatcggagttctggccggcttcggcatcggctgagtcatcggagtcatccgattcggcatcgtccgactcgtcgccgtatccgtcttcggagccgccgtacatgtcgtcgtagtcgtcgggcgcgaactgggcgtcgtcctcgctgatgccgagcatgtcgagctcgtcatcggtgaagtgctccatgtcgtgatcgataatcacgtcgtccacggtctcgtcctcatcggcttcggcgtactgggtttcgagacggtcgagcaggtcgtccaatgcggcggcctcctcggtacggccgcactcgtcgaggaagtactgctcggcctgcacggcacgcatgcggtattcgcccggcagccctttggaacgtccgagcgtgtggacgatctcgatggccttgtcccacatcttgaggtcggcgagggcaccggcatagaccaggaacatctcggctttcgcctcgccatgcaacgccttggcatcgtcggagcgcaccacttcgatggccttcttgggatcgccgttgccgcgttcgcagtcggcgatgaacggcaggtagtcgaggaagccgttcatgcggtacgcggtgcggaactcacgcagggcgagcttgtaatcgccctgacggtacgcgatgaaggcaagcgtctcacgggagaaatcgatgcgcgacgcctgatgagcagcccacttggcgtgggcgagggccagttcgggatccttctcctccagcgcataggcggcgaggatgtgcaggccgatgttctcggcgtgctccttggacaggccgcgcaggcgttcacgctcttccttggacagcatggaccattccatgcccttgggcatcttcggctcgttcggacgacgatccgtataggggttctgcgaagggtagcttaccgtgccgtcggaattgcgacggggaccgttcatatagtcctgacgcttctgctcccgatattcgcgcttctcctcggcggagaactcgcgacgctcgccgtcgcggcggtcatcgcgctgatagcgcgggcgatcgccatcacgatggaagtcgcggcggtcatcgcgacggtaacgcgggttgtcgccgccgcggcggtcatcgcgacggaaaccaccacgatcaccatccttgcggaaaccacccttgtggaagtcacggcgctccccatccttgtggaaaccgccatcccggcggaacccgccctgatcaccgtcacgacgcggaccgcgatggaaatcacgacgatcaccatcacgacggtcatcacgacggaaaccgccgcgctcaccatcacgacggaacggacggtcaccatcacgacggtcatcgcgacggaaaccaccacgatcaccatccttgcggaaaccacccttgtggaagtcacggcgctccccatccttgtggaaaccgccatcccggcggaacccgccctgatcaccgtcacgacgcggaccacgatggaaatcacgacgatcaccatcacgacggtcatcacgacggaaaccgccgcgctcaccatcacgacggaacggacggtcaccatcacgacggtcatcgcgacggaaaccaccacgatcaccatccttgcggtaaccacccttgtggaagtcacggcgctccccatccttgtggaaaccgcccttgccgcggtacccgccatgctcgccgtcgcgacggaatccgccgcggtcgccgtccttgcggtaaccgcccgacttgcggtaaccgccggaacgtccggagccgtaaccgcggttgccgtatgatttgccgccggagcgaccctgttcttctgccatacgtgtatgcctttcttaatgcaaagtctgttgttgcgatgcgatgtcacgatgagcgggatagcctccatgccggcgcaaccaccccagccggccctggccggcagctccccgccagtgggagcaggaatgaatcagtgcttctcgacgacgccgagcgccttcttgccgcggcggatgagcgcgaaacgaccgtgcaggaaatcgtcctgacccaacgtctgctcttcgtcggtcacacggttgttgttcagatacacgccaccggacttgatggtcttgcgggcctcggaaatagacttgaacaggcctgccttcaccccggcctcggtgatgcggtcgtcgatgccgacggacgcgaacgtcttggcaccggactcgtcctctatcttgagtccgtcgatggcggcttcaagcgtgtcctcgtcgatggaggcaaggtcgccgccacgcccgaacagggctgcggacgcgtcgatcgccgcctgcgtcgcggcctcgccatgcacgaagctggtcacttcccatgcgagggtgcgctgggcttcgcgtgcgccgggattggtgcgcgattcttcggcgagtcgttcgatctcggcctttggcaggaacgtgaacgccttgagcaggccttccatctcgacgtcggggcggttgaaccagaactggtagaaccggtacgggctgagcatggtggcatcgagccacaccgcgttgccttcggatttgccgaatttctttccggtggcgtcggtgatgatcgggctggtgaacacgttcaccgtgacgccgcgcaccttgcgaatcaggtccatgccggaggtcaggttgccccactggtcggatccgccgatttccagcgtgcagccgtactcgtcgaacaggtgaaggaagtcgttgccttgcagcacctggtagctgaattccgtgaaggagatgccctcctcggagttcagacgacgcgcgaccgtgtccttggccagcatggtgccgagtcggaagttcttgccgacgtcgcgcaggaagtcgatgacggacatctgtgcggtccagtcgtaattggagacgaaacgcaccggattgtcgccgtaggtttccagaatgccgccgatctgccgcttgagccgttcggcccagccggcgacgacgtccttcgggttgagggtgcgctcgcccgactggcgggggtcgccaatcagaccggtcgcgccgccgaccaaggcgatcggatgatgcccggcggcctgaaggtgacgcatgttgatcagctgcacgagattgccgatatgcagcgacgccgcggtcgggtcgaagccgcaataataggtgaccggctccccgttcaacgcttcggcgagttgtttcctgtcggtggactgggaaatcaacccgcgccattccagttcttcaaggacggaatcgaatccggcctctttgaaatcggtgacgtgagccatggatattggtactccctatcaaattctgggcattgtgcatctatcagtctcgcagaacatatcgacagcatgcgccaggacgactgcccgcgaaacgtcggggaatgctccccggttcgtcgcttgaatccggccgtcagtgacggtacaggctttcgagaatccggcgcagctgctccagcacatcgttgttgcgttcggtgcgcagtttcgggaacgaggcgatcattcgacgctgctgacggttgaagatggacatcgccgcgtccctgacccgcatcatgaagtcgaacgacatctccttgccggatttccacgattcgctcatcttgccggtgacatcgctgacggcgaccttcatggcgtctccgtaatgcgtcatggcggccatgagattgtcgagactgttctcgaaatgcatgatgccgcacaccgtgacgacgaggtcgatcagcgtgagcacgaacagcaccccgcacagccagtggatggcgggcagcggcagccggtcggtgacacctgcaacctgcggctggatcaccgacgtgatgagcacgccgcccacgccgaacacgaacgcccccagcaggcagatgcgcccgttaagattgaatttgtagtcggagtagtcccaccagcgggcatgaaacagcgcctccatgacccaggatgtgacgtattccagtatgctggcaccgaccatcgaaagcaggaacaccaccaggggattgtgtacctgtcccagcaccacgacggcgccgactgcgcccgcaccgtaaatcgggcacaacgggccgttgaggaatccgcggttgactggccggcgctccaggatggacacgagaatggactcgtacacccatccgcagaagctgtagaacaggaaccacaggaacagtttttccacgaacagcatcaggccagcacctcccggctccgtgagggcttgtgccgcccgtcgtgcgcggacgctgcggatgctccgctttcgattgcggcgaggggtttaccggactccagttgcggcttgtagaaccgctccagggagaaggtctcccgcgtggcactgatcttgtcggccatggtgaccagatagccttcgatgtagctcggcggcttgagcgtcatggggaacatgtggcatgcgatgctgtcacgttcgatcgcgttgaggcggaagtcacgcactgcgttgcgcaatgcagcctgcccgtgcgtgaacccatgcagcctatgggcgccgtcatcccagtcatgccagtcatacaggaagtaatcgtgcagcagagccgcgcggaccagcgaatgcagatcgaccttgtcccacagatgcaggcggtcggccatccacacggcgaggcacgccacgcggatagaatgcgcgaatgtcgtcaccgctccatgctggtagcatccgcgctcgatatgctgcatatgatcatggacgatgatgtcgtgcccatgctcgttgaccaacgaccgaatctgattgcgcgtcagcacactgtttcccttcgcccgaatccgtcttccgtatgtctgtgtctcttccagtcatgattctaggtcaggctcctgtcacgcgggttcatccttcaggatgaacccgcgcgcgctggcggggatgtggaggcggtcagtcggtgacggagcgcagggacttcggggacttgtaggccggaccatcgctcacggagttggcgaacacgcgcagcgcgtcgacggtggccttggcgcaggcgatctgctcacgtacacgggccggcgacgtgccgcccttgccgttgcgggcggacacggagccttcggtggacagcacctcgcgcacctgcggggccttgtcggcgggcaggaagtcacggaagatcccgatgaaatcgtcatccgtgagatcccacagctcctggccgcggccttcggcgagcttgacgcatgcaccggaaagctcatgcgcgtggcggaacggcacaccattcttgacgagccattcggcgatgtccgtggcgagcgcgaatccggtcggcgcttcggccgcaagacggtcgtggtcgaagctcatggtggcgatcataccggtgaaggcgggcagcagcacctccagcgtatcgacctggtcgaagaccgcctccttgtcttcctgcaggtcgcgggcgtacgcggtgggcaggcccttgagcgtggcgagcaggcctgtcaggtcgccgatgagacggccggacttgccgcgggcgagctcggcgatgtcggggttcttcttctgcggcatgatcgaggagccggtggagtaggcgtcatcgagacgcacgaacgcgaattcctgggtgttccagatgatgatctcctcgctcagacgcgagatgtcgacgccggccatggcggcgacgaacgcgaattcggccaccagatcgcgcgaggcggtgccgtcgatggagttctcggtaaccttgccgaaaccgagttctcgggcgaccgcgacaggctccagtccgagcgtgttgccggcgagcgccccggagccgtacgggctggcgtcgatgcgcttgtcccaatccacgagtcgctgcacgtcacgcagcagcggccacacgtgtgccatgagctgatgcgcgagcagcacgggctgggcgtgctgcatgtgggtgcggcccggcatgacggtgccgccggccttgaccgactggtcgatcagcgcggatgcgagggaaagcagctgacctgcgatgacgcgggagtggcggcgcagccacatgcggatcaggcaggcgatctgatcgttgcgggaacggccggcgcgcagtttgccgccgagctcgtcgcctgcgatctccagcaggccgcgctccagcgcggtggcctcgtcctcgtcgtcttcgatgggcgcaaacgcaccggagtcgacgcggcgctgcagctcgtcaagcgaggcttccatgcggctgagctcatcggcggtcagcaggcctgcgcggccgagggcgcgcgcgtgggcgcgggaaccggcgatgtcgtcatcggcgagtcgccagtcgaactgcgtggatttcgacagacgggccagctcgggcgacggtccggaagtgaagcggccgccccacagggcgaggtattcggtgttttcagccatgcgatactccttggagaatgggcatattcgtgcggtttcgactgtctgccagactatcagcgttgtgatacattcccgtggcggctctccggtcgagcggccagacatacacaagcaccagcaggaatggcaccgtacagcgttacaaaaccgtcagagggcgaatcgccagtgcgagatctcctcgtcgatgtcgaacccgccttcgagcacgaactgtttcaacagtttcgacgcctgtactttcactttgaaattcggcagcgtcacattcatgcatcgctcgaagaacgatttcgcccgtggcacgtcgatggtgtcacgcagggcgtcgaatcggccgaatgcgttcagacttttctcattgatatatctgacggtgagttcttcaagcaacgacctgtcgacgccgagatgatccacgagcttgtcgatctgctcatctttctctcgtttggcatagcgcgtgatgtagtcccgcagcgtcatgccttcctcgacttccacatcgccacgctccacatcatgcaggaacagctcagcaagtcgttgttcgtccctcgaaagcgcagcgaaggatcggtgcagctgtgcggacatctccgccaactccggactgtcctccttgagtgccttgagccatttgacgaagttggcattcatgtagtcggtgtcgatcagtccggtgtcgatttcggtgagatacccttccagctcataaggcgcttcggggtcacatctcccgtcatcgtccggttctccggcgcagctgtcatcatcgaacagctccttataccgctgggcgagaatcagatatgtgcgttcgtcaatttggggacgcacgatatcaggttcgccgttcccgccatcgttctcatccgcatcgtcggcatccgtgccatcgaccttgtattccgtggtgttccagtcgaaaccctgcactttcgccgcttcaaggtaacgattcagctctacgaactccttggcgaacttgcgtctggcctccaccgattccggcagctgcatgaggtccgattccccgttatccgtgaacacgtcgagaatctccaagtaccgtgtatccatggatttcacgttcgcgggcagtttctgcacgaacaaatcaagcggcctgtcgccggagtacagtttcaccgccgcttcgatgaagccgtacatggtgtgcggcttgcggtagtagcggatgactccgaacggcttgtccggcccgaacaggcggttcgtgcggctgaacgcctgaatgatgctttcgtagtcgatgatcttgtcgagatacagcgtattcacccattttgagtcaaatccggtgagcatctggtccacgacaatgagcaaatcgagctgctgactgcggtttgctgctatgccgccgtacggactcttatgcgatagtcgcgacgaaatatctttcttcatcgccggccatgtggggatgatgaactctttgccgaacgcctcgttgtaatcggtgatgatttcagtcagcgcatcttctttatccgttgctccttcgttgttgtcgatgttgggatcgaacaacgccgttacatgcaacttaggtgcttgctgcttgaacaagtgataatagttgacagcttcaggaatggagctagtggcgagcatcgcatggaatttgcccgcatggctgagcaccgggaactgttcgagaatgtccgagaccaccatgttcggatgcggggagtcgatgccatattggtctcgtccaaggaaatcctcgatgccactgatacggtttccagcgccatcaaccatcggccccatagggacctcggatttatccatgtaatgctgaaacaccttagctttaatggggtcagcaagtgcatcttccgtactctcagctttcgccttgtcaagagctaccacacgtctaacatcggaatccttgtacgtggtcaccatgtacggatcgaatccgagcacattatggtcacgaatgccgtcggcgatgctgtaccggtgcaagcaacggccgaataccatggcggtggtggagttcttcttctggttttcgcccagaatgggtgtgcctgtgaatccgaagaacagcgcgttggggaaggaacggcggatgacttgcaacatgtcgccgaaggtggagcgatggcattcgtccacgatgaagacgatgcgtcgtgcagcaagttgatccagccatgtctgggtgacgccccgctcccctgctttcacgttgctcatcttctggatagaggtgacgatcagggtgtcgttgacatcggtgctgttgagtttgtcccgcaaaacaccggtgttctccgtgccctgcacttccgtctcgctgtcggcgaagctgcggtactccttcaacgattgagtacccaattcaatgcggtccatgagaaacacgaccttgtcggcgtcatgcgagtcagcaatgagctgagccgatttgaagctggtcatggtcttgcctgaaccggtggtgtgccacacatagccgccgggtcgtcccggcatggagggtcgctgttcccaatcacatttcctcaccacatcggagatggcgtttgccgcgatgtactggtagctgcgcagcaccttaaggcatccatccgccgagtcggcgatggtgtagaagccgatgagctggtgcgccatgggaatggacagcaggccggcggtgccggaggtgccgccgatgaacagcttccattcgtctttgcctgggtgttgcccgccacagataggctcgttgttgtagtccgcccaatggaagtaatagcttggattgaatttgtccgcgccgggattggcgaagtagacggcgtcgtcgggggtcatggccacgaagatctgcacgagacggaacaggccggtgaacacgccttcgtgcgcgtatttttcgatctgattggtcgcttggctgacgggtatgccgcttttcttgagctcgatatggatcaatggcatgccattgatgaggagcacgaggtcgccgcgccgcgagctcaacatcttgttcttggctggatagaccggttgctgagcgatctgataagtgcttttgccgcccgcgatttccttgcggtcatagatgtagagactgacttccttgccgaaatgcgccacatcttctttgttgtcacgcgtgatagacacggtacgcccgttgacgaacgaattgagcgcgagcggcgttctcagggtctcgatctgctcgattacctgtgccatttccccgtccgtcagcgggtatttgccaagcctgtctatgtcgttgttgttgcggtacagtatgtctttccaattgtcgagcaaatcccgctcagttggatagcgcaggacaccgtccttccatccatgctgcttaagcacggtgatgacgttttcctcgaacaccgattcgctatcgaatatcatgattcttctcccctttggacttcccattgtcctgcttttcgcgagccgacgcgcttaagtaatccacgcccaatgagtatttcagcatccctccgcacagtcgctgatgaaactcccgcggcatgtgccatgtcgtcatatgttgctctggggctcttttctacaaaacgcagaacaattcgctgtctctcggttatctgctcattcaaaccatttaactgctcattattgtcagttatctgctcattcgaactatttatctgctcataatcgtcagttatctgctcattgttatcaggcttggcatccgcctccaacatgagcgtgagtatcgtgcgatcagcttctccgaagttctcttcaatccgtggttcaggaagtcctgcattcgcccatgtggcgaacacatcggggacacccgtaccagctcgctcgcccacatcgattaggctgaacatcttcatgacaagaccgttgcgcggatcagacaccccgccgaggcgcatctgttcaatgccggttcggatatcacccggattctcgaacaccagcttgtcgggggtgcgtctgaccaccactccgcgtacgccatggtaatcggcgttgaacaagcagttggccaacgcctcacggaccgccttatgcatgggggtgtcatcgacgcggaaaatgccgtcgagcttgaacggggtcttcagggattcggcaagcttgcggttcacgcggaaaaagaaatcaaagaggttgcctgaccacatgccatcgccggaatggacacgatcagtccaacgaatcgtcggatctagagtctcctgataatcaaggaaataatgcggacattcgcgcacgatgtcatagtcgttgccgaacataagcagaccgccgaacgtaggatgaagcttaccgtcttctcggctcaccattgccgcgccaacagcacgcagaaaacgctcgtcatcgagatcggtccaggagctgccctgtcgcgctgcgcggaaacgattgcgatatgcccgcactgtgtctgtattgaagtcggcaacagtgagatcgtccagcaccttggaatccatcgtctcagctccctgatcccggagcattgctgagatctcctgccgcgtgcaacggtagtcgccctcaccacgccgacggtaggttcccccgaagagatcattattgatatacacggggcgttcgtcacgcggagcgcgcggaacgtgaatagccaccaccatgccaccatccgcttggagcacctcgacttccgattcgatgggcagcacggcgcttaccttggaccggttgctgaccgtgttccaaaagtcctggcgaagatgttccgcttccactggtgtgagcccgactgtttcaaatgtgccgtcttcgcgttctttgacaccaagcaggatgacaccgccataggtgttggcgaaggcggagtaggtctcccatatgctgcgcgggaggccgcccttcgcggacttcgcctcgatccggttattctcgcgatatgaggcgagcttcgcgatatcgaatggttccatggcgattcctcccctcacacgaacatcttgtcaagcaaggatttcttgatgttccgcagcaattccaacttacgctgatgaagggtgatgaggttgtcaagacgggagaagaaggagccgatgacttgctgctcttgaagcgaaattggtatacccatcgtataaagcgaccgtattacggacggatgcgctttaaccgtgtagtcaaatttaattcgagaatgcgcaagagacatcgcgtaggcaaggaacttgcagtttatcttctctggattaactgcgatatagcctgatacgttcgtaaccgagaaacggtgctttcttcggtaaaagacagcccctcctccatcaatcgaccaggtgattagctcctgattgaacatgtacttcccgtaagcccccatgcgtccattatcaagagcactggaggaatacaccggaaatgttcccggtgtattcgacatatccttcgcggagattaccctccctctgcccatgtaaagggtggcatctttttcaagttcccccaacttacgctgttcccaagggtcagtaaaaccagcgaaacgaatctcgggtacagactcaccatctttcgggaacattttttcaagcatcgattttttgaacacgacgagcttgtcatacttacgctgatgaagggtgatgagggaatcgaggtcgctaaaaaactcgccaagccggctctgctcattaaaacttggaacaagtgcgatggtttcgttaattgcttctttagataaactgggcaacccagtcgattcatccttggatttccaatcaacattcaaaaacgagcaatgaacgaattcaaggtccatgtccgattttggaatcgcataaaacagcgtgtcaaccgtccaaaatggagcctttagcaaatacggtttgtcgatcgttcccttcctgccgataccaacagcatcgcggtcgtaagacaaagcctcgtcaacgctcgtcataaaaccgccggtcccatagacgggaatggggccttcttcgaggtgcttgtaatccttaccgctgcaaacatcaacgatatccgagaacttacgctgttcccaagggtcagtaaaaccagcgaaacgaatcgcaggaactttcgcctgttcagtcatcattcacctcccaacagggtcttcagctcggcaataccggccatgtcgaactcattgccggttagttgaccaagcatattgccaagttctgcctcagcctgttcgatctgttcgcacacatcggagtatgtggtcgaatacttgtcgttcagcgcattcaccgctgcaatcaactcatcaacagccgtctgagggagctcctcaagcttgcgctgcaatggttccacccacttggcagcaagcaagtcatcagcatgttcatcgctcagtccttcaataacggtccgggtcttttcatcaagcgctgaacggagattcttaacgttctttttgacttcacgctcttcatcaaacaaccgctgtgcactcacaagagcacggtcaaagtcagtctcgggattcttcccaatcgatttcactgctttcttcaattcagcggcaacgaaagaatctccatcctcgctgacggcatcagtcgaactcttgtcatcctcatccagattttcaagaatgtcagcgatttcgccgccaatcttactcagccgagattcaaatgtggcaatttccgcaagatcagaggtaagatatttcccctgtacgagatcgaacggcagaatatgcccgacccagccgtccggcacttcgacatccttaccgcctttcttcttgacgaccatattggcatcgactttgcgaacggcgtcatgcccctcggcctgtatggtttcaaggtcgatggagatagtcttttgccaactatcgtcaagcacctgatacgccgcataggcgtctacgagagggataccagccaaacgacgcagcagatcatttgccagagtctcctcttcggcggcaatgctcacattggcggcattacccaccaattcaccgcgtatataagccggataatcgatgaacgcctcacgataacgctggatatatgccttcacatctgagtcggcattcaccgcctcacgaacgtcttgcacggcgagcttggccgaatggccgttctcctccgcgaaaaggcaccggcgtagtccggggaacacgttccaatatttgctgagtgcatcgatgtcccgcttaggaatgccgccgaacatagtggaatacacatcccagctctcggcattgtcggaggaatccacgtagcgaggaatattgaggttatagtcgttctgccgaatctcatcgatacccaccaagcggctgaacttatcgacgtcacgattccctgtcaccgcatccacgatgcgtttgatatcgctcgcacgcagcttgttgttcttgccttccttggtgaagtatttggaagcgtccacgacgagcacatgatcgtcgtcgcgatgtttgcgcagcaccatcacgatggtggggatgccggtgccgaagaagatgttcgcgggcaagccgatgatggcctgaatgtggtggttctccaccagattccggcgaatagtgccttcctcaccaccacggaacagcacgccatggggcaatacgatggtcatgatgccgtcgtcgcgcagatggtagaggtcatgcagcaggaaggcgtagtccgccttggacttgggcgcgatgccgtattcgaagcggatatcctcgccggcctccggcggttcccaattctgggagtagggaggattcgagaccacagcgtccacgaacaacggctcataggtctcatccttggtctcgtcggtgtcgaaccacggccagtcgcttttcagtgtgtctccgttgcgggccacgatgttgtccggcaggatgccgcgcatgacaaggttcatgcgcgtgaggttgtaggtgttctccttgagttcctgcgcgtaatacctgatgtcattcgggttgccgttgcgacgggccaccgcctggccgatgtggatgagcaacgagcccgaaccgcttgtggggtcatagatgttgatttcctcacggccggcgagatgccaggccacgatttcgctcatgagctgtgagacctcgctcggcgtgtagaactcgccggccttcttgcccgcgttggaggcgaaattgctgatcaggtattcatagatgaagccgagggtgtcgtagtcctgccggctgtccatcggaatgtccttgatgaggtagatgaggtcacgtgcggccttgctgcggcttttctcatcggtgccgagtttggacaggccggtctgcaaggtgtcgaagatgcccgcgaacacgcgcttgcgggcagggtcgatgttgcggtcgaacgcagaaagcgcgtcgcgcacattggcgatggcgaaatcccccttcttcgccacccatgtggagaacaggttatcgtaggagatgaagtagccgcacagatcgcgcacatactgcgcggtctcggtatcatcctcccgcaattcttcgaggtcttcgtcccccatgccatcagcatgcagacgagtgacttcagtctcggaaaggaacttgtagaagatgaagccgaggatgtaatccttgtattcgttggcttcgatcttcgagcgcattttgttggccgactcccagatcttggcggcgagctgctgcttattcattcatatgctccttgcttctgtacacataatcaagggtctgcccctgctcattgacccattcgatccacccgttttggctgccgccgagaacgaatacagcggcggaggagggactggacagctcgacatcgtccgcaagaatcactttgcctgtctgcgcggcgaaaagctgccgtcgagctgccacggctccttgatttttgatcaccgcatgaccaaggtccacctcggagcccgaaagaaccgtgaaacggccggtatcccggttgtatcgtccagtcgcacgcacgccattcttcttggtgtggaacacggtattcactgcaaccggcgttgtctccttgcggtcgagatcatatccgagcacgcgcatgcggaaaagaatgctgccgtgcaggtcctccacccgctgctctttgtatgggttcatgcgaggagcgggagtattcccgttatcggtctcatatgagccgtgttcacgcacgtaatcgatggccttcgcctcaagcgaatccagaacatcacggtcgatattgacatcgttatcgaggaacatgatggctttgttccagaactcctttttggtcttgtgcgcatcaagtctgacaagtcccctcgtggtttgccccgcgtacacacgactcagcacaccatgatcctcatcaagcaggtaatacacaccgcggtctggcagatcgggaagacacttcgcctcgcccaacatgtctctgggcaccacgacagtgacaagcgattccccgtccacccggcaaatacggataccatccggattgttgtcaattatttgtatggtcatggcggtgagcgcaatcaattacttgccgcccttcgccaactcattgatcatgcatgtccttacgaacgccgagaagctcattcctctcagagacgcggcttctttggcggaatcccgcaggttagcgggaatgcgcatggtaactggcaccacgtcaccgtctactagatatgagcgtatctctgtttcaccagcctcatgttcaatcaaatcggagtacgtcatcgcatcccacgctttcaaaccgcagtataaatgcattaattatacacccgcttgggaacagcgtaagttgggagacgttgcgtcttcatttgattacggcttgaacgctgctgcaacagaatacgatggccaaaataaatatctgcgtatcaccgacattgatgacgaaacccatgagttctcgaaaagcgatcttacgacgccgttagctgaccttgcaatgagtgcagattatttactgaaagagggcgatctgctctttgctcgcacaggcgcgagtgtaggaaaaacatatctgtacaggcaattcgatggaatggtctactttgctggattccttatccgtgcccgaatcggcgaaggcgctgaccccgaattcgcctatcaggcaaccttgaccgatgcatacaagaagtatgttgccataacctcgcagcggtccgggcagcctggtgtcaatgcgcaggaatacgcagattatcaattgatgcttccttcaaaaacggaacagcagcaaatcgggatgacattgcgatctctcgacgacctcatcacccttcatcagcgtaagcggcagtggttgaaatggttagatgagggtggagagggcacgcatcacgatatcgacatccttgttttcaagttcgcggatgacatgaagataagtgtcctgtgtggtgttcatgcttgcatgaccaagtcgcttggacacactggcaatcgatacgccggcaaacaacaacagcgaggcatgggtgtgccttaacccatgaatcgaaatcacgggaacgttggcccgttcgcaatgcctggcgaggatgttattcgcggtggagttatacaccttgccattcacgaaaatggggtcgcccgcaggcaaatctttcaggagcgttgagagctgcatgataagctgccaatcgagctgcacctttcgtacggaggatgcgttcttggtggggacgaatcctccgccgttcttgtaatcccacgttttactgaccgaaagggtctgatgcacgaaatcaaagtcgtcgggtgtgagtcccaaagcttccgagaaccgtaacccggttttcgccaccaacagtatcagccaatcccagcttggtcccttgccgagttcgagatccgcaaggaccgcatgaagctcgaactgattgagatacttcgttttctttgagcatggcggcttgcccttgatgattgccttacgagtcgggtcgcgctgaatcagcccttcgtcgaccgcgtcaagaatggctcctttcaattgatgatggaaatccatcgtcgtctggcgctcgtgatgttcggcgtagccgttgatgagcttctgatagttcacgcgatccatgtcggcgagtttgagatcgggaatgagccgacccaaccatgcctgcgtgagccggtatttcttcatggtcacttcacgaattgcaccttccttgtatacgctgatccattgctcgtagtaatcgcagaacaacgtttcggcgttggtgttgccttcggtcatacggtcttctctttctggttgatatgcgcttacgccgatgccggatatatcaccagctaaccatatgaatgagcgcacgcggatgatgcggctttcgcgcttacgctgatgaagggtgatgagatggtcaacgctctccagacaagctgaaattgcccgctgctcttcgagatttgctggcattgtggcttcgatatccgcaaacctgtcatatttcagagtttgggtatctttcgagtttccctgtgaatcgcacaggtatttatatagcatctcaggccgcttcagaagatagccaaaacaagtcgagtctaactcgatggtgggcctagcaactacgtaagctgggctaacgataccatcgtaatcacttgacccaacggccccctgccacattcgcatgctgttgtagacaacatctcccttgtgaaccactttgtaattcacaagactcgcacctggatttgtatccctatccgattctgatgcaggatatattcctttagctacactgacagatagaatctccattgacgatgagcgttcattgctttcgaagaatagctctcccaacttacgctgttcccaagggtcagtaaaaccagcgaaacgaatctcgggtacggactcgccatccttcgggaacattttttcaagcatcgattttttgaacacgacgagcttgtcatacttacgctgatgaagggtgatgaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgattttttgaacacgacgagcttgtcatacttacgctgatgaagggtgatgaggtcgtcgagcttagcaaagaattggccaatttctttttgctctctaccgtctgggatagtgacttctgcgctcagtaagtccttgttgtaaagtcgcttaatcgtgctgccctctaagccccattcaattttggagtataaaggcttgagaaacgcatcgttcaatctatgctcatgttcgagccaaacaatgtttgagtcttgaaaatatgccttctcaccttggtactcaacaatccgcccgatacttcctgcagccgatatcaataacgtacccggggttggatacggataggtacgcttgtagtcttcaaatagctcattggagatgaaggcatctggatccgcaccaaaagttccaatcttaaagaacggaacatcgccctgctccgaggtttgctctttgtagatgcgcttgcacatggcaacagaaccaaattcccccaacttacgctgttcccaagcgggtgtaaccctgtcatgtcagttgtcctcaagtaaggcaaaaggctcccctgcgcatatgcgcaaaagagccttgcaaatcagcgggagccgttcgacgatattactcgacggtgttcttcggcacctcgatgccgttgccgaacttgacgtcgcgggcggcggccacgcgggacggcaggccgtagatgtcgatgaagccgttggaggacttctggtcgaagctgtcgccggagtcgtaggtggcgaggttgtagtcgtacagcgagctgtcggagcgacggccggtgacgacggcgcgaccgccgtgcagcaccatgcgaatctcgccggagacgtacttctgggtgtcctcgatgaaggcgttgagcgactgggtggcggggctgaaccactgcgcatcgtacaccagctcaccccagcgcttgtcgatgtcacgcttgatgcggtgctgttcgcgctccaggcagcagttctccagctcctggtgtgcggtaatcagagccacggcgcccggggcctcgtacagctcgcgggacttgatgccgaccagacgatcctcgatcaggtcgatacggccgatgccctgggcgccagcgcggcggttcatctcctcgatggcctgcagcggggtgacgtcgcggccgtcgatcttgacgggaatgccttccttgaactcgatgaccacttcgtcctcgacgggcgggaacgccgggtcgtcggtgtaggagtagcagtccttggtcgggccgttccacggatcctcaaggaagccggtctcgatggcgcgaccccacacgttctggtcgatggagtacggggacttctcggtctgggtaatcggcagcttgtgctccttggcgaacgcgatctcgacgtcacgggtcagcgacaggtcgcgaatcgggctgattgccctcagggtcgggtcgatggacgagatggaaacctcgaaacgcacctggtcgttacccttgccggtgcagccgtgagagatggtgtcggcgccgaactggtgggcggcgcgcacgaggtgcttggagatcagcggacgggaaatggcggagaccagcgggtacacgccctcgtacatggcgttggccttcagggccttcatgcagtactcgttggcgaactcgtttcgggcgtcgaccacatacgcctcgacggcaccgcaggcgagcgcacggttcttgatggtctccaggctttcgccgccctggccgacatcgagggacaccgcgacgacgtccttgccggtacgatccttgaggtacgggatggccacggaggtgtcaaggccaccggaatatgcgagtacgattcggttgttgtctgccatgggatgcctttctacaaaaacaaactgctgcaagtatatacgaatgtctgtatatttatgcaatcggtgtggcgaatactgaaacgggccccttcccgagcgattcagttcttcgacgcgagcgtcagcagccactgcgagcgctcgaaggcgatgtcgtcctcggcgcatatcaccatcaccgtgtcatcgcctgcgatggtgccgagcacgccgtcgatgggttgcttgtcgatgacgctcgccacatactgggccgcgcccgaaggcgtgtggatgacgaccaggttcttggccgacgcgaccgatgtgaccaagccgctgagcacgcgggacatctgctgctcggccttggacccgatgccgctgccgaccgactccctgagcggacggtcgccgatcgtataggcgatgctgccgttggacagtcgcgtcttcatcgcgttgatctcgtccagatctcggctgagcgtcgcctgcgtaacctcgatgccctcctgggagagcagatccgacagttgcgactgggacgtgacgatgtgcttgagcagcacctgttcgatggcgctcaatcgcgcggcacgtgtggccggccgctgcacgggaggtgtcgattcactcatttatgccctttccggtggtttgccgaacgtctgcgcaccctgcaagccacccgcatactacggcatcgagcattaggccagcagcgattcgtcgccccgctgctgcccgatcaaccaggtcaacagcgccttctgcgcatgcagacggttctcggcctcatcccacaccacggactgcgggccgtcgatcaccgacgcggtgacctccttgccgcggtatgccggcaggcagtgctggaacagcgcgtcgggcttggccagagccatgagctcatcgttcacctgataatcccagaacggcttggagcggatggcgtactcggcttcctctcccatcgacacccacgtgtcggtgaagatgcagtcggcgtcggcgaccgcctcccgcggatcggtggtgaccaggatggagccgccgttctcggcggcgatccgctccgcgtcggcgacgatggcgggatcgggaagatacccgaacggaccggcgatgcggacgttcatgcctgcggtggcaccgctcagcagatacgagttggccatgttgttggccgaatcgccgagataggcgatggtcttgcccggcaaagcatccacaccgccacggtgctgcgcgatggtgagcaggtcggcgagcacctgacaggggtggaactggtcggtcagcgcgttgacgaccgggcaggtggcgtatttcgccatctcttcgacgcggtcctgaccgaacgtgcgccagacgatgctgtaggccatgctggtgagcactcgcgcagtgtcggcgaccggctcgccgcggcccagctgggaaccggacttgtcgatgaccagcggatacccgccgagttccgccacgccgatggagaagctggaacgggtgcgggtggagggcttgtcgaacagcacggcgacggcctgggggccggcgaacggctgacggtagaagcggttctcgcggaatttcatgccgagttccagaatctgcttctgttcggcatggttgatgtcgtcgtcacgcagcatatggcgaagttgaccggccatgaggtgctccttctgtggttcgggatgggtgcggatgttgtatcggcttgggcgtgcggggcgggctggttgtcgcggcccgtcccgtaatcgtcgtggaggtcagtcgttgggcaggtcggcggggatcttcgcgaggatggacacggcttcgtcgatttcctgctcggagacgatcagcggcggtgccaggcgcagtgcgtcgggtgcgaccgcgttgacgatcaggccatgttccagggcccagttcatcgccgcatgcgagcagcggtgggacaggaggatggcgttgagcagaccgcggccgcgcacggaggtgaacagcgggttgccggatgccatgatgccctggcgcagttgctcgccgcgctcttcggcgttctcgaccagatgctcgttctcgatggtgtccagcgtggcgagagccgccgccgcgcccaaggggttgcccgcgaaggtggagccgtgggatcccggcgtgaacagcgcggacagcttgcctccgaatgagatcatgccgcccatggggaatcctccggcgacgcccttggcgaacgtcacgatgtcgggagtgatgccgcccgtcaggtcctcgcgctggaacgcgaaccacgagcctgtgcgaccgatgccggtctggacctcgtcgatgatgagcagggcgtggttgatgtcgcacaactcccgcaccttcttcacatatgcgacgtccagcggacgcacgccggcctcgccctgaatgagttcgaggatgaccgcggccacaggacccttgccgtactggccgagtccggtggcagagaacgcctcatacatcgcgatggggtcgcctgcacgcacgaattcgatgttcggcaccagcggctcgaacggcttgcgaatcacgggcttccacgtggcggacagagcgcccatggtacgtccgtggaatccgtgggtgagcgccaggatgcgcgccggcttgccgccgatgctcgggctcgcgcccggcagcgtgcgaccgtacagcttggcgagcttcagcgcagcctcattgccttcggcaccggagttgccgaagtagacgtgggagccttccggggccccggcgagctcaatcagtcgcgacgcgagcctgatctgcggctcggtcgcgaaatagttgctcacgtgggcgcatttcgcggcctgctcggacaccgccttcacccatgcggggtgcgcgtagcccagcgaattgacggcgatgcccgcgaggaagtcaaggtattcgttgccgtccacgtcccatatgcgcacgccttcgccgtggtccatcacgcgcagcggcgtgccgaacacgttcatgtggacctggctgtactgtcccagccattgcgagtcggtggggccgagcgtttccttagtaggcataggaactcctcatttcgatgccatcatcgggcacaaccatggtgccgatgccggcggtggtgaaaatctcattcaggatggaatgcggcttgcggccgtcgatgatgtgcgcctgcggcacgccgccatcgagggcgcggacgcaggcctccatcttcgggcgcatcccggattcgaggtcgggaagcatgtcacgcaggttctccacaccgatgcggccgatcagcgagttcttgtcgggccaatcggcgtacaggccgtcgacgtcggtcaggatgatcagcttcctggcgccgagtgccgcggccagcgcggcggcggccgaatcagcgttgacgttcagcacttccgtggcgtcgtcctcatcgggggcgaccgaggagacgacggggatgcggccggccgagatcaggtcctccaccgcggaggcgtcgacgctcaccacgtcacccaccagcccgatgtcggtaggcttgccgtcgatgatgggtttgcgctgcatggcggagaacagggcgccgtcctcaccggacagtcccacggcgaacggcccatgcgcgttgatcagtccgaccagttccctggacaccttgccggtgagcaccatgcgcaccacgtccatggcctccggagtggtgacgcgcaagccgcccttgaactccgacttgatgcccaatgccttgagcatgtgcgagatctgcgggccgccgccatggacgacgaccggatgcaggcccacctgccgcagaaacaccatgtcttcggcgaagcaacgcttgagatgctcgtcgaccatggcgttgccgccgtatttcaccacgatgcgctgcccggcgaactcctccagccacggcagcgcatcgatcagcacctccgctttctggtcggcgcgcaggtcggtgtgcacgtcgaaatggaaccctggtcccttcagttcagtagccatattctcctctatcgcatcccgcttctccggccggcatgtgccggggaggaaccgggagactagctttcgtaatcggcattgatatgaacgtactcgtgggtgaggtcatcggtccacaccgtggcctgttcgtcaccggcgttgagatcgatgtcgatgtgcacctcgcggggggtcatgtcgacttcggagcggtcgcgtcccgcgcccccattctcgcagatcctcacgccgttgacgtccacggtgaccttctgcgaatcgtagggcgcctcttcgacgggcacggtgcccagcgaggatacgatgcgtccccagttcgggtcgttgcccgcaatggcgcatttgagcaggttcgaggccgcgaccgcgcgggcgcaggccagggcggcgctctccgtggtggcgccggtgacggtgatgcgcacgtcgtggctcgctccctcgccgtcgccgatgatctgccgggccagcgatgcgcatgccttggcgaccagggcgttgaactcgtccggatcgggctcgacgccggacgcgccggatgcgagcagcagcaccgtgtcgttcgtggacatgcacccgtccacgtcgatgcggttgaacgaatggtccaccgcggcgttcagcgcagcctgcagctgaccggcgccgacggcggcgtccgtggtgatgacgcacagcatcgtggcgagctggggggcgatcatgcccgatcccttgaccatgccgccgatgcgatatccgtcgccttccagcgatacggtcttcggcttcgtgtccgtcgtcatgatggcgtgggacgcgtcgcttcccgcctggtcgtcgtccgacagggccgcgtacgcgctctccactcccgacagcacatgatccagcggcagcagctcgccgatcaggcctgtggagcatacggcgatctcgtcgggctgcgtcccgacgagctccgcgaccttcttggccgtcgccgccgattgctcgtatcccgcctggccggtgcatgcgttggctccaccggagttgaggatcaccgccttgatatggccgtcggcgaccgtcttgcgggaccactgcaccggtgccgcgcagaatcggttgaacgtgaacacgccggccgcgctgtcgagcggcccctgattgacgaccagggcgagatccttcttgccctcgacggaggagatgcccgccgcgacgcccgcggcgctgaatcctttggcgaatgtgacactcacggtgctactccaatcttcgtaagtcccttgtcttcgggaagtccaagtgcgacgttcagcgactgcacggcctggcccgcggtgccgcggttcaggttgtcgatggcggcgaaggcgatgagacgcccggcgtgccggtcggtgaccacctgcacgtgggcggcgttcgatccgaagacgttcgccgtggccgggagcgtgcccggctccagcagcacgatgaactcctggccggcgtatgccttggcccacacgtcgtggatttcctcgtcgctcatggaaagcgccttgtcggtcatcttcgcgctgaccgtggcgaggatgccacgcgccatcggcgcgagtatcggcgtgaatccgagcgtgaactcctcggcccgggcggcgtccaaacctgccgcatgggcgaagttctgcagaatctcggggatatggcgatgcgtgccgcccacgccgtagggcacggcggagccgaacgcctcggcggcgagcaggttcgtgcgcttgaggttcttgcccgcgcccgaataccccaccaccagatcggcgacgaggtcacgacgttccacgagtccttcggcgatggccggctgcatggcgagcgtcgtcgcagtcacgttgcagcccggcccggcaatgcgcttggcgccggggagcaggtcgcgctgacgcgtgtactctccgtctgcgctcttgccggtgatcagctcgggcatgccgtacgtccaatggtcgaagaactcgcctccgtagaacgcgtcccacgcggagcgctcctcaagacgatggtccgcacccaggtcgacgaccacggcaccggggtcaagctgcgcggccaacgccccggacgcgccgtggggcagcgccaggatgatcacgtcatggccgttcagcacttcggcggtggtgtcctccaccgtcagatccgccagctggggaatatgcggcatatgccgtccgagtttctgccccaccgaggaatggcccgccacgcaggtcacctcgaagtccgggtgggcggcaaggatgcgcaacgcctccccacccgcgtatccggtggcgccagccacagctaccgtatatctcgccatatcacgctcttttcatcgaagacgaactacggcgagtatacatgttatgcagtacattgcatatattcattcatcggcttgcgtgtcgcagcacacggcccatcacaccgaaacggagtcccccgacccgcttccgcccgtgccgggcgccagcatgttgagcatggcctggtacatgtcgtccatcgatatgccgtgcatcgtcatccatatgacgatgatggtggtcagcacgttgatgacgacggccgcgatggccagtccgcggccccgcgtatggaaacgacgggtgcgccagatggccaggcagccgatcagcgcgggcagcaccgggaacgaggacaccagggcgaagatgaacgagaatatggcgtagaaatcccaatgcccgtaaatagggttctgctgcgggtcgttgaggtcgatgccgttgaaatatcggggaggctcccgtcggggaccgccttggtcgggcccaccctgagccggagccgcattgggagcggaaccaccctgagcgggagccggcccggctccgaacacggaggccggctgagacggcgacggctgcgcctgcggagccggctgctcgggctggcctccatatacgtaagggttgtaattcggcggaaactcatccgccctggcaccatattcaggctcgatgcgctgaccatattgcggctgggccgcaacatgccgggactcgcccgaactatcgtcagacgattgcggctgttgttgcggctctgtcatatgcatgtcctccatggtgccttttcgtcggcggtcaggcgcgcagctgcgcgccgatgacttccgccttgtcgacgatggccttgcgaatggcctcactgtcctccgcggacagtgtcttggacggggagcggaaggtcaccgcgaaggcgagcgacttcttgccctctcccacctgctcgccggtgaacacgtcgaacagctcgatggattcgaggttggcgccggccgcctcgcggaccacggcctcaagctgggccgcggtcaccgactggtcgacggtgaaggcgaggtcctgcttgacgggcgggaacgtggcgatgggcttcgcctgcacgggcttgccgtcaagcgtgccgaacagcgcggtaaggttcagctcgaacgccgcggagtgcgccggcagtcccagcgcctcgttgacacgcgggtgcagctctccgaccatgccgacgacctgttcgcccgcgacgatctgcgcagcgcggccggggtgccactgcgcgggcacatcctgcgcggcgggctgccgcagctcgtaacgcgcacccaaacggtcgcagacacggcgaacggcctcgacggcgtcgctccaatcgacggcgcgacgatcgccgagccatccggagtcgaccgcgttgccggtcagcaggccggcgacgtgcagcggctgatcgggaaggcccgcatccagcgcggcaagctgctcatcgctggggcgtacgcctcccggaagagccgggatggcgggcgcgttcggatcccacaggtacacgtggccgatctcgtataggcggatgtcttcgaggcctcggcgcaggttgcgctgcacggtggtggcgagcgtggggagcacatcacgacgcaggtacgggcggtcgccggccagcgggttggcgatctcgacgctcaccggcttgatgaccgccggatcataggagaacgccttgaagtcctcatcgccgacgaacgggtagctcagcgactcgaccatgccgtattcggcaagcgtgtctgcgacccagcgctggcgacgctggtcgggggtcagcccgaccgcgcccttgaccggggccggaggcacggtgacggggatctcgtcgtagccgaccagtcgggcgacttcttcgaccaggtcgcacggctcattcagatcggggcgccaggtcggagcggacacagagaactcgccgttgccgccgccagcgacacggcatccgacatcggtgaggatgtcgctgatgcggttgacgtccacgtcgagcccggcgacgcgggcgacctcggtggccttgaaggggatcggacggcgatacatcgtcgtgttcacgtcggtcgggtgcccggacggctcgccgttgccgaacttggtgagcagttcggccgccatctgcgcggccgcgggctgcagctgcgtgtcgacgccgcgctcgaaccggcgggacgcctcggaggggatcttatggcgtcgtgcggaacgtgcgatggagacgctgtcgaaatgcgcggcctccagcaggatgttcttggtgtccgcagtgacctcaccgtacaggccgcccatgacgccggcgatgccgagaatgcgcgagccacgcttgccgtcgggcgaatcggtgatcagcaggtcctcgacgctcaggtcgtgttccttgccgtcgagcgtggtgagcttctcgccttcggccgcgcgacgcaccacgatcggcccttcgatcttgtcaaggtcgtaggcgtgcatcggctggccaagatccagcatcacgtagttcgtcacatccacggcgagggagatcgaacgcatgcccgcgcggataagacggcggcgcatccagttcggcgtgtgattcgtcgggtcgaacccgtggatggcgcgggcgacgtagcggtcacagccggtgacgccgtgaatcgggttgttgtcgtcgacgatgacctcgatgtcgctggagacgccggactccgccgcgggagcggcgggggcgcgcttgttgagctcggtcaccggatcgacgaacttcgcgccggtggaatgatggtattcgcgggccacgccacggtatgagaacgcatagccgcgatccggggtgatgttgatttccaggatcggctggtcgaggtgcagcaggtgcatcgcgtcgtcgccgggcttgagcgccttgtattcctgaggcgtgaagccgtagtcgcgcagcaggatgatgccttcgtggctgtcgcccaggccgagctcgcgctccgaggcgcacatgccgtcggaaacgtggccgtaggtcttgcgcggttcgatcctgaaatcgccgggcagcactgcgcccggcaaggtcacgacgaccttctcgccggcggccatgttcggggcgccgcagatgatgccgcgcggcaccttcttgccgttctcgtcgaccgcgttgtacgcggggccgacgtcgacatgacaccagttgatggtcttgccgttcttctgcggttccggcgtcgcgtcgacgacatatccgacgacgatcggaccggtgacctgggaggcgtggatctcctcctcctcaagaccgaccctgaccaggtccttggccagctgctcgtaggtgaggtcagacggaacctcgacgtgctccttgagccaatcaatgtcaaccataggcatgggcttctcactcccccatcacaaactgttcgctgaatcgcacgtcgccctcaacgaggtcgtgcatgtcgttgatatcggaacgcagcagcagcgtgcgctccatgcccacaccgaacgcgaaaccggtgtactcctcggggtcgatgcccgcggacttcagcacgttcgggttcaccatgccgcagccaccccattcgagccagcccgcgccgcccttcttgtcggggaaccacaggtcgagttcggcgctcggctcggtgaacgggaagtagctcgggcgcagacgcgtcttcgcttcggggccgaacatggccacggcgagcttgtcgagcacgcccttcaggtcggccatcgtcaggtgcttgtcgacggccagagcctcgcactggtggaacacgggggtgtgcgtcgcgtcgagctcgtcggtgcggaacacacggcccgggctggcgatgtacagcgggacgccgcgggtcagcagggcacgcacctgatcggaggaggtctgcgtgcgcagcaccatgttggagccgacgaagccggccgcgtcatgggcctggttgcccttgacatagaaggtgtcctgcatctggcgggcgggatgatccgggccgaagttcagggcgtcgaagtcataccattcggtctccacctcggggccggcggagatctgccatcccatggagatgaacaggtcctcgacgtcctccatgagcttggccagcgggtggcgggcgccgagcgggcgacggttgaccggcagcgtcatgtcgacggtctcggcctccagcgcgcgctgctcctcctgcgccttgagctcggcctccttggggccgaacgcgcggccgaagtcggcgcggagcttgcccataagcttgccggcttccttcttctgatcgaccggcagcgacccgatggccttgctggccttggtcatcgccgattcggcaccggcgtattgcgttttgatggctttgagctcctccaagctggaggcgttctgaatcttgctgatgccctcggcgaccgcatcggtcactgactgggcatcgaagagagcattgtctgccacgagaaccctttcgtcctacctacaactaccgaaactaccggtttatctgcgccaaaaatcaaataatccaagcgtttaccgagttcacattgtccctatatggctcgacatagccatactcatgagcatgatcgcggcgctggtcgccagattcagcgactcggccttgccatagagcggaatgcgcacgatgtcgtcgcacctacccagcagacccggctcaagtccgcgggcctcgttgccgaagatcacggccttgcccaccccggagagatcctggtccctcagcgcctcgggcagctcccttggctcgcgcccgtccgtcccgtagacgtcggcggcgacggtgcggagcaccttctcgccggcccatccgaagaactcgtccacgcccatcgtcatcacggggatatggaacagcgagcccgcggtcgcgcggatcaccttgggattgagcatgtcgacgcaatcgtcgacgaacaccacggcatcgcatccggccgcgtccgccgcacggataaccgtgcccgcgttgccggggtcgcgcacctgccagaacgccgcgacgaacggcttttcgggcaattgcgtcccctgcgccgtcgcgcgcaccgcatcggcatcgccgaccgccgcaatgccctggcaatcggggctgatgcggcgcatcaccgcctcgctcgccggatgcacatatatacggtgttcctgggatcgctcgacgatggacgtcagcgtctcgcctgcgatccgcggcccgtccggcccgtccacggcctgcacataaaggtcacggacggcgccgggcatccacatcaccgcctcgcgaaccgactgggggccctctatcaggaaacgaccgaaacgctcccgggtgcggcggttggcaagatcggccaccttgcgcacgcggtcggccttcatgttgtctatcattctggaatcgatcggcatgactgcaactgtacgcgccaagcgatacagcggtgccgggcgccacgattcggccggctcgccgcgtgcgtctctaacactggactaagaaacgctgtcaaacatcgactatggccggcgaacgggtaacgttgccactatgcaaatgttgttcacagcccgtagggtctcctgcgtcgtgccttctgcgcagtcagaccgcaccatcttcgaggatctgtcgttcgacgtcgatcgcggccagatcgtcgatctggtcggcccgtccggttccggcaagagcagcctgctgaccgccttcgcgctgctcaacccccatgccgacggcacgttcacgctggacggcgcggacagctcatcgttctcgctgcagcagtggcggaggaatgtcgcgtatctgccgcagaagcccatgctgatgggagacagcgtcgccgacacgattcggcttccctggacgctggccgtgcgcagagcggacgaggcgagcgcgcccgacaaccatgcggccaccggcaagaagacctccgcgagacgcggcaggttcagccggctgttccgctccgaacagtcgcaggcgaagctggcgctgcccgaccagctcattcgcaatacgctggacgccatgggatgcgaggatatcgacctggcccgtgcgccgcacgacctttccggcggtcaggcggcccgcgtcagcctcgcgaggacgctgctgacccgcccggccgtgctgctggccgacgaggtggacgcaggcctcgacgacgacaacgcggacaaggtcgcctcgatcatggccagcgcggccgccaggggcatggccatcgtgcgcatacggcaccgtccgcccgacggccgagccacacgcatcgtcacactgtcctcagggaggctgtcatgagcggcaacggttacgtgatcgataattggggccttctggtcgcgctgctgatggtggcggtcgcggcgctcgtctccgagctcatgcgcatcagcatcggcaagacgctgatgtggtcggcgatacgcgcgctggtgcagctgtgcgtgatgggcgtgatcatcgggtacgtgatccgctccaacaacccgtggctggtgttcggcgtcatcgcggtgatgctggtcgcggccgtgcagatcacactctcccgcgccaagggcatcccgaaggggctcgccggcccggtactgctcagtctggtcataaccatgctgctgatgatctcgctggtgaccgagctggtggtgcgcccgcacccctggtatgcaccgcagctggtggtgccgcttaccggcatgctactgggcaacaccgtgtcggcgctcgccgtcggcctgagccggttctatgagagcatgaacgagcgccgcgacgaggtggacacgctgctcgccttgggcgccaccccgtgggaggccgcccgtccttcgatcgtctcgtccatacgactgggattgctgcccaccaccgcctcgctggcgtcgtgcggcatcgtgaccatccccggcatgatggccggccaggtcatcgccggcggagacccactgaacgcggcgaaataccagttcgtcgtgttagccgccatcgccgcgctcaccctcgtggccgacgcgctcatcatgacgatgacctatcggacctgcttcaccgacaaggaccagtacaagccgcccgaggatcgctgagacgacgggcgcgcagaagcgcgacttgcattgccgctgagccggcggaactcatccggctcagcggcaactgcgttctatgaggatgtcggagacggtcaggttcgcgtcgttgaccagattgaacaggatcactcgggccagttcgcccggatccatgaaggtgtgctgcttctcctccgacacgtagtcgcggctgtcgcggtagaacgcggtgtcgatgccggccacgaaccagccgtcggcgatcagctgtttggtcagctcgtatcccaatcccagtgcactaccagtgacgatagcgatgttgcggccgttcgagttcgttatatcatgctccgatcccccatacaatgtatggtcagagtatcggaccattcagccccccccgccgcaccggccacccgattggtcccgcgcagatccccgtcagccggcgaactgcgcggcggatgccgggtaccaccgcgcgaacgacgcgatgttctcctcgccgtccccgtgcaccgcggcacggaccgaagccagccggacggccatccgggcacggacgacggcataataccgggcaagccatccattgatcagttccatcatgcgagtcatcacactcaccttgcctttccatcagggtgtttcaaggatgcagacggtcacatgaacgacaaaatattaatatcgtcattctcgcgatgtccgaatcatcgattgagtccctctcctgcagcaagaagaactgatatctacgatagggatggaatgtaacgacgacaccggcgcaatgatacttttgcgcatcaaaagaaatatagtattttcatatacgttacatcacgcagagagcggcaatggggcactccggtgcacaggcggcgcgaccggcccggaacctggcagggcgggcaggaagaccatcattctcgtcggatctttcggagcggatcgactacaacatccccgacctgcccatatatgccagacgggacgcattgtcgtcgttcccggactaccgctgcccatgtcactggcatcgcgatctggaattcatccatgtcatcagcggtcagatgcaatattccgtcaacggcgccatagtgacgctggaagccggcaacggattggtcgtcaattcgagccggctgcattacgggttctcgccgcagcagaggcaatgctggttcacctgcgtggtggtcgacccagaactgcttgagctgctcggcgcggatgagcgggttttcgtcggcgagctacttcatcaacgtgttccgacggcggcgaggcgtcactccgcgcgtctggcgtgagtcacgctgcgtgggtcgcgtcactgtgcgagggtcatgtcaccgtgcgagggggcacgcaacgtgacgtaaccctcgcacggtgacatgacccacgcacagtgacatacctgacagcggccacgaacccgctacaggatgtcggggtcgtccttgtcgatggtgcccgtggccttaccgatggccttgagcccgtggtaggcgacgaggatgacgaccgtgccgatggcgatgccgttgaactgcacgccctggaacgcgaacgtgaaatcggcgatgccgatgatcatcacgatcgcggcgaccatgatgttgagcggcttgtcgaagttgaccttgttctccacccagatgcgcacaccgatcatgccgatcatgccgtacagcagagtggtcacgccgccgagcacgccgccgggaatcgtgttgatgaccgcgccgaacttcgggcacaggctcagcagcagggcgaatgcggccgcgcaccagtaggcggcggtcgaatacaccttggtcgcggccatcacgccgatattctcgccgtacgtggtggtgccggagcctccgccgaagccggcgattgcggtaccgaggccgtccgcgaacagcgcggtgcccatatgcccgtcataatcgcgcccagtcatctgcgccacagacttgacgtggccgacgttctcggcgaccagcaccagcacgacggggatgaacatcggcaggatcgagaagtcgacctgcggaagatggaatttcgggaagccgatccacgccgcgtcgccgatggccgaaaagtcgacctgaccgcggaagcatgcgtacacatagccgacgatcacaccgagcaggatgttcagacgtccgacaagaccgcggaacagcacggcgatgagcagcacggcgagcagcgtcaccagggcggtgtcccagcccttctgccagttcgaccacacgctgggagccaggttgaagccgatgatcgcgacgatggcgccgttgacgaccggcggcatgatgatgtcaatccacttcgcgccggcgaagtggacggccacgcccaccagggcgagcagcaggcctgtgaccatgatgccgaagctggcggccggaatgcccttgcccgcggaggcgacggcggcgatcggggcgatgaacccgaacgacgatcccaggtagctcggcagcacgttcttgttgatgagcaggaacagcgcggtcgacatcgcggtgaagaacagcgtcgtcgacgggtcgaaatgcgtcaggatcggcaccaggaacgtcgcgccgaacatggcgatgacgtgctgggcgccgatgccgatggtacgggtccaggtcagtcgctcatcgggctccacgacctcgccgggcgcgagcgtcttgccgtcgccatgcagtttccatgtgaacaggtttcccatcacgaactccttcggttctctcaggtggcacatccatgcagccatgtgccgcgttgaggccattgtaacccgttcgcccaccgttgcgatgacgagccacgtgcggcgcgcgactcgtcatgcgcggcccgtgagcgccgtgaggcgcctcgtgccgtcacaggtgcgggtcgaccgaatgcaccacgtcgacgaggtcgccgttcgagagcaacgggcgctggaattcgcgccacggatcgacgcgcacctcccagcgtccggtcgactcgtcgaacaccgggcgcgcggtctgctcccagcgcacgcgcgacgacgtgcggccggtggccgggtctcgccgcgaataatgcaggcacgtgcagttggtgatcgcccatgccgggtcgtcggcgcggcgcatgaactcctcgtccgacaggtcctccagggtgagcatcagcgcgagcatgaagtcgccgtgtgtgacggcgacgacggattccgcctcagcacgccggttgagcgacgtgagcaggttatgcacgcggttctccgacacgtcggcaatagactcgcctgccggcggacgccagtacagcgggtcggtgcgcttgaacatccagttgcgcgcgtagttcgtgcggaaatcgtcctgcgtgatggtgttgatctcgccccaggagcgttcgcgtagcacgcgcgtctcctcccacttggctttcggcagcgccatcgtcgcggcggtttcgcgcgtgcgtacgtatggcgagaccagataccggtcgaacagctgctgttgcgcgacgagccagcggccgatgcagtcggcctgcttgcgcccggtggcggtgagtcgccacgaccggtcgggcacggtcacgttgtcctgcgtgtacagggagttatcgccctgctcccccgcgttgatgatgacgttcgcctccgactctccgtgtcggatgacatatagatccaatggcattcccatgaatgcgtttcctcatttcgttatcttgctatgttgctgtgtttgctgtcttgttgcgttgtgtttcgttgtcttctgtcgccgccgtcttccgccgtttcctgccgtgctgtcccctcgtcccgccgtttccgtcatcgtcagagcggccctgccgtctgccgcgccctgcgggaatcgtaccgcttcgattcaagttcgcggcatggcttcgcgattcctccagattgctccagccttccccacggtacacgcaatcatgccgcttcgcagccgcgctcatgcccacagcgcaacaattcacgcacatgtcaccggtgattcaactgttacccggtgcccgccgcagccttcgtgccgccctgcaggcgtacaatgacgccatgcgattgaaggtgaactgccgggtggatttcggcgacgaaggcgatctgttcctcatgttccacggctacggcaatgacgagcacgagatgatccgcatcatcgacgccgtcgatgccgaagccgactattattcgttccgcggtacgtatgcgcggcgttacatgggtggcaattactggtatccggacggctgcgacgtggagtcgcgccggcacgaatgccgtgtggtcggcgatgccgtcgtcgcgctgaccggctctgcggcctttgccgggcgccgtaagatcctgatcggcttctcgcagggcgggtacctgtcataccgtatggcggtggaacatccgggcgtgttcgatgcagcgatactgctcagcccgtcgttccgtggcgagcaggacgctgaggcggactgcggaacgcgcttccttctggcatatggcgaccaggaccgcacgatacccgtcgaggatcaggatacggcccgacgggtgatatccggaacccgcggcgcgcggctgtgcacgtacccaggcatggcgcatgcgatctgcgaccgcgagatcgacgacatccgtgatttcctgagataggggctccatgccctcaaatacgtcagcgggctgaaacggaggctcccaggccgggagcgcccatttcagcccgctggcaacgcgatgtcgggaatcagaagaacagcacggcgacgccggcagcgaacagcatcagcaggatcgacacgaggaagctcgcgaggaacggcttgcggcccttgaccgcgatggccttgaagttcacgttgatgccgagcgcggccatggccatgccgagcacgatgtacgcgaagtccacgagctgcggggtgatggtggcgatgaacggcacgaaggtgccgatcacggacgcgccgatgaagccgagcatgaaccaggggaacgcgacggagcgtttgccggtgggcgcgacctcggaatgcttcttctcccaccagatggcgatgatgatggcggcgaacacgagcatcagtacgcgcgacagcttcatgatggtggcgatgttgaccgcgttgaaggcgtcgccggcggcgaccgcgtgggcgatctcgtgcagggacgcgccggcggtgatgccgagctggtcctgcgtcatgccggtcagggggccgagcgcgatctcaagcaacgcgaagatcgtgcccatgatggcgacgatggcgacggccatggttacgtcgtcgtccttctcctgctccttctcgggcggcaccttgatggagccggacaggcccatgacggcggcggcgccgcagatgcccgtgccgccggcggtcaggatcgcgagcatcgggtcgacgcccatcttgcgcgccacccagtaggtcacgacgatagtgagcgtcaccacgaccgcggcgatgggcaggcacttgatgccctgcgtgaacagcacttgcaggttgagcttgaagccgagcaggatgatgccgaggcgcagcagcttgttggagatcagcccggccgcgtccttgacgccggccttgcgcttgtcgctggcaccgacgtaccacttgcggatcgggaactggatgatcatgccgatcagcagcgcgatgatcagcgcgccgaacagtttgaatccggggtattgcttgagccatgagccgatcagtgaagcgatcagggtcaggacggcgatgaacagcatatcgacggtggcgatgcgtttccaccatttcgtacagaactctctcatgatgtccattgaactaccgtcatatgccatcggtcaaatcagtgatagtgatggatggtattgatatttttgatgccagattgcagcgaatcgttctcaataagaaaggtgcgagccagatgcgggcggaaacgaacacaaacacctccgaaagcccggaattccgggcttcgtcggcttgttcacttgtgcgaaaatgtgaggaatcctcgcacgtttcttattgagaaccattcgctgcgacacagtcagccgcgcagggccgcaatgactctgccggcaagttcccgctgccccggcgtcagaccggaacgcggcaccaacgcatagaaccgccgcacgaactcgtcgcccagctcccgtgtcggcacgccggccggcacggcggccgccgacaccagggagcagccgaaaccggccgcgagcgccgcgccgatggccgcgttattggcgacctcgatcatgcgagacggcatggagccgaccgtcttgaagtacagatccgtgtaatagcgcacgccggagccgtgctcgcgcaccatccacacgccatgcggatcaccggccagcaccagcctgtcctcgcgcagcgtgacacgatcgaccgagtcgttgacgatgggcttctccaccacacccaactgcacggctttcataccggcctgttccaggatcgcgtcggaattgagcacccgaatcgagcagtcgaagccgctcagcgccttggccatcaccggcagtgcgactggcagcagcacggccgccgtggtgtgcgagaatgcgacggacaacggctcacggctctcgcgcatgcgggcgatctgctcgcaggcgttgcgccacgtgccatcgatgccggtcgccgcacggtacagcaaccgcccagcctcggtcggcgtcacatcgcttttggcattgcggacgaacagcggcgccccgaccatgcgctccagttgggcgatgcgcgacgacaccgtggactgcgagaccttgagctcgtcggcggccaacgtgaactggccgatctcgtagaccgcgaccagagtgtccagcaaggggaacatgaaccgctcctttccgtcgtgttcggcaacgcctgccggaacgtcagtgcgtccgttccggcaggcgttgccgatcggcttgcatcatttgacctgcgtgatccggttgccgctgaccatgaacgccgttctcgccatgtcgatcatcggctggtcgaaccggctgtcggtgtagaactcgtcgatgaccgtgtccgggccgacgacttcgcggaaccgtttcggcttgttcgtattgaaattcagacaggtgacccgcatcgtccgcggatccacggtggatgagaccagacggttcaatccgagacgccggcatgcctcccccacggtcacgtcgaacgacgccgtcaggatcacgtcatccggacgcggctcataccacggcttgatgtggtccatatgccggttccagaactcgttcaccaacgcggatacgccctctgcgatcgcggtctccccggcgagaccggcatcgggagccgcgccgtccagtcgcagtatccgtcgggaagccgcgacatcgtgcaggtaatcgcacgtcacgccgcccacgccgcgttccatttgcgcaagcgtggcccgccccatcttgtactgcaccgcgtatcgcagcaccggagccagatgccgcagcaccttcggctcgtatcgggcactgaacatatacaggtcgaacaggctttcgccgtcatatatcgtgccgtcgaaatcgaacaccctcatcgcgtctcgttccctctcaccctcgcgccgctcccggcccgtcagaactgcgcatagtccgcatccttatgttcccccgtctcaaggtaccgtgcaagatcgtcggacgacgagaacacagcgcgcaccgactgggcgatcatcaggttgatgctgtcgccgtcgcgcaggccctcgcgatatgcgtacacggggatgcctagagagtgggcgaatccgatctcgaacatcgtgccggaatcctcgtccatcagattggctatcaccgccttggaagcgcagatgccgttcacgtcgtcgtcgaagcagcccgcgggaccgacctcggcgatgtcactggcgaaccgcggcctgaacatcgtcttgccgtgggtgtcgagcacatgctccaagcattccatcgacgcgacctgctcgggattgaagaacgggccagcgacgtagaaatcgtagcggcggcgtttgcgcgaataggctttctcgcgcttgcggccgggctcgcgatcgggctctcgcccgtccgccgcttggcccgcctctgcgcccacatccggctccaccatctcgacgaacgtctgcttcatcgtatccagcagcgactgcgtgctttccggaacctcgtcgcccgctccggcgacgtccttggtgagtccctcgatgcggcgacgaatccggtcggcgtcctgcgggtcgatgctgaacttcgccacgagcgactgccgtatcgtctcataatcaaggttgacgaagaagataagctgctgcagcttcatgaagttcttcagctcggggaaccgctcgacgatgtacgtctcgcgatcatccgtggccctcacccagtcgcgggtcagctgcatgctccagtcgccggtgatggatccgcggcgcatgcggtaatggtacagcgcttcgggaatgcgcacgacgcgatgcgactcgccgatcacattgcagatacgggccatgtcctcaatcttgcgcccgacggggaaggagaacccgtgattacggtagatcgacgccgccgcgacgaacgaccagaaatacccgtcgatctcggccttgacctgcgccttgatcgcctcgatcggggtcatgatgatcacgtcgtcataatggttgtgcttgtacgaggatgtcagcggcttgccatcttcgctgatcgtgtcgaactggaacatcaccaaatcggcgtcgtagtcgcgcatcgtcgccatcgcacgttcaatgagattgcgctcgaccatgtcatcggaatcgacgaagtagatatagtcgccagtggccttcgccagtccgacattgcgcgcatcggacaggccgccattggccttgtggatcacgcggatccgctcatccctcgccgtccacgcatcgcacatcgcagggcagcggtcgggcgacccgtcgtcaacgagcaggatctcaagattgcggtacgtctggccgaccagtccttccacgcacgcgtcgagataccgctcgactccgtacaccggcacgatgaccgacacgagcggcgtggccccgtcaccattcatggcctccgccgtcacattcgacgatgtttccgattccgctgacatgcccctcctcgatgctccccggtccgttcggctccactcactgctgacgcacggcggcacgtgcgtcgccttccattgtccatgataggccagggcttgcgcagggcggacgactccatcctgttgtttgccatatcttaaccgcgccgctcaaccgtgccttttacccgcgcggaaacggcggcagaacgccatgccggcgtgcgtcggccaccggattttccatccgccctgaggtcgcgtagacccctcccatcagtcttttgacaccatgcagcattttgccgaaccccgcaaccgatcaccgtggcgggatgcttcttgccgtatatggccgtcagcggcgacagcgcggcgatcaagcagatgctcaacaacatgtccagcgaagagctcctcaaatactatgacggggacagctcgatcagcgcatcgctgttcaacgatcgcacatttcccgctctgggcgttcctcgtgctggcggcgttcatcctgttgttcgcgctgcttcgtctgcacgccgccacgctgacgttctccatcctcaacctgctctgatgcgctttgtacgcgggaatactcatcttcattctcgtctccgcctcccacgagatggatgtcgtacgctcgacggcatctcagcctgggctgaatctcgccaatgacctgtccttttcactcgttccgtcgtatgggatgtatgcgatcatcgcgggaacgttgttcatgttcgtgggagccatcgtttccgtggtgaatcgcagccatgcgcgcagggcggcattcgccagtccggctccggcgaatccgcccgcagtcgcgtacggtggcatgccggcgcaaaactacggagccgcgccgggcgccggagcggcgtatcagcagcctgccgtgccatatagcgcgcaaccacagaatccggccggaggaacgccgaacacaatgcgtcccatgccactgccgccgcaacactaatccgcacagcccgcagactccgctgacatccacaccgaatcagcggagttcttttatgccgccagacgccgactggcgcaacggcgcgactcgccgaactatggttccgatacgggccgcactggaatatcatggtgtatatagcaacgctgcgagagaggtgggagatcatggaatattgtccgcattgcggtgccccatatgacgagggcagtcggttctgcttccagtgcggcgctccgcggcaatccgccgctggagcgccgggtgctcctgcgataccgaccgctccgatacccgtgtcgggctatggcaacatggcggcgcagccaccggttccatcgcctccgagagcatccgagacggcatccgacgatggttttgccgcattcgcagcgaatgcgggcgatgccggcacacctccgaccgtccccgccggaaactccgccacgccaccggtcaatcccaccggatccgccaccgcgcagccgtccgccaagcgcccacgcatgaaactcatcgcggcgatcatcgccgtactggtggttctcgctggaaccgggttcggtctcgccgcgaggaaactggaatggatcggcccgcgcaccgtgccgacggtccgataccgcacggcagccggagtgtcacgtgagctggagaccaaaggctttctcgtcaagaagaagcagatgttcaacgccctgggcaagggcaagtgcctcggtctggtaggagtcaaggcgggcgaccgtctgcccaagggcacgacggtgacggtcatcgaatcgatgggacccggtgtacccgaaggcacagtcggctctgaaccgagcaaggccgaaaccgcgctactgaaaatgggcgtcagagtcgtcgagcacgaagtcgtctcggagcatcccggcaaagtcgccgtcaccatgcccgcggacggtgagccggtgcgcgacaccgacgacggcatccatatcggagtcgggatcacaggtgacggcatacccgtcgaaatcgccggaatggacaaggacgaggcgaaaacaaagctccagcaacagggcttcgacgtcacgctcaagccgcgtttctccagccgaaagaatctcggcaaaatcgtccgagccgatcccggcatcggcgtgcggaccagcgagaccaacgtgcccctgtattacggcgtggatgccagcaaacgctacgacgtggtcggcacgtccattcccgacaggggatcggacaagatcatgacgaacaccgtggctctggcagggaagtattgcaccgatggcggcaactgcctgacattggaacccggtcagaccgatccaaacccgagtggtctggtgctcgacggcaaaggttcctcggatttcttcgaccagctgaccctctgcacgtattcgcaggacatcagcggctgcaacccgtcctccggcggctactacaacgcaatgaaggacttcctgatccagggcgataccggcgccatggagctgtatgcaggcttcggactacccgtatgcggcaccacatcttacgtgggcgacgggccgacatactgtgacggcacatcggagaaacaagtcgaggatggctcggatggaaccgccgaacaggccatgagcgaaaaatatctcaaatacgtggctcgtgatttcttcgtggtgatgccggtcggagccaacctcgaccagctggaatccaacggatatttcgacggctcgactacgtacaagccctatgcggaccgcccgtatctcatccgccgcgacaactccgcatacccggaaatcaaggcgacgaatgacaccttccaccggaagcccaacccgtacgcgcccggcaccaacatgcagccgttcaagaaggcgcccaacgcccacaacgtgtactatctggtcgagcagccggtcgatttcagccagttcgaggaggccactgtatccggcgggcggcagggagacggctccgactcgtcgcctgacgacggcacctcttccgacggcaacggcgatgataccactgaatccgatgactcatcgcaatcccagtcatcgcaatccggtgcgagaacctacacgaacgcgcggttctcgtaccgtgtcgacgtgcctgccggttacaagtggcagcaggagtccgacaacggcgacggtcgcaagttcgacgcgacgtccggctccacgcagatcagcgtgtggggcagcaacaacgcgctgtctcgctccccgcaggaggagctcgactggctcaaggagaatctcggcggcaacgcgaacatatcgctcgcgcaggtggccggccaatcggtgtacctcagctatgagcagaacggaaccatcacgtatatccgcgaagtcgtcaccggagggaagatcgcggccatcgaaatcacgtatccgaccagcgaacgctcgagcggagacaaactcgcggagacggttccgctgaccttgaagttcgtggggtgatggggctatcgtcaccaaatgcgaggccgtacgaaaccgttgtgttccaagaacgcggcgacgtcacgcagctccggcatgttgatgctgtgcgtcatgccggggtagattttctcggtgagcgtggtgtgcgaggcatagaacgcgctcatcgcgtcgagttcggacttggggaagatgtcgtccgcagagccgtggccgtagaacattggcggcttcagtcgcgcaagctcgtcgtcgccaggcaactcgccatgtgcgaggaacccggagaaactgactgcggcggcgtaccgtttcgggttgacgcgcagcatctcgccggcgagtagaccgccttgggagaagcccatgaccacgatggggcgctccggggcgatgctgtcggccacccatgcgtcgatggcctcgccggcttggcgtgattgccgatcgagcgattcgccggtcgggacgccttcgtaatcccatgagccgaaccacgtgtagcccgggccgtacgaaatcggcgcacgcaacgacgtgtaatcggcgccgggcgcacaataatccagcaatcccggcaggtcatgctcgttcgacccccagccgtgcaacagcaagaacaccgggccgcttccattggccggcagattggccaccgcatgttcgatcctcatcgcgctcactcccctcttgtgtgttcgtgttttgcgttcgccaccggcttcagagcggccggcgaatcacgtttcaatgtcatgttccgtcacccatggtagtcgcacgggcgccggcagtcacaccatcgcgcatccgcccccctccatttcatcatctcatctcgccaaagtcccatctcaaggtcgtcacatgggactttcgccggatgaggggtcacgccgcggcacggacatccgctcatagtcccgcgggaaagtcagccaatgggactacgcgcggaatggaggctgcgggattgcatggcgtaccatataactcgacatcgaatccggcgccgcaacaccggcatccaccgacgacacgggagtatcaatgcaacaaccgatcatgacctccgtcgcttttctgtcgcaggcatcggctcctgccgacccgtcgaacgacgaggaccgcgccaccgcgaccgacctgcgtgacacgctggcggcgcatcgcggcgaatgtgtgggcatggccgcgaacatgataggcgtggcaaagcggatcatcgtgttccaagacaaggaaaacaaccgcaacgcaatcatgttcaacccgcgcatcattgctgggagcgacccattcgataccgccgaaggatgtctgtcactggatggcgaacgtccgacaacacgctaccagagcatcaccgtcacctatcaggctcgcagcgggcgcgaatacacgactgccttcgacggattcaccgcgcaaatcatccaacacgaaatcgatcacgtcaacggcatcatcatctgacgaataatgacggtcatcgcgtcatatcgccgaaatcgacaatgtgacgcgtcacaaagcacaccacacactcagcccaactggtccttgatgccggacggcagatgcgtggtgacttcctgctgaatgcggtcaaacgcgctggacagcagcagattacccggaaccgtactgatcaggaatgccagaatcgcggcgatgaccgccgtcaccagacctttgacaagacgggcgacgatcttgaacaccagataggagacaatcgcgccgacgacgacggtgatcgcggtttgagccagctgcggcagattgccataccacaggacgaactggtcgaatccggaccgcacggtctgtgatgtttgagagatctgcgagttttgagcaatatgcaaggacaacacggcgtgcacgaactgcatgtgcgaggtcagtctcctttgccggtgagtatggtggttgtttgatgatatcagcctgatcaggcctcccgtcatgtgccggcccccgatcgggccgggatgcgggaggtcccctatgccgtcatgacgtcagccgacgaggaagtcgaggacgttcatgccggtgccggtctgcgcgcgatacaactcggtgtatccgcactggcggcaggagatggtgacgaacttcttgttctgcacgttgaacagtttggcgaaatcgccgccggtcgcctggaactggtcgctgtcgtatgaccggcatccgcatttaacgcaaacgtactgaatctgctgcataatgaattcctttcatcggaacctaacatcccccgatagtggttcaccctatcagacaggattcgcccgattgccggttatcccatatccgcacgtaacgcgcatacaatcaacaaaaacgtccgcgctccttcgcgatgcgggcgccccatatcggcatcagtgcgcatcggagaagaaatcacgctgaaaaacgccaacagccgacaaatccagaggctatcttcgtttcgaggggttgattcggatgcgtcaaaacatctatctgcgtttcgagggggtggtgctcaagtataaacgctcccaaaaccgcatgattccagcaacatacagcttcgaataccctgcatatcgtgttttggcaaccccttgaaacgcagatagatgttcggagagccccgaatcaaccccccaaagttcatataccgtacaaatcggcgggtcggatgtcctcagtagccgtgcgcgtgcagataatcgtcgtcaaaaccgaaataatggccgagctcatgcagcactgtcttgcgaatctgccggcgcaggtcgtcgcgcgtggcgcagacgcgctcgtgcgggcccttgtatatggtgatgatatcgggcatgacgccactgtatccggtgaagcgccgcgtgattggcacaccttcgtacaggccgagcagctcatcgcactggcgctgcatcgtcgcccgctcacgctcgttcggctcgtcggcgaccgcgataccgacattgtccagcgcgcgtttgaaccggtccggaagactgtcgatggccgtttcgacctcgtgctcgaactcctcgtcgctgatgcgcattccacagccttccttgtcattgaacagtcgccttgcccgccacgatcaggcggatgccccggcacaatcgggagcaggctgactccatgttccaagcataggacggcgtggaccgatgagccacatagaccgtacgccacacgaccggtatacgcttcagccattcgtaacgtacactagtgactgtgcgaaaggaggtgcgcattggcgacgtcggaaatcgaacagttgtggatcagccagtttcaggagaatctgggggcgcttcgcaaagtggcgggatggaccacccagcagttggccaacgagctaggagtcgcacggcagaccatctccaatctggagaccggccgaagtcccatgaccaaattgcagtacctcgccctgcgcaccgtgttcagcgccgaaatcgccgaatgcggcaaccgcgaactggcgaagatcatcaagacccttgttgacgatccgattgaactgcgcatcaaggagcttgggacggccggttcgtccgacgatgccaaagagccgaccgatgagacggccaacaataccaaagcaaacagcgctaccgagcctgacgctcccagcgaagcagacgatgcacgaccggtcgcaccggcatccaagccggctgccggcagacgggcacgcaaaaacaaggaacgaccgctgagcacggccatgcaggcacttgccgtcatcaccgcggctctggccagcggcaccgccgccggcgttctcacctatctgctgtttcccaacggcaagcccggcaaaaacggcagacgttgacagagcggaccgcgctgcagaccgcaacaaggccgatcatcgacagtcgtactgattcggcatgacgattcgtgtctatttccgctgccacgaacaatgcctcatctcgatcaacttccggaaaagtccgggattctcttcgcgcatcagcgcggctgcgactgcatcatgtggcggcgcgtttgaacagaaaaatataaatctcccggcatatgaaggcaaggctcttcatgcaccgggagatttgacgattcgttacggcagaaaaaacgttacaggcctaggacttcatgcttcttcatgtcgaactcctcttgggagaggatgccgatgtcgacgagttccttgagcttcttcaacgtttccacctgttctgcgacgctcatggaggcggcgtgcgagggcgctgccgcgccggctccggaggttgccgtatcggcaccgcccgtgctttcggctgcaagtgcggtttgaggctgcggctgttgcggttgcggttgcgcggccatcggcatcggcgctgccggcgccgcggtcatcggattgatggcctgagccatgttcatgccgaggagcatgccgccgccatcaccgaaaccgttgttctggatgccttgggcgatctgctgctgcgcggccatgttgccggccgtctgcgagacgccctcgtacgcagagacattcatcttgttcgaagcgaattggcgcacgagctggcgagactcctcatcgaactcgatgctctcgatgccgacgccggacacctcgaatccgaagcgattcctccacgtccccgcattcgtctcatcgttgcgcacgcgtgtggcgatatcgttcgcatgggcaggcagctgcgaaattcgatactgatcggacaacgagttgatggcgacgatgaacgactggacgaattcggaaagaatctgttccctagccttgggattgtcgaacgcgtacgacgttacgttggcgggaacgtaattgcgcacgaagcgaaccgggtcggtgactttcagtgacatcgtgccccgcgcccgtatctccaaatccacgccatagaatttgtcattgtagaccagcggcgctggagtgccgaacttaatgctgcggatctcacgcaggttgacgaacgccacatacttcgtctccaccggctgcccgccgaatgtgaatcgactggcgaccgaactgaacagcgatccgatgccgtcaccggcgagcacgcttttctcgccgtcgcggtactcgtaaccgcccggctcggtaatcacgttctcgatgccggattcagagaagatgaaggccgccgtgttttcgggcacataaatgtgggaaccgttgctgatgacgccttcagaaccgtactcgttcgacccgcgtccgttgttcgtgcctcttgggactcccggcgcgaccactacatactcgtcgaaccgaccggcagtgatgatgtctttccatagatccgcgaacgttccgccgagcgcgcccgcgaacgccttgatgattgccatgtgctttctcctcgtcttctcgcgcaagcgcggatgcgccgccatgcgtgttgcctgcatgacggcgcatccgcccagcgcacaggttcggtcggttagttcagctgcgtctcgcgattgcagtattcgcagcgaaccgcctcgcgcttatggccggacagcggcgcgccgcatccctcacaggttcccgacgaccgcgtctcggcgatgccaagcccgttgcgaaacgcgccgaacgtgtccttcaacgtaccggccagcgcctccgtgccgggtatggccttgctgaacgcctgttgcttgttttggatctgatcgagaaaacccattgctgtccttcttccttatgtggattggcggagtgccgaataccgcgtcactggctgacggacgcaagtttctgcgtgcatcgagccatgacctcgttgtagtacgcgagatcgctggcgctgagcgagccggaatcgatggaaaattacttgaattactcgcagatgtatcagagcttgtgctggtatctgatgtagatgaatcatcaggaccgcgcaggcttatcgacatgatgtccttattcgactcatcatgtgaaatccttacggaatagccatccttggtctcacctctaaaccatccgcccctgcgtctgtaatctacagtgaagcccttctcaagaacagcatcattatacgcggcatactgttcatcattggtatcacacacatcaatagagagcatgtcatcatgttcaatgagattgccaccagtcgtagatttcggggttggaagtttggtgccaatattggtttttggccaagagaaagcttcgcgctcaatttccggtgcggcggccggagcggccttttcgagagctccggagacaacaatgcctacactgccaatgacaaaacccaacactgtaagtactgcggcaatccaagcaaacagctgaccagtcaccttgccgccgggacgtgttacatacaacgcagcaaatgtcagcaacaaggatatgaacgccatggagaacaacattccccattccaatgccgccggcgcgaacgtgctcagcaccatcaggatgctgtatgcaagtgccgcaatggcgagtttagagcggttaccggaagcgccggtgaactgaggattattcaaaatcttccaaatcttctgggcctttgttctccttcttcggggcttcgccgcatcggtgggtgccgctgtgggcagaagtgccggatcaagaacagacaggaattcagcggtccgagtgccaccatcatcaccggtcacgtccagtttgatggccgtcccgtcagcaccctgagcgctggccttcagcgtgaattgtgctccgtcatatgcgtggaatgtcaccgttccctcagcgacgttctcttcatccgcggtgaacgtggcgctggtggacagctggtcgtggacggcctgcattacctgctgcagactggtcgcatacacacgatcgttgtacgacggagtctgggcgggaacatcttgaactggcggcattgtctgcgtcggcggcacagactgttcggtcggaggaatgaattgggtgggcgcatcattactgcccgaagtcgttggctgattgccgccggcggggaagggtgccggctgttgactatcgtttgtcatgattttcttcttcctctttctttgccagcgatatcgccagcgcgcaaacggcgagacatgtgagcatgaccgccagtccgacctcgatggcaaaccggctgcgttcgttcattgtcacatccttctctcgtcaaccacttgatgtcgctgtactcatcacttagtgtatgtcgctgtgaatatgtacgcaaattagcattatgtaattagtttagctagtcaaactgagttgaatccaccctttccgccacgtgcccttacggcagtggcaacgtcaattttcaggatggcgacatggccccgcatcagttgccaactgattttttctccggcgtttcgccgggcgagtctcgctacgctgaatcatcagaatcacacgacatagcaagaggagcgcaacatggcagacacccccgaagagcatctgaccgaagagctgcttgaccggctgcttcacagtgccaagatcgaaacgtatctcgacgaggagcacatcacagatcgtgcgttgcccgattatctgaacgaactgctcgacagaagcggaatcaagcgcaaccctctcgcagaaaaaacaggcatgaatcagacgttcatctacgatattttcgccggcaaatcccggccgggaaggaacaacgccatcagactcgcgttcgggctcgggtgcgacctgcgcgagacccagcggctgctgcggcttgccggcgtgagcgagctctactgcaagcagcggcgcgacgcaatcatcatctggtgcattcagaacggccgggaccttcccgctaccgacgatgaactgtatcggatgggcgaggataccttggtgccgaaggactagtgcggggaggtagctggcgacgcccccacccgcttcgcgggagcccccgccagcgggggcgagattcttagcacatcactcgtgcgcttgtctccgccagcgggggcggaatcttaggccatagagcatgtcgatcgggaacgggttagggtagcgggtaacgaccaggactggggagcaagatggacgataagcagaccgcgcacgcgatggggatcgacgacacctaccgcgtcgagcgcacgctcgctcgcggtcagggcggcgtcaccgaactggtcagcatcgacggcatcggtccgttcgtgcgcaagaagatcccatcccagctggcccaacgcaacgtatgggcggctctcagcgcctgcacgaacccacgcctgccacacgtcgaggcaacatacgagttgcccgatcatttcgtggtggtgtatgactacgtatcggggcggcctctggagcacgtcgttcagcaacaggaaaaacttcctgagcgcacggcgacacaactgatctgccaactgtgcgatgccgtgaccgagctgcaccggcatggcatcatccatcgggacatcaccccatccaacgtgattgtcgccgacgacggagcgcatctggtcgacttcggcatcgccaggaccgtcgcagcgaatgcgacgcacgacaccaaggcattgggcacctacggcttcgcttccccagagcagttcgggttcacacagaccgacgcccgatcggacgtgtactcgctgggacggctgcttggatacatgctgaccggcgtctaccctgacgacaagcgatacggccagctgctcgccgacccccatgtggtgccatcccagctgaagtcggtcatcgaccgggcatgctcattcgaaccgagcgcccgtattcaaagcgccgacgaactgcgccgcgcgatactgggacagcctgcacagcaaaatgagaacatcgccaggcccgccatcgtgaacgtcgcgccgcaatcggcccggaagcgctccaagcgcaaggcgattatcatcggtgccatctctgcgattctgatcgccacgctcatagccggcatgctggttctcggtaatgtgttcaaaaccggcaaacagtccacgccgaacagcagcactacgtcatcatctcacagcaatacgtcagacgcacaacagccgggcaaggatggcacgaacgacagcaatcagttcaacggctccgcgaacgggcagacaacggatggaaacagcactgacaatacgcagagcgatacaacggagaacccgctgaaaatcacggaatcagggtggtcggcggacagtgccggctatatccattatgccgtcgcggtaaagaacaccagtagcaccttgcaggtcgagtttcctgcgattagcatcaccgggcgcgcgaaagacggctcgatactgttcgctgaggataacctcagggcagtatcgttcccgaagcagaccatatatcttgtcggacaagctggcaatggccccggaagcgaaactccggaaagtgtggaattctccataaaccaacgtggcggcaccgatatccggcaatcgcatggtgtcgtcaccttcacaacgtcaaatctctcggtgtcgcatgatagttttagcaataccttattcaatggagagatcaaagccaaaaacaccggctacgattccattctaaatggggcgtatgtgacagtcgtgctacgcaacaagaaaggcgacatcatctacggggatggccagcctatcgattcgatttttgacggaaaaacgcattccttctcaatccctatagacgattgtcccgattatgcctcgtatgagattcatgcgtcaatttgatttttgatttgccggaaattcgacgccgcccattgcgtatcacggtcatctcaccactatgccgcttgccgctccggcgatgtaatcggagcggcaagcggctacgcaacaatacaggtggcccgaattatcctcagccgcggttgtcgaacatcgacaggagcatcttgctgggttcgacggcgtagacggtgtgcggcaggcgggcgctcaggtagacgacgccgccgggtacgagttcgacctcgcggccttcgccgccgacgcgcagtttgccctcaagcacctgaatggtcaccggcatggcggccgtatgctcgctcagcgcctgatccttgtcgaaaccgaacagcacgacacgcaggccgtcctcacgcatcaccacacgcgagacggtggattccggctggatctcgatcagcgatgcaagatcggccacatagcccaggtgtggttccgtggaaatggcgtggccttcggcatcgtgcttgcacgcgcagtgcttgggctgctcatcaccggcttccgcggcgccgtcgtgcttgcacgtgcaatggtgggcggctggctgctgagcggccgaagcgttcgctgcggctgcctcggccgcggccctgcgctgacggcacttgcagtgctgctcgtcacgtcccgcctcacatgcggactgctgttcgttctcatctgccatgatgttctccttcgttacgttgccgtatctttttgttgcgcgttcgcgccgtatattgctgcgcggacgcgcatccacgtatatcagtgcatatcaatgtcggacgccgtaccgggcatcgaaccgcggctgatcttccgacaccatccaccatcattatctgtcagcacggccgccggcggaatcatccgcccggctgtcggccggcgcatcgtcacttcgcaggcttgcgcaccatgaacgcaatgccgttgagctccttgctgtacttgtggaacgtggatttcatgttcatcacgcgggcgcggatgtccttgttccccaacatattacgcaggatgcgcaacacgccgccaagcccctcatcggcgagattgcggcgcatatccagcagcgccatcggctccttgccgctccacagcacttcaaagccctcggattccagcagctcgcgccactctttctcggtgagaggacgggcgttgaccttgatgctgcgggcgagtgccttgcgcacctcgtccttgaccggctcaggcagatcgtccggctgcagcccaagctcgtgaatcgaataggtgccgccagcgcgcagcagacggtaggcttctgcgatgatggcccgcttgccacgctcagtctgcatggtgagcatcgcctcaccgatcacggcgtcggcgctttcggattccaaccccgtgtccgctgcgtcgtgcagagcgcagctcgtcggaatggacggtgcattctcggccgtcagcttggtgatgatgtccaccacctgcgggtcgcggtcgacgccgcgatagcttttcggcttgtgctcaagaatgagctgcgtggtacggccaaggccgggcgcgaattcgacgacgtccttgccttccaactcggttttcgccagcatgcgcccggtcagcttcttgccgccagggcgcagaacgcgcttaccgatgcgggcgagcagccagtgtccctgcagatgctccacatcacgatctgactgaggcagcggaaggccgccgttcccctgcgcattggtcgtggattgtggcgctgtattcgtagtctgagttcccatatcacgcgacactatcggcgatgcgccccatgcacaagggttttcggtcttttatcagcgtaatgtgattgaactcactccgaccggcggaatcggccgagcagtatttccgacatgccgacggctacgtcttgtgtgaagaaccggtcatacaggcactcgtcagtgagccatcctgttgacaatatgccacaatgaaaccagtgcgacgatgcgcggcagatcattcaccagtcacgtcatccgcgcaccgcacgacaacaatcggagacaatcgaggacaggaagaatgagagttatcagcaatattctgtggattatcctaggcggtctgatcatcgccatcggctgggcgctgatcgggctcgtgctgtgcgtgacgatcatcggcattccgctgggcctccaggcattcaagatggcggggctcactctgacgccgttcggcaaaaccgtccgctatggcggcggtgtcggctcgacgctggccaacatcatttgggtcgtgctcgtcggcttttggatggcgctcagttacgtgggcgccggcctgctgaactgcatcacgattatcggcatcccgttcggcatccagtcgttcaagatggcgaaactggcgctctggccgttcggcgcggacatcgtcagcctgtgagcgtccggctcgcaggcctcatacggcggtctgcctataccattccttcctcaagataaaaaacggtcgagccgccgtcatcccattcgaccttctcctcgcgcctgtgcgtcaggccgcgacgcgtataaaaactgacattgcagccggtgtcggtaaacagatagtaccgccggacgccaacgcggcggaaccgttccagcagatcatcgaacaggaagccgcccactcccccgccacggattcgctcgtcgaccaggaagagcgtcacctcggcgtcgtatcggttctttgcccctcgtatcagccgtctgtcgacacggttgatacgcagcatttcagcaatgccggagcggcctgcggtcgaaaacagcaacgggaacaatgccctgatgatatgacgatggtgccggttcggcaggaggcacaatcgtttcggaacattgatgtcgacccgcgccaatatcacgcccaccggccggccgtgcagcaccgcgacggtcgcctcggaagagcgcgccagacatgaatggaagtccgcctccgccagccgacgggaacaatcgctgtccgctttttggccgcctgaccattcgctgtaccatgtacgccgcaggatctcgatcagcgcaggataatcgtcgcgccgcagggtgcgcagacgcactgcggggcgacgcggggtcgctgctgtcgatgacgatgctgtcgaaaccgcggcgaccgaggtcacatccgcaatcgtgctcgaggaatcgttcataccgcaatggtgacgtggcaccgagacgttgacggagcaaagtgagacacggcgaggcgggacggacggaaacgcagcacaacgactctcctgccgagacacgcctggatgtgtcacaaagccgtcagagccaatcgccaagaatgacggaacagagccccgttctttcaaaagtcacacgacaagcttgcgactacgcctccgtaaaggtcatcgatgccctaatccgaagcagcggatacggaaacagagaaatcgaccgtctctgcgatggaacgatcacatacggacgcatccgagacattcgcaatggccttaaggctccggtgcgtttgtctgagtttctgcaggcgcggtgatctcgacttcgcggcgcatgaggatgagcataagtacgatggcgatgaagacgatccggcgtaaagccggatgtggtgccgtgcggggcttcgtccttcgtgtctaatcgcgattaaattgatattaattatgcaatcggctacttttatttgacttatttctcgtcttatcttatagtttctacaattaagagcctaacccggaaagagaggcggaacaatgggtatgaaatataggagtttggcgcggtcgttccataccgacagatccaatgacgccttcaacaaccatgcgaagcttgcccggcaacggctcgaggcggactccacattcaggaccggggtcgtcacccctctgggcgaactgttcgccgccacaccacgcgagacatccatgctcacggaaaagatacttctcgcggaacggcgggtatcccggctctggaaccaaatccctggcgtcatgcgctgggactacatacggcactccatcagcgaggaattgttcgccaccaacgagatggaaggcgtacgcagcacccgcaaggaaacccaggaagccgtggaagcggccgacaaggcgaggaaggacggcgacgaccccaaggctcggttcagcgaattcgccaagctgtacctgaacctcaccgacaaggactccgcactgccggcgggaatcgccgacatccgcgacatctacgacaaggtcgtgctcgacgaaatcaacgagagcgacaagccggacggcgaactgttccggaaaggcgacgtggaaatacaaggcccgcacggcctcgcgatccacaacggagtcaaaggcgaaggcaacatcggcgcactcctcaccgacatgatccatctcgcgacctccgacgagattccccggctgcagtcggccatcatgtcgcacttcctgttcgaatacgtccacccgttctacgacggcaacggcagaaccggtcggtatctcctggccctgtacctgaaccacgacctaaccatgcccaccgtgctgtcgttgtcccgcaccatcgcggagaacaagaacgcctactacaaggcattcatggaggcggaggacaagctgaactgtggcgaactcacgctcttcgtgaacaccatcctcggattcatccggaaggcccaggacgagctgatcgacgaactcgaagttagagtcgaccagctcgacaagggccgggcggtctgcgaccagctcgaacggaagcacggtctgtccgcgaaggcggtctcgatactatatggcgtgatccaggaggagatgttcgactcgaccaagtccatgacgctgaacgatgccgcataccatatcagactatccaagcaaagcgcgagaaagtacgtgggagagctcatggacgcgggcctcgccatccagtccgggaagcgcccactgaaaatacgggcatcggaatcgttgaagggcatccttgaggccggaatgggcgaggacgccggagagcatggcggcaaaacccaacaagaagaaacagaaaccgcccacgagggcgatcccgcataactcaactatccggaaattccggatagttgagttttcattaaccatcgcggccggatggatggtcaaggtttatccgctgcgtgaaacgtcgagtgagacgtgtttcacgcggcggaactcccacgtcccgtccgcgcgatggacgatgctgccagatcccttcgtacgtcgtctgccattggccgccatgatgttcctccctgtcgggagcgccttcgggcatctgccgcaagcgccctcccaagggcactctattggcactctatccgggccacaaacggccagatacgtggcaaaaacggccatttcccagtaatcgaaaaacggcggaatccgcacgtgtccggagaccggaaacgttgggattccgccgtttctcagggctgcaaccccctacttgctcacattgaacttgaactcgacgatgtcgccgtcctgcatgacgtagtcgcgtccctcctgacggagcttgccttcctccttgatcttgaccatggagccttcggcggccacgaagtcgtcgtaggagacgatgtcggccttgatgaagcccctttcaaaatcggtgtggatgacgccggccgcctgcggggcagtccagcccttgtggatttgccaggcgcgcacctccttgactccagcggtcaggaaggtctgcaagccgaggatgtcgaagccgacgcgggcgagctggtcgagaccggattcggacaacccggcgtcctccagcatctcgcgggcgtccgcctcgtcgaggtcggtcaggtcggattcgaactgggcgttgaggaacacggccggcgccggcgccacggatgcggcgagcttggcctgcaactccttgttggcgagctcgttatcgtccacgttgaacacgtagatgaacggcttggcggtcatcaggtgcaggtcgtagatgtcgcccttgttgatcttgcctgcggcggcggcatggtcgatggtctcgccggcttcaaggatctccttggccttcttgaccgcgtccatgtacgcctgctcgatcttcttgccgcgcaggtccttttcgagcttcggcagcgcgttctcgatggtctgcatgtcggcgaggatcagctcggtgttgatcgtgtcgatgtcgtcggccggatccaccttgccgttgacatgcacgatgtcgtcgtcctcgaacgcgcgcacgacctcgcagatcgcgtcggcctcgcggatgttggccaggaacttgttgcccaggccttcgccttcggaggcgcccttgacgatgccggcgatgtcgacgaaggtgacggtcgcgggcacgatcttctcggtgtgcaccagctcggcgagcacgggaaggcgcttgtccggcagcggaacgatgccggtgttcggctcgatggtggcgaacgggtagttttcggcgaggacattattgcgcgtcagcgcgttgaacatggtggacttgccgacattcggcaggccaacgattccgatagttagagacatagtatccagtattggtgtcaaggtggacgttggccgcgccgatgacgcaattcgttgcagcgaatcgttctcaataacaaaagtgcgagtctcacgctcggcaaaacgaacatgaacaccgtatattgcccggaatataaggattccggacaatgtgcggttgagtggttttgttcgttttcctcacacgtttcttattgagaacgattcgctgcgattggcagacagcaaaaacgtcacagctcagccgcgccgatgcgccgcactgcctcgcgcagcagcgattcgtccttcagcaggctgagccgcacccaatccttgccgacgcggccgaagcacgtgcccggcagcccggccacctgcgccacgtcaagcaacgcgtcggcgaaacgttgcccgctccacccctcaggcgccttgaaccacacgtagataccgccgacggagtcgaacacgtcgaatccgagcgagcgcagtcccccggtgacgatctcgcgccgcccggcataccgccgggccagttcgtcgacgcacgactggtcgctgttcagtgccacggcgccggcatcctggatcatgccggcgaccatcgaacccatctgataatggtattgcttgagccgtgcgaccacgtcccggtttccggcgacgaacccggccctccacccggccatcgcgtacatcttcgacagtgaatccacttcaacggacacgtcggacgcgcccggcaccgtcagcaggctgacctgctggtcgctcacgccgagtcccgtgtatgcgaagtcatgcacgatgaggaagccgtaccgcttggcgagctccaccgcgtgctcgaagaatgacgccggcgcctgcgcgcccgtggggttgttcggatagttgagtatcagcatgcgcagccggcgccacaccgattcgtccaccgcgtccaggtcgggcagccagccgagttcggcgcgggcgggcagcagtatctcctccgccccgtgcatgacggacatgcaatggtacgacggatagtaggggtcggcgaacgcgacggcgtcaccgcggtcgatcaggatcgcgaacagtccggcgagcccgtcgaccgcgccttccacggcgaacagctgggaacgccagtccagttcgacaccatgcacgttgcggtaccagttcgcggcggcctgcaggaacgccggcttaccatcgaacggcgtgtatcgcgcgttgagcgggtcgtcgaccgacgatttggcgacgtcgcggatgaattcggccgggtatgcgtcggggttgcccttcgccaggtcgatcacgtcggcgccggacgccacggctgcggcgaccttcacgtccatgtcggcgaacacgttcggcgggatgatctgggcgaccggcgcgaaccggggcgcccatacgccatcgcgggtgtcgtcgtcttgtgcggcgctcattgcggtattgctcctttgggatggggttatataggaacggaaaaagaggggacatgtggcaaggaccgccctccggcgttacgcgccatctcccgccagcgggaggtggcatgccgtcgccccgctggcgaaggactgtcggcgtagccgacttcgggcggtccgaggaggaagcgaatctcagtgctgcagccgcttggcgagcaggttgcagatcagctggctgacgaacacgatgacgagaatgatcagtgtagccaccagcgtcacgtcgctctggaaccggttgtaaccgcggatgatcgcgaggttacccaaaccacctccaccgaccacgccagccatggcggagaaggcgaccacgttgatgaacgacagcgccgacactcggatgatcggcacgcgcccttcgcgcaggtacacgcgccatatgatgtcgagcgtgcccaggccggatgccttggccgcttcgaccaggccggggtctatctccagcagcgcgttctcgacctgccgggcgtagaacggcacggtcgcgcccacgatcggcacgatcatcgcctcggtgccgatggaggtgccgacgatcactcgcgtcacgccgaccagcagggccatgagaatgatgaacgggatggatcgcacgatgttgacgatcttgtcgaggatgttgtagacgatcacgttctgcgtgagcccgccgcgtctggtaagcaacagcagcagaccgagcacaaggccgatcgcgtatccgatcaccgcgccgacgatcaccatgtacagggtctcgtaggtcgcgtcccagacctccggccagatcatcgacacattcggcagccatgtctccagcagatcattcattgtcgttctcctccacctcgttcacatgcaggtcggcgagcggcgtcgcgctcaccccgaccgtcgggaaatacgcgagcgccttgctgaccgcctcggccggaccatccagactgaccaggatcatgccgaccggcgtgccgtgaatcacgtccacgttgccgaacatgatgttgcctctcacgccgaaccgttcgcgtatgtcggccatcagcgtctcctccgcaccggagccgaccgagaacagcaggtacacgctgccgctctcccgctccttgctgaacagcgggtgctcctggacgagcgtgatgcccttgttcatgttgccggacgtgtagatgaactcgcgggtcagttcgttggacgggtggtcgaacacgtcgaggatggacccgtcgtcgacgaccttgccgtggctcatgaccgccaggtcggtgcagatgtccttgacgacctgcatctggtgagtgatgagcacgatggtcaggccgagccgtgcattgaggtccttgagcagggcgaggatcgaccgggtggtgcgcgggtcgagcgcgctggtcgcctcgtcgcacagcagcacctccgggtcgccgatcagcgcacgcgcgatggcgacgcgctgctgctggccaccggagagctgccgcggatacgccttggccttgtcggcgataccgacgagttccagcagatgcatggccttcgcgcgggcgtccttgcgggataccttctcgtggatgagcggcagggtgacattgtcaagcacggttctggatggcatcaggttgaagtgctggaagatcatcgcaatcttgcggcgcagcggtagcagccggccctcgccgagcgtgctgatggtggttccgttgaaggtcacggtgccgctggtcggacgctgcaggacgttcatcgtgcgcaccagcgtcgattttccggcgccggagaaaccgatgatgccgtatatggagcccttgttgatggtcagggacacgtcgtcgacggcgcggaagcggtttttgccgcggccgaattcgacggtgacgtggtcaagcgagatcagaggggcgccggcggcgacggaatccgaagcctccgccgctgcggctgcggttgcgttgacggttgcatcgctcacgcggcctcacccgcccgacccgcagcaccatccgccccatcgacggcggacttgccggccgccgcgagcacggcgtcgaggatctccttctcgccggacagcacgaagtcctccatcaccgggctgaacggcagcggcgtgaaccgcgcgccgacgcgcagcaccggcccgcgcagataatcgaaatggttctcggccacgcgcgccgcgatctcgccgcccacgccgccgatcttgatggcctcgtgcgcgacgaccagatgaccggtcttcttcaccgacgcgtagatggtcggcatgtcgagcggcgtgatggaccgcaggtcgatgacctccacgctcacgccgtattcgcgccgtgcaacatccgcggcagcgagcgccttggtgagcatcagaccgtaggagaccagcgtcacgtcggcgccttcgcgcacgacctgcgcacggctcaggtcgatgggcggcaggccctcgggcacgtcgcccttgaccgggaacagtcccttgttctcgaagtagatgaccgggttaggatccttgatggccgccttgagcagctgcttgccgttggccggcgtcgagggcacgaccacgcggatgccggggatgttggtgaaccacgtctccagcgactgggaatgctgggcggcgccgtgcttcatcaggccgtcgggcgcgcgcagcaccagcgacatggtggcctgtccgccgaacatgtagtgcgccttggccatctggttgagcacctcgtccatggcgatgccgatgaaatccgcgaaatgcaggtcgatgaccggcttggcgccggcgatggccgcgccgacgcccgcgccgacgagcgccgtctcggagatcggcgtgtcaagcacgcgctcggggaattcgtccttcatgccggcgaactggccgaagatgccgccctgcttggcgatgtcctcgccgtagacgaacacacgttcgtcggctcgcatctcttcgagcatggcctcgcgagtcgcctcgccgaatgtgatgattcgctcactcatacaggttcacctcatcgctgaatacgtcgtccaaggcgtcctcggccttggggaatggactgtttaccgcaaattccagagcctgtgcgaactcctggtcgagccgctcctccgcggcgtcgaggtcgtcctgcgcgacgacgccttcgagcaggatcttgcgccggaaccggtcaatcgggtcgttgtagagtttccattcctcgacctcctcctgggaacggtacttctgcgggtcggtgatgaagtggccgtcgcgccggtaggtcttgcattccaggatggaggggccgtcgccgcggcgggcgcggtcgatgagcttggcggaggcgtctcgcacggattcgacgtcgttgccgtcgacggtgacaccggggatgccgtatccctgagcgcgttccgacaggtagtccacgttcttgatgtcgtcgaagcgggtggtggatgcccacgcgttgttctcgcacacgtagatgaccggcagtttccagctggcggcgaggttcacggcctcgtggaaggtgcctcggctagatgcgccgtcgccgaagaagcacacggccacgtcgctgccgtgccgctgcttgatggcgagcgccgcgccggtggcgatgttgaagccgccgccgaccacgccgttcgcgcccagcatgccgacgctgaagtctgcgagatgcatggagccgcctttgcccttgcagtatccggtggtgcggccgtagagctcggcgagcgaacggtcgacgcgggcgcctttggcgagggtgtggccgtggccgcggtgggtgctggtcacgtaatcgtggtgggtgaggttgctgcatacgccggtggcgacggcctcctcgccgatgtacaggtgggcgggtccgacgatccccttgccgatgtgcgccttgacggtttcctcgaaccggcggatcttgcgcatggtggtgtagaggtcaacggcctgctgcgtggtcaatggtgtgctcatgatgtgcgggctttcgtatgttccttggtttgtttcctgttggatgtgggcggcgcgtgggcccgtcccgacttgtgccgggccttgcgcgggaatcgtcgcggcatggccgtctcctgcatggtccgtctgacgacctgtgcggccgtccttcacggatgccatgccgggccatatggccgacctgccatgatgccggccggagggccgccacggcgcggaccgtccccttggtccgcgccatcccgtccggctggcatcatgtcttctcggcgagcactccccttcagccgagatgcgtcgacgttccccgttcgcgtcgcttgtcgtgtgtgttgttatgttgcgtgctgcggttgcggcggcattcgccgcatgtcaccacagcggaatgacggcccccttgtacagcttgtcgatcagtttcttgacgtcgtcgctgcggtaggcgtccacgatcttcttgtaggtggcgttgtccttatccttggcgcgggagacgatgatgttgtagtacggcttggactgctcgttgaccggctcgatgtagatggcgtccgacttggggttgagtcccgcgtcgagggccatgaacacgttgatgacgctggctccgacgtcgggcagcgaacgggcggtctgcgaggcttccagctcggtgatcttcaggttcttcgggttggacacgatgtcgtccggcgtggggttcgcaccttccttgtagtcgagcttgatcaggccggcggactggagcagcagcaggccgcgggccgcgttgacggagtcgttggcgatggtgacttcggagccttccggaatgtcttcgaccttcttggccttgtcggagtacaggctgatcgggttgagcaccgtctcgccgactgcggcgagcgcgttgtcgtgcgtcttgttgaagtcgtccatgaggatgtagccctggtaggcgttgaggtcgatgtctcccttggcgagcgcctcgttcggctggatgtagtcggagaacttcaccagttcgacgttgatgccctccttcttcaggttcgggatgacgacctgatcccagacctcgttgctgtcgccgaccacgccgaccttgacggtggtgccggagtctgccgagctgctgttcccgcacgccgtcagaccgccgacaagcgatgtgaccgccaataccgccgcagcgattctcctgatcttcatgtctcttcgttccccctggtatcgtgtttggtttgtgccgtgtgtttggatgctaagattgctgatcgtgcacattgatcttgtgcgcccgctgcgttccggcgggatgccggccgttttcgcgaacaatgttcagcgtaatgcgcgttttcacgcggttcttgcgattgcgtcgaacagggctatcgccgaaatctatatgccgctatcatgcgcgtatgccgcacggccggcgaatgcgcgcccgggcggcgcggaggccaccaccagtctcacatattgagacataaagccgtcatctcgtcggattcgccggcaaaaaccgcgccgtaaccgaatcgcctcgaatggaccggtcccggagacggtggcataatacacgcggaaaacatcagtcacggcgaaaccgtgcaagggagggaacatgatcatcaccaccgtatccggcgcatcaacggcgtccggcagtcctgtcaacggcattctgctggcgatccacgcgggagccggcgaccggagcaaggatggcagagcgcagaagactgcgcaggccgagcgcgatctgcgtcgggcgctggacgccggctacgcgctgctcgaacagggcgcgcccgccgaggatgcggtatgcgccgcgattcatgtgatggaggatgcgccggagttcaacgccggtcggggcgcggcgctgaccagcgagggaaaggtgtcgatggacgcctgcctgatgaccggcgacggcgaggtcggctccgccgccgggctgaccacggcccggcatccgatcgatgtggcccgggcggtcaaggagcgcgccaagcacacgatgttcgcgctgccgggcgaggacctgctgcgctcgtggggcatcgaattgcgcgatccgtcgtatttcatgaccgaggaacgccggcgttcgctggcacgcgcccaatccgagggcgacgcctgggagaagcacggcacgatcggcgcggtggcgagggatgccgccggacatgtggcggcggggacgtccacgggcggcatcacgaaccagatgccggggcgcgtcggggattcgccactgcccggatgcggcacgtacgcggccgatgacagcgtcgccgtgtcatgcacgggtatcggcgaggcgttcgtgaggtctgtcgcagcgcatcaaatcgcggatcgtgtgcggttcgccggccagtcagtgcaggaggccgctcaggccgcactggatgacgtggcggcccgtcgcggcgacggcggcgtcatcgtcatgccggccagcggcgacggcgtcatcgcctacaacagcgagacgatgaactacggatacgtcaccgccgacggcgtccgcgtcgttcacggcgccgaataacaacagacggcctgcgccatccgacgacagctttccgtccatcccgcgaaagtcccatttgcggcgtgcgatatgggactttcgcgggatagggcaccggatgatatccggagctacaccgcggatgacgactggaagacgaccggatgacgaccgtccgatggacccttttgcagggtcagcctacgatggcgtcgacggcgtcgatgacggctccgcggaagccgtccttctccagcttggcgacgccgcggatcgtggtgccgccgggcgagcagacggcatccttcatcgctccgggatgggtcccggtggccatgtacagcgctcccacgccctcgaccatcttcgcggcgagccggtatgcggtggcccgctgcagtccgtactgcacgccggcgtcacccagcgcctcaatgtacatgtcggtgaaggcgggtgcgcagccggccaccaccatggcgatggtcatgtgtgcggcgtcgacgcgctcgatcagcgaaatcgggccgaacagcgattcgaagacctccgtctgcatgtcggtgagcgtgttgtcgatctcggtgacgagcacgcccttgccgacggccaccggcgtgttcggaatcgtgcactggatatgtatgctctgagccagatcgccgaacagcttctggtacttcgccagatcccagccggcggcgatcgacaccacgaaccgtccgttcttggcgaactcgtctgcgatgggcttgatgacggattcgatctgatacggcttgatggcgatgatcaccacgtcggccgcggcggcgacctcacgcacgttgtgcagtggacgcaccccgagcttcgcagtgctggcttccagcttgtcgtaatgcgccgcgcaggcgacgatgtcgccgccgttgacgacgcccgcatcgacgagaccctgcgcgatggcctgcgccatgttgccatagccgatgaatcctatggtgatgttctgcgccatgatgctccttgttgtgttgttcatacgaaagatgcagttcgtcatgccccgccgcgcacggccgcgaagcgtacgcccgcacgctagaacagcgattccaggtcgccgcggttgagggcctcgtcgtagagatggcggaacacgagatcgccgtgcagcccgtcatgctcgaactcgttggtgacccagtaatgcgagttgccgacacggctcagcgtgtcgagctgcatgccggaatccacgtacatgtcgtcgaaatacacggccgattgcagcggaacctcgttgcgggccagctggtcggcgtcatagatcacaccgaatctcgtatcctccatcagcaggtccatcgccggcttgaacggccgcagcgcggactcctgctcgaacatccacgggaacatcgcctcgccggtgaaggccagcgggcgttcgccggtcgagaaccggggcatggtgtcgcgcacgcgctgtgccgcccagcgaatcggctcgtccagttcaccgttcgcgtagatgaactcctgcagcggccagtacaggggacgcgaggaggtcgcgttcatgaccttcgccaagaactcgtcggacaacgccgccccggctgagaccgaaccgtcgccgtcgacgaacgcatcgtcgaaaatccagtgcacgcgctcgaagcttggcttcatgccgaagtcggagccgaggcattgcaggcgctccacggtcagcgggtcgccgttcggcagcagcggggttccctcgggcagcgagccggaatcgccaccgatgccgccggcttccgcgatctcagccacggtcggcagctgatccgcgacagcggcgacacgatcggcatcgacgccgtagcgctcgtaaaactgcgcggtcttgcgggccatgcgcgggaacgtgtgctcatagacctcggtcgcgttcgccgggacatgcgggatgccgccgcaggtgaagctcgcggccactccttcggggaacagcgacaggtaggtcagcgtcagaaatccgccatagctctggccaagcgtcacccacggcgagccgccgaactcggtgcggcgcagatgttcgaagtcccgcacgatcgaatccgcgaggaaccgcttgaggtaatccgcttgcgcacgcgctcccccggcggcgagcctcgccatggcatgcgagtcgacgcgcgacgagcggcccgtgccgcgctgatccggcagcaccacacggaaatgcttgaccgcctccgcaatccatccgtcgctcgacgggttcagcagcctgggtccggcccctcccggaccaccctgcaggaacaccagcagaggcagatcgtcatgcacgtgctcgggggcggtcaccacgcggtagaacaggctgatcgattccccgtcaaagccgcgccccggctcatgaccggcccaatcaagcgggaccttgaccgaccgatcctcgatatgcagccccggcacgtaatattcggcaagcagcgtcatacattccctttcattgatgcaccccggcatcccacgatgccgtaccattctcggttccactgtagccgaccggcggcggaaacccgaggggattcccaccaacggaacgcaccccgcccgacacgccgcatcgcaatgaatcatccggccgaccgatgtgggtcgggtcaccgcacgcgatacgctgaaccgtatgggaatcatggaacgaatcaccacgtggaacaggaagcatgtgctgctcgcagatgccctgtatgcggtgatcatctccatctttttcacgctcatggccggtaccaatgacagcaatcccggcatcatcgcctatttcgaccatacggtaatggccttctggagcttcgttctgatggttcccgtcgcgatgcgccggtggaagccgcagatggctacattgctgttcgccggtctggtggtcgtccaactggcgttcgggccgtcgatggtatatgccgacctgatggcgccatggatgctgtattcggccatcgtatatgcggatccgcgcaattcgaaggcgttcatcgtactcgccgtcgccatcggggccttggcgtcgcccgtcatcatctggtccgccgatgcaggtcccatcctcaatcagggcgtgcccttcgatggactcagccccctggagacatgttcggggacatacatctatggtctgagcggtgattgcgccaccaccatgacgacaagctcagtggccatattcatcttcatcgccgtgtatctgttcgcggcgatcatcgtcgcgtactggcagcgggcccggcgcatcaccgtcagcatgatgcatgagcgcaacgacgccttgcaggcaaaagaggatgaggaacgccatatcgcggcgctcgccgaacgcgcccgcatcgcgcgtgacatgcatgacgtggtggcgcacacactgtcgatcatcatcatccaatccgatgggggccggtacgcgggcgccaacaatccggcgctggcccggcagaccatggagacgatccgtcatgaatcggagcgcgcgctgcacgacatgaaacgtctgctgggcgtgttcggagggtcggaccatgccgattacgcggatgtggacgcgctgatcgaccaggcgagggcggcggccggcatggggtgcacgattcgcaagaccgtgtccggccagccgcgggtcgccgcgctcggcgcacaggcgagcaccgcaatgtaccgcatggtgcaggaggcgctgacgaacgtgcgcaaatacggcggcccgaacgtcaccgtgcagatcagcgagatctggggggctgacggactgcacgtcaccgttgccgacaatggccgcggcgcgtcatcgtcgttggacggccacaagcccggttacggactgatcggcatgcgcgagcgaatcggcgcgatcggcggcagcgtgaccagtggcccgcagcttggcggcggcttcgtggtgtccggcttcgtgccgtacagcactgtctcaacgcagtccgaggatgctgcgccggcgtccgaaagctcgaacgcggcgtcttccgctgcggtgtcttcgggcgcggcaatcatgccgatggcggccccgacgaccggaacggtttcaatggcgacggataccgggaatgccggggtcgtcagtaatgtcgcgaacgccccgcaatccgccgtcgccagtcaagtcggtgtcgtccaaccggccggtgtcacgcaaccggccggcgcaaagatgccccgtccggtgtcgcagatgtcatcggtcccgacacaagcaccgccggcgcccatcaccatacgcctgcgcacgattctgtccgccctgcgttcgaagccgatccagcaggcatccgctaccggggagcagcggctcaactggatcgagcgcatgtcgcagtggaccgagcggcattatctgctgaccgacctgctgctcaccatactggtggcctggatgctactttccatcaatccatccgtcatatacgccgagggactgcagctcgacaaccgtttcgaccgcgcattgacgatcatcatcctgattccgttgatcttccgccgcaggttcccggaatccagcgcgctggcggtggccatcctcgctgcgcttcagctgctgttcttcgagccggtcagcctggccgataccctcgcttcccttgtggccctgtattccgcggtgttgtacggccgtgacaaggcatggcgatggacggggatcgccgcaatatcggattccgtgctgttcggctgcaagatcttcgccgctcaaaccgggtatcgaagcatcttcagcatgctgactcattcccgcccggcatattccctcgcgacgacacccgccgcgttcgcatcggcaatcatgttcatggtgatatcgctggcgttgtgcataagcgcgacggccatggcacgatgggcccgatccagcggatcgaacgcgctggtgctgcaagcccgcgaggaagcgttgcgcgcggagcaggccaagcagcgcatcctggcggcgaacatggaacgtgaccgcatcagcgagagcatccagtccgaggtgacgatgacgctgaccagcgtgatcgaccaggcggtcgccggcctgcgcatgcttgacgattgcgagcgtcacggcgaacagccgtcgtccggggccatctccgaggcgttcgcggccatcggatcacagggccgtgcggcgctggcacacatgcgcaagctgctgggcgtgctgcgcgagaccgggttcagcgatgaggctcaccggcaagagcagcccggcatgcagctcaggcccgcggcatcgctcgacaagcagctgcacgatagtcagctgcacggcatcgcgtcgtaatgagacggcgctccacggcccgccggggatcatccgacatgaattcagggttaaatcagggggcgtgatgcgggacttgttcgccgatgttggatacagtggaaggcatgagtgagttgcaaagaattcgggtggtcatcgccgacgatcaggaactggtgcgagcgggattcgcaatggtgatcggatcccagccggacatacaggtggtcgggcaggcgggcgatggcgcccaggcggtgtcgttggccgaatcgctgcaccccgatgtggtgctgatggacgtgcgcatgcccggcatggacggactggaagcgaccagccgcatcagcgcgctggaagcggccgccggagacgcgccgcgcaagacccgcgtgatcatcctgacgacgttcgacttggacgagtacgtgatggcggctatcaacgccggcgcatccggattcctgctcaaggacaccgagccggagacgctgctgagttctattcgcacggtatatcagggcaacgcgattatcgcgccttcggcgacgaagcgactcatcgaaaagatgatggaggacgggtacaccaagcatgggttgacggcgactgacggctatgcggacggttcgtccacgatgcccggcgcccggccggtggcatacactgacccggaactgaacctgctgaccgagcgggagcgtgaggtgctggtggagatcgcccatggattgtcgaatcaggaaatcgccgacaagctgttcatcagcctgccaaccgcgaaaacgcacgtggcgcatatccttgccaaaatcaatgcgcgcgaccgcgtccaggccgtcgtcttcgcctacgacaacggtctggtataaggcgaatataaaaacgtccccgctggcggggcgcgatgctcagtccgccagcggggacgctagttgtcagatcgcgtgcttgcggcggatcatcatgatcgtgacgccggcggcggcgatcaggatgaacgccgaggcgatgccggacacgtccgcgccggtcttcgacagcggctgcgtgccggaggggttgcggccagcggcattgttgacaccggtgttgccggcattgctaccgccgttaccgttgccgccgttgtcgccgttgctgccactcgtctcgcgcacgaccgaggcctgcgcctggccgggctcgaccttgacgacgttcttgccgtcggcgctcagcgtgaccttggcgctgtaggccgcggcgaggttgactcgcgcccagccctgcgacgaggcgtccagcggatagccggagtcaccttcggtcgcggcgagcacggccttcttctgcgcggaatccagcgacttgaacgcggcgacgttgtcgagcatgcggacggccgagtcaggcaccaccggcgcctgtccggtcgtgcccgtggcctggaagccataggtcatgcgggccttgtacgcggccagtgcggaggcgcggtcggtaaccggcttggtcgaaacctcgtcggtgaaatcgttgcggtagccgttggcggcgttcgcgccggtgttcgtgatgcaggcgtcgagcgtatcgccgtggttgtcggccttgcactgcgcggtcaggtaatcgacgagctcggcgcgggcggccgcgccttcctgtgcggtcttctcgccgctcaccgcggtggcgacgccgtactggccggcgatgtggccgcccatgatgtcgagcgggtagtgcacgccgagcacgatgcggttgttgccggcctcggacacgcgggtcatgatctccgggccgagctcgggcagcaggtacgccaggccggcgccctgcgtgaacgcgaaggtggtgtggccggacgggaacgagccggagttgtacagtccgtcatactcgttgtcgggcgcttcgccgtctccccagtcgaagttctcgtaaccggggaccttcttgatgttcagcgtctgcttcagaccgttcatgttcagcgtcgtgccgttgaagttcacgcggtccacgtaggggcgcgggtgctggtatgtggccttggcgacgccggtggaagcggacttgttcatgtcggacaggaactgggcggtcttcggcaacttaccagcgtcggcggcgtccttgtagtacttgccgagcaccggaccgagcgcgtcgtacagcgtgttggtggagttcatctgggcgtcggacagggcgcgctggtcctgcgcggtgttgccgtcggtgccgtacgccttgttgttgatgtcttcggtgagctggtcgtcgtgcgcgagcaccgacttgccctcatcggtcacgcccttgcctgcgacgtagtacttgttgaagtcggtcagcagtccggtgatcgtgtccttggaggatgcggtcttcaccacggtcggcgccttggcgccgaaggagatggcggtgatggtgctgccgtcttcgctcagcgtcaccttggcgctgaaagccttggcgaggttgatgcgctcgaatccgttggagctggcgtccagcgggtagccggagtcaatttcggaggcttcgagcacctgacgacgctgggcgtcggtcaggtcggggaatgcggtgagcagcaggttctccgcgccttgcggcacgacgggcgcctgaccggcggccgaggtctgcgagaatccgtaggtcatgcgtgcggtgtaggcgtcgatggcggacgcgcggtcggtcaccggttcggtggacaccgcgtcggtgaaggtgttcttgtatccgttcttgtcgttggcgccggtcttgctcacacacgcggcgacggtgtcgccgttgccgtcggccttgcagcgtgcggcgatgtagttctcaagttcgtcatgggccggcagcagcacgttctggcggaacgtggcatcagaccacagagcggtgacggatgcgctggcggagatgcgtccgccgatcacgtccatcgggtagtgcacgccgagcacgacgcggttgttgccgccttcggcggcgcgggccacgagttccggtccgagctcgggcagcagcgtggccaatcccagaccgcggttgtaggtcttggtggtgtggccggacgggaaggactgcgacggctcctgatagtcggtgtaatcctcgccgtattcctggccgtcgatattgatcatcgggatgcgcttgatgtcgagcgtcgggctcagaccgttgaggtcggtgtcaccgccgatcgtgcggtcgacgccttcgttctccttgttgaagtacggacgcgggtagttgaagtccttcttggcgctgccggtgccgacgaagcccgcgaacgagtccttgctgcttttgctgaacaccaggtcggaggtcttgggcagctcgccctgcgcgacgccctcggccacgtactggccgatgatcggcccgaacgcgtccttgtagatgcgcagtgcgtcgccgtcgctcgcgtcgagagcggcgcgctcggcctgcgtgtaggtgccgtcgaccttggtggtgtcggcggcggccttgttgttgatggccacgacggtcttgtcgttctgtccgagcacgctcttgccggcatcggtgaccttgccgcggaaggcatcgccctgcggcgtgttgttcacgaccttcttcggggtccaccagttgtaatactcgccgagcagcgaggtgatgttcggcttgaccgcgctgccgtacgagggagtgtccgcggcgttcgcggtgacgctcacggacatcagcatcgcgatggatgcgatgcctgccacggcgcccttgaggaccgcggacttacgcattgtcttgtgcattctttcagcttccattgtgtgttggttgatatggaaccgattctgttgtagaccaactgtcaggttccgaccgctgaaagataatgaaaatcaccttcgattaatgaacagttcattttgcaacgtaccgttttttgcgtgttcaggttgtaacatcgcgcgtcgggagccgcgtgtcacgggtcgtgcggtataacgccatataggcgatgaggtcccttcttttgagtgaaagaagggacctcattgcactggcggctgtgttgaccacccaccggctctacgaactaggcttcagccagagcctcgacaggctgaaccgtcaaacagacagtccagtggactgtctgtaggtgaagtgagcggcttgccgcgaaggccgcctaagaggctcaggcttcagccagagcctcgacaggctgaaccgtcaaacagacagtccggtggactgtctgtaggtgaagtgagcggcttgccgcgaaggccgcctaagaggctcaggcttcagccagagcctcgacaggcggcgtcttgactgcgcgacgggccgggaacacgctggcgagcagggctgcgatggcggccaccacaagcacgatgccgttcatgccccattcgaaggggaacaccgtcttgccgtacaggctgaacaccatgtacgaccccagccatccgaacagcgtgccgagcaccacgccgaccacacctgcgacgagcgacagcagcagcgcctcgacggccagcgagcgccgcagctgcccgcgggtcatgccgatggcccgcaatgtcgcggattcgcgggtgcgttcaatcaccgacagactcagcgtgttcgccacgccgatcagcgcgatgagcaccgcgacggcgatcagcgcgaccagaagcatcagcatcgagttgatgatggtctcccattgtgcgcgttgcgccacgggaccggtgatggacacggtggagtcatacgaaaatacgtcctgaatcttgttgaacacgtcactcagggagacgccggccgactgggtatccacacgcatgagcagcatgtggccggtcgcggtgatgtcgccgttgttgaaatggctggtgttgatgaaggcgacggcatcatagttggacgagacgcggcggtaatcggattgcaccggcttgagacgcattgatgaggaaacacctccgttcgtcgagcttgcgctggcggacccgtcttgctcggtgcttgccgcaatgccattcgactccgcggcagtgaaccgcagcttcgcatcggagccgaatgtgatctccttgcctgaggtggcacggtatttcggcagcagcacggtgtcgtcgccgacggtgacgccgctcaggtcggcgtgcatgacgccggcgagttcggaggtgttcttgacgccgacgagcagcagggacatcgttcccccgttcacgccttccgcggtcaccgtcgccgtgggcgcgtacatggtggccgcgacgcccttgacctgggccgcttccttgactgcgctggtcttcaggccgtcgccggtggcgatcatgtcgacactgtaccgggacgcgagcgcctcccccatggtctgcttggcgctggctgcaccggtggcgatggtggcgaccagggtcacgccgatcagcagcgcggtgccggtggcggcgacgcgacgcgggttcttctggatgttggcgtgggcaactttggcgctcggaccgcacatcgagacgagcgcgccgacgccgcgcatcagcaccggcagccagaacgtggcggtgagtacgagcccgaggaacaccagcgcggccccgccgatggacatcagcagcacactgctgtaattgtcgctggccatggtgtccagaccgttcagcatgccggacagctgccatacggcgacgccagccagtgccaatccggcgatgatcgtcagaacgccaatcgtggcgcggacctttccggcgcgtgatgtatcggtcagctcgatcgggcgcagggcctcaagcggcgtcacgctggtggcggaccgtgcggagccgagtgaggcgagtacagtcatgatcaggccgaatgcgatcggaaccacgaacgcttgccacgagagaatcagcctggcctgcatccccatcatttccattacgcccgtgttcgtgaccagcgcgatcagaccgacgccgaagccgacgcccagcaccgacgcaatcaggccaagcaatccggcctccatcagtacggatgtgtacagctggcccttcttcgcgccgattgtgcgcagcaacgccagcgtgcgcctgcgttgcgccaccagcacctggaacgtgttggcgatgaccagggcggcaacgaacagtgcgagcacaccgaagctcagcaggaatatggtggggaaactggtgttgttcgagctgaggtccctgacggcctccgcctcgaccgatcggcgcgattccacgccataagatttcggcaggagcccggagacctcgtcgacggtccgctgcgcggcagcggcgtcggcttcgtcgatgtcaagcaggagcatgtacgcctgcatatggtcgaaatcatccacgccgtataccgcggcgacgacgttctctgacagcaccgaagcgccaccgtaaaacgagtacacaccaaacgggtcgctggtcaggccaacgacgcgcacgtcacgcaccgcggtgccgctcagagcgctgccgttggatatcggagcgacgtccaccttgtcgccgacacccactccaagttgtttggcgacggattttggcaacgccacctcgttgttgtcgaccggctggtcgccggagacgatgcggaccggcagcagcttgcggtcggttgacgtgccgacggcgtatccgttcgagcgcttgcccgctgcggagatcgaaacgctgacggacgtgtcgacgcgggcgcccttcacgcctttcgtggcgcgtatccggtcgaggttgaaatcggcgacggtggttctgtcggccgagccgttctcggagaccgcgccgttgctgtttgttttcatcgtggcgatgtagttcgcttcgccgagctgggcggtacgctgcctgcgcagcgagtcgtccatggagttggagaacaggaacgtggcggcgatgaacgccgtgccgataaggatggctatgcctgcggggatgagcatcctcgcgctttttttcatgagtttgatggtgatggagaacatgagaagtccttaatgctgtgggcgggtcagcggcggtgctgggcgacggcggcgtgctgcggagcgcccggaacgcttggagcacccggaacgaaagacgccttttcggtgtgccccttgagggccgccaccggcggtcttggaacggtggtgcccgcggacggcccgccgaccagttgggtggcccactcgcgctcgttcatcaacagttggttcatgctctcggcggtcgggcgctgctcgtcggcgacgatctggccgtcggcgaacacgatcgcacgatcggcataggatgcggcgacggcgtcatgggtgaccatgatgacggtctgcccaagttccttgacggatcgcttcaggaagctcagcacttcggcgctggagacggaatcgaggttgccggtgggctcgtcggcgaacaccagcgacggtttggtgatgagcgcacgcgcgatggcgacgcgctgctgctggccgccagacagttcattcggccggtgcgtgagacgttccttgagtcccagcgtcgtcgtcagcatgtcgaaccactgacggtcgggcttctgacccgccagagtcaacggcatgaggatgttctgctcggcggtgaacatcggcagcaggttgaagctctggaagatgaagccgatcttgtggcggcgcagcatggtcagctgattgtcgttcatggtggtgatgtcggcgccgtcgaacacgatatgaccgctcgtggccgagtcgagtccggcgagcgtgtgcatgagcgtggacttgccggagccggacgggcccatgatcgcggtgaacctcccttgctcgaaccgcacattgacgccgcgcagcgcatgcaccgcgttttcgccatgcccgtagtccttgaccaggtcgatcgcctcgatggcgatggggtgccgctgttcctgcgccgcaccggcattggtctgcggctgcatgatctgctgttccataacgtcctcttccatatcaatacagggattttccctgaacgttactttcaccatacggatggcgggctcggaccggcatcgtgcggcggggtgaatcgccatcgtgcccatcatccttgagtattacgcgctcgaacattgtgcgcggtttcactgcgctcggcggcctctctcggccgggagcacacgggcccgtggcgatgacggggcggggatgataggggatgcctggcaagaagaattgtacgatgagcgagaacagtgttgagaacgagaatggcgaaacgtccattttccaatgattcttagatttgccctcacgccccgaaacggcatgtaaccggttaaaaacgatttcgtggcacagggaatgccacgaaatgcctaaaacagcgatttttaccgtttcgtggcacgaaaccccctgcttgcatcactgttcaagacaaaaagccaaaatgtggtcggaacggagctgaacagcaggatcggaccatacgccctcccgctggcgggaggtggcgcgaagcgccggagggtggttgtgcggcgacatcccacccgcttcactacagcccagccagcaagggctatatgtaacaaacccgcgctgcatgacgtcagcgcgggtttgtacgggttccccttctcgttccgcgtcacggttccccgaccggcgacgcggaaaatccttgcggctatctagccaagaccatcacttggccagtccggaggcgcgcagcgcctcgaagccgcccttgaggtcgtcgaggatgtcctcgatgttctcggtgccgatggacaggcggatggtgccctggtggatgccctgatcctccagctcctccagcgtctcctgggagtgcgtggtggaggccgggtggatgaccagcgacttcacgtcggccacgttcgccagcagagagaacaggtgcaggttgtcgatgaagacacgcgccgcgtccttgccgcccttgatgtcgaaggtgaagatggagccggcaccgttcgggaagtacttcttgtacagctcgtggtcgcggcgcccctcgatggacgggtgcgagacggactcgacctcaggcacggtctgcaggtactcgacaaccttcagcgcgttctgcacgtggcgctcgacgcgcagcgacagggtctcggtgccctgcagcagcaggaacgcggcgaacggggacagggtggcaccggtgtcgcgcagcaggatggcgcggatacgggtcacgaaggcggctccaccaagggcctcgtagaagttcagaccgtggtaggagggatccggctcggtcagggtcgggaacttgcccggcacctcagcccagttgaagttgccgccttccacgacgacaccacccagcgtggtgccgtggccgccgatgaacttggtcgcggactcgaccacgacgtcggcgccgtgctccagcgggcggaacaggtacggggtggcgaaggtgttgtcgacgatcaccggcagatgatgcttgtgggcgattgcggagatggcctcgaagtcgggcaggtcggcgttcggattgccgaaggtctcgaagtagacgagcttggtgttctcctggatggcgtcctcaaagttctgcggaacctccggatcgacgaaagtggtggtgatgccgtcgcgcggcagcgtgtgcttgagcaggttgaaggtgccgccgtagatgttcttggaggagacgatgtggtcaccggactgggtgatgttgcgcacggcgtactcgacggccgcggcgcccgaggcgaccgcgatgccggcggtgccgccttcaagggcggcgatgcggtcctcgaacacgccctgggtggagttagtcagacggccgtagatgttacccgggtcggcgagtccgaagcgggcctcggcgtggtcgaagttgtggaagacgtagctggtggtcgcgtaaatcggcactgcgcgggagtcggtggccgggtcggcctgctcctggccgacgtgcagctgcagggtttcaaaacggtacttcttgttggcttcggtcatggtggtcgctccttttcccatgtcgggatgctgtggtttccgtgtctttcttgtcgccacccgtcggcggtttccagcgtctggcgaggtgttggtttagaccatagggcacatggatgcggcatcgcaagtccggcgttatcgcggttgcctataaccctttaaaagccgttggcatcattggtgtcgcaggtcgtaacaggagccctaaaaccgactatccacgatgcgacacgccgctgccgtcagagccggttccacaggtcacggatcatgtcggtgatggtcaggtcgcgcagggataccatcttcgggaacgtgcggatcagacggcgctgctggcggttgagcgagcgacggaccagctcgccggcatccgcaaccggtctggatgccgcacgaatgccctgctgggctccggccgcgaaccggtcatacgcctgctccgcctgcccgcgcagtttggcggacgtttcgcgccactgctcgtcggcctcgctgatgcgtgtgtcgatctgtctgatctgctgcgatttgagcgccttgatgccctcgctgaccttcgccagacgcgaatcgagactgcgcagaccggcctgggtgatggccgcatcgattaccaccacgacgaacgacagtcccgcgacggcgtgaagcagccatatcggccaggaccggacgatgtcggacatccacggctggaccaccagtttgatgcacgtcgcccccgcgccgaacgccagaaacccgttgagatacacgcgcccgttgatgttgaacggcttgccggaataatcccagaaacgcatgtggtacagtttctcgatcgcccagctcgacgcatattccagcgtgcatgcgagcacgccgctggacaggaacagcgacagcggattgttcacgtcatgcagcagcacgacgaccagcagaccgccgaacccgtagatcgggcatatcggcccgttgagcatgccccgatcctcgaaccgcttgcgcagcacgacgctcaggccggtctcccacacccatcccgcgaacgagtacgccagccaatacaggaagaagcgttccacgacaatcagaacatccatgggcgtcatggcatcctccttgcgatcatgcggacggaaccgccgcatcgggcttcgtcccgtcgtcacgtgtatcagacaactctagcgcgaggcgtcacgttccggcttccgctcccatgccgtcgatacgatgcaggtggcacttcccggccgcccgccaccggtggcgcgctgggcgggaccgcgttacgcggtgtgcgcccgacgatgctagtctctgttgtgtatcgtcattgcctaccagtaaggggtgtttccgaatgaccgatgatgtgacgctgtatgaccgcgacccacattacattccgcgcgtggccgccgtgcacgacatgtgcgggtatggcaagtgctcgctgaccgcggcgatcccgatcctgtcggcggccggctgcgacgtgtgcccggtgccgacggccctgttctccgcacacaccaagtacgccgtgttcacgttccatgacacgacggacattctctccggatatctggatgcctggcgcaaggagaacgtcgaactggacggcgtgtacagcggcttcctcggctcccccgaccaggtgtccatcatccagcgcctgtaccgcgaatatccgtccgcgctgcggctggtcgacccggttatgggcgacgccgggcagatgtacccgacgtacacgccggaactgtgcgaggcgatgggggctctggcggacggcgcggacgtgctgatgccgaacctgaccgaagcgagcatcctgaccaagcgcgactaccccgggcaggatctcgatgacgccgccgtgaccgaactgctggacgcgctgctgggactcggtgccaagaacgtggtgctcaagggcatcgaccacggtgacggcaagatcatcaactacgtggcgagcgccgaaaagggcgctgccgagaaggtcgagcttgtgcacgacaagctgccgtacatgatccacggtacgggtgacgctttcgcgtccgcactgtgcggtgcggtgatggccggccgcggcctggccgaatcggctcggatcgcgggcgaattcgtacgtcatgcaatggaaagcacccgcaatcagccgcatttcgaggagcgcggggtcagtttcgagctcgatctcggtgagctcacttcgctggtgaagtgagaccgtgccgcaaagccggcaaaacggaactgcgccgaagccctggctgggccttcggcgcagttttgtatcagaaccactctgactcgggaccaaggaatccggcctgaggggaaggcgtcaggccactcccgtatcgcagctctcagtattcgcgcgtcttgggcgggaagtcattgatgtgcacggactgccacaggatggaggcgtgaggtgccgatgaagcctcggcatcggcggcatcggccatcccgatcatcgaatgcgcgaggaaacgttcgtcgtcacgcgtcggataatcgagcctttgcagggaaccgcgcgattcgtggcgcgcctcggatgcgcgcagcatggcttcggcgagcagtgtcaggtgccgtacctcccagatcgcggttatctcctgattgaacgcgggtgtctccgaatgcgccgtgagacggttggcgcggggacggatcacagtatcgagcaggttcagggcctcgctgatggaacgggcgtcgcaacgcaccgccagcgcatgttccatcagcgttcccagatcggcggcgagccgatacgggttatcctcctcggaaccgggctgcgcggaagcatctgagccgccgagctccgctgtctgcggcataccgtcagacgtatcgtctgccgcgtcatcgtccacgtccggtctgcccgcaagcatcgtggcgacatcctgcttgcgcgaacgggcgacgtcgtccaccagcgcggctgccgcctcggcgggaccgtcatccgcatcggcgccgcgcatcgggtcgtcgaccggcgactgtgcgatgcgggccgccagcgactcacctgcgcgcgtgccgaacaggcatgcgtcgagcagcgagttgccgcccagacggttcgccccatgcaccgacacgcacgagcattcgcccgcggcgaacaagccctccacgaccgtgcgggtaccggaatcggcgtcgccgtcctggctccctgactccgcccagcgatacacctctccatccgtggtgatcgggatgccacccatcgtgtaatgcgcggtcggtttgaccggcaccatgtccttggccggatcgaggttcgcgtacgccttgatggtctccaccacctgcggcagcaccgcattcatatgatccggatcgatgccggtcatatcgagccacacgcagtccttcggaccgtccgggtctttcgggtccgcgacgccgcgtccgccgtcgatctcggccatgatcgaacggctcaccacgtcacgcgcggcgaggtcgcgatgctccggcgcataacgttccatgaacgcctcaccgtcggcgttgcgcagcacgccgccctccgcacgggcggcctccgacaggagtatgcccgtgtgcgcgagacccgtcggatggaattggacgaattcgatgtcttccagctggagtccggcggacaacgccaaggccatgccgtcgccggtcagatcccatgaattcgacgtggtgtggaacagtcgtcctgcaccgccggtggcgaacatcacgttgtgcgcatgaattgcgtgggtgacgccggcgtgcgtgtcataggcgaccacgcccgcaacggcgctccccgacttgtcaagcaccacatcggtcacgtaccattcctcggcgaattcgatgccggccgcgacgcactgctgccacagcgagtgcaggatctgatggccgatgcggtccgccgcatatgccgccctgcgcacgggcatcttgccgaaatccgcggtgtggccaccgaaccgtcgctgcgcgatgtggccgtcatcggtgcgggagaacgccacgcccatacgctccaggttgatcacggtctgcggggcgtactcggcgagcagcttggccgcatcctgatcaaccagccagtcgccgcccttgacggtgtcgtagtaatgccaatgccaatcgtcctgttccacattgcccagactcgccgcgatgccgccctccgctgaaccggtgtgcgagcgcaacggctgcagtttggatatcaccaggaccttcggctcgatgccggactccttcaactgttcgatgtcaggggagtgcatcagccccagcgccgccgacaggccggccgccccggcgccgacgatcaccgcgtcatacatttcttccacatgtttcggactcatatccaagattgtcgcacaagggctgacgttcgccgcgcacgtgacgggggcacggcggataataccgttcatggaagaaatatccgacagcacgacaacgcccggcaacacggcgacgcccggcaatgcggcaacatccaacggcacagcgtcatccggcagcacagcgtcgtccaacagtgcgacatcgttcaacagtgcggtgtatgacatcgtccggcggatcccgcgcggagcggtcgcgacctacggccaggtcgcgacgctggccggccgcccacgcaatgcgaggttcgtcggcttcgcgctgcacgccaatcccgaacccggcgtgattccctgccatcgcgtcgtgttccgtgacggttcgctggcgcccggcttcgcgttcggcggcccggagcggcagcgcgcgatgctcgaagaggagggtgtgccgttcatcccgccgcgggcgggtcacgacaatgccggtgacggtggatggcgtgtcgacctggcacgatgccaatggcaggcgtaacgcacgccaaggcaccatgctttcgcctgtaccatccgccacgagtgagtatcatcatcatgatctccgtctccctccggtttccggaacgatggagatgcgaccgttctcgacggttatcagtccgatgagctccatcgtccccaattgcgagagcacatgggcgaccaactcatgcatgccgcgttccggcaccgcatccgctccctttccttccgttgacttcccttccgttggcttcccttccgtcgcgcccgtctcaaggcctttttcacctgaccgggtgcgcagctgttcggcgacggattgcgcggtcggggctatccgccggcgacggcaccatcggatggcatcgatgatcgcccgctggctctcggtcatcgccgatgacctgttgccgcccgatgggctgctgtcgcgcaatatgccggcatcacgaggcgtcccgacatcgcagtccgagccgtctttccgttgagtggccacgtcgtgaaacgactccggcggatgcggggcatgccagacgtcatccatgtcggcgacggagcacacgatggtggcccgttgctcctgaatgagccggttgcagccgccgttgcccggcatgtcaatgttgccgggcaccgcatggatgtcccgctgcagttcgcttccccagttcacggtgttcagcgcccctgaacgcagtctcgcctgagtgaccaccagcgttgacgaaagcgcggctatgatgcggttgcgcgacaggaaccgcctcgcctccggaatggttcccgggcacagttcgctgaccagtgctcccccgttttccgcaatcccgtcgaacaactcgctgttgcactgcggaccggcatggttgaggcctccggcgaacacggccaccgtgcgcccggcccgtccgatgccgtacgcccgcatcgcgtccaatgctcccctatgggcggcggcgtccgcccccatggctccccctgaaaccaccagatgcccggcttgcgcggcatgcacggctatgtccgtcgtcagtcggcgcccatactcgttgacgccgcgcgagccaacgatgccgacgggctgcgggcaactggtcaatgccgcgcgatcgccactgccccacaggcacagcgggggcgcgcaacgacccagcaacgccaggtcgttgagacgggtgggccaccatacgtcatgcggcgcgatgatccattgcctcccctccatggtgaaccagccgcagagataatccctgtcccacgtggggagagttcgcaatcgctgctgccatgtcgccaacgcggagcgaaacgaacgcaccgcctgcggcgtgggcttgctcccccatcgggtcatgccgatgcagaacgcctgctcgatgaccttccccgcgccggccgacgtgcgcagttccgggtcgctgtcccggatgagggtgagcgcttcccacgcatcggccgtgcccttgaggagcgcggtcatcagcgcgtctgcggtattgaggcagaatgtcaggatggcccgagcgagcgtctcctcgtcaaggtcccagcaaaggccgctatccgactcgcatacagtcatgacatcctcgctctcaacatgatgccttgcgacatctcgtccggccccggcgacgttttgcccgccagatcggccagcgtccatgccagtcgcatggcccgatccactccacgcaggctcagccgatgcgacgccagcgccctgttggcgagttccagcgccttcaccgacgtgttggcgcgcatccacgaccccggcacttcggcgttgcagccccacccgtatttggaataccgttcgccggccgccgcccgcgccgcgatcacctgctgctgcatgacgtggctgccaatcgaatcgcgggtcggcgccgaggctatgcacgggaccggcggcacctccacctgaatgtcgatccggtcgagaatcggaccggatagtctggcgaaataccggatacggtccttctccttgcacacgcagcgctccccgttgccgtaggcgtaaccgcacgggcacgggttggctgccatgaccatctggaacatcgccggatagtaggtcgtccccttcgtgcgagacagggccacgtacccggattccatcggctcgcgcagcgtctgcagcgtcctcgcggagaattcaggggcctcgtccatgaacaggatcccgcggtgggcgcgcgtaatcgcccccggcatcgcaagccctgatccgccacccaccagcgacgcggtcgacgccgtatggtgaggcgcctcgaagggcggcatatcggagatgccataatgctgcagcgtgccgcacagggagcgtatcgacgccacttcgagctgttcctccggcgtaagcgggcacatgatgctcggcatcctggaggccaacatcgtcttgcccgagcccggcgggccggtcatcagcagatgatgtttcccggccgccgccacctgcaatgcccacttgacatgatcctggccgaccacctcgctcatgtcacccaatccgctgaaggccggcgtgtcctcgaccgtgcacgagaccgtcgcacggtcgacgccaagcgtatacgacgctcggcctcccgccagctcgatgagctcgcccacatgacggacgcaggtcacgtccatctgcggcaccaggcgggactcgtcctcgttgccgtaaggcacgatcagtcgccgtatcccccgctccttggcatgcagcatgatcggcagcagaccatggatcggcagcacggtgccgtcgaggttcacctcccccagaacgatcgtctcctccaggctgtcgtgcggaatcgcccccgccgcgctcagcacgccggccgcgatggcgaggtcgtgcgaggcgccccgcttgggcatcgacgcgggagacatgttgacggtgacgcgggtgtccggccatttgaacccgctcgcctgacaggcggatttgacccgttcccgcgattcgctgagcgaggcgtccggcaggccgatgacgctgaaatacggcagaccgggcgagatgaacgcctgaatctggatgatgaaggccttgagaccaatcaggccgaccgaaagggaaccgccgatagccatcagaacgcccccggtatgtggtgcaccgacaccatgcccgcacgcgcgacgatggtgagcacgtcgaaccgcacccccgtatgcctgatgcggtggtccggctcgagcagccactgcacgccggcgcgtctgagattcgtctgcttgtgcagggtgacggcctcctgcggcatgccgaaatggtcggtccgcctggtcttgacctcgacgaacgcgatgacgcggtcgggcgtcatcatgacgatgtcgagctccccgtaccgcgaatgccagttgcgccccagaatcgtgtatccgtgccgttccagccaatccgccgcatattgctcccccagcacccccagctgcttggatttgagcgagccgtcgcacagccggcacagcatatcgctcagccccgccacgggaggatcatgatcggtcgtagcgcctgcgtgttccgctcggcttgtcaaacaggtgtccatgaccatcagtgcaccataaaaccgccttcgaccacatggttttcggccaatgtggtcgaaggcttgcccttcggcgtgttgtggatggaatgtggatgaatatccacttatccacatcgccggcacgacgacgattccgtgcgcggagccgaggcatgggcgcgcccgccaaggccatgccttatggcaaactggttgacgattctttgacttcaggaggcatatatatgagcggctcaagtgacgcgctggccacggtgaccttgcgggtgaacaggttcacgccgcgtcccgagcgtgatcgcccggcccgctccggcagccccttcgccaagaaaagctcgccattcggcggcgcctccgcttcggcgcgtcggcgtccccgcggcaagcagtgggttcaggagtacactctgccggttcgccgggaggatacggtgctggactgtctgctgaagatcaagcgcaccgtggatccgaccctggcgttccgttattcgtgcgggcatggcatgtgcggttccgacgcggtggcgatcaacggcacgccgacgctcctgtgcaccgcgaccgtcggcgactgggcgaaaccggcgacgccgattcccctcgccgatggcgagggattccgccgcaccggcgacgcgggtgataagcggagcgcggacacgaccgctcccgaaggaaactcttgcgaagacaacgcaggcgcgcaatcccacgaactcggcatcatcgaactggcaccgctgccgggattccccgttcagcgcgatctgatcgcggacatcgacccgatgctcgaccagatcaggaagctcaagccgtatctgcaggccgatggcgtgctcgcgaccaccagcgaaggcaaggtggacgtgttcgaataccttcagcggccagagcagctggcgaaatacgagctgctcagcaactgcatcgcctgtggcgtgtgcgagggagcctgcccggtctacgccggcggcgacgccttcatggggccggcggccctgatctcggcctcccgcttcgtgaacgattcgagggacaccgcaaccgacgagcgactggacgccatcgacaccgccgacggcgtggccgcttgccaatccgtgcgcgcctgctcgcgccactgtccccgcggcatcgacgtcggcgaggagatgtggcagatcgtcgcccgcgtccgagagcgctgacagaccgaaacagacaccattcgacaacggttcaggggattgtttatggataagacctcatatgcgaatctcgccagggcatgggagtacgtcgaggatcacgcctattcccggcagacgcaagcgctgctggacgcgcgcgaacaggccgcccagtgcggtcttgcgcagggttccgcagctcaggcgcagctgctgcatacgctggcatgcatgatgcgcagcacctcggtgatcaccatcggctccggctcactcgtggagatcgtccagcttgtcgatgcgctgcacggtaccggccagttgacggcggtggattcctcgacgcagggaatcgcgctcatccgcaagatgttcttcgccctgtccgacacgacacaaacgacgctgcgcgcggtgaacgcgccggtgaacgtgtttctgccgcgtctcaacggcacggattacgacctgatcgtcgtctccggcgatgcggcgaactatttggacacgtttgcccaggcgccgcggctgctccgggagcacggcgtcatcgtgttcaccgacatgctcgcgttcgagggcgacgaggcgaacggcggtgtacccaatcccgccgaccgcagcgacaaggcggtggccatgcggcaattgctggacatggttcaggacgacgaccgtttcgaatcctctctgactccgaccggcaccggactgctcatcgccgtcaagcgctaggaggcgatccggctgaccgccacttccacggcctcgtcggggtcgtccgtgatcagtaccagactcgggtcgagcggcgagatcatgccgtgatcctgcacggtcgacgtcagccattcgaacaggccacgccagtattcggtgccgtacaggacgatcggcatcgacatgaccttgtgcgtctgcaccagggtcagcagctcgaacatctcatcgaatgtgccgaatcctccggggcatacgatcacgccggacgagtatttgacgaacatggtcttgcgcacgaagaaatagcggaagctcatgcccaggttcacccattggttgagcccctgctcgtgcggcagttcgatgcccagtccgaccgatttgccgccggcaagcgccgcaccacggttcgcggcctccatgatgcccggacctcccccggtgatgacggccacgccatgctttgcgattccacgccccatgcgccgcgccgccttatagtccgggtcggtgcgcggcgtgcgggcggagccgaacacgctgaccgccggcccgagctcggcgagcgccccgaacccgtcgacgaactcggattggatgcgcagcacacgccacggatccatgtggagccaatcggtctcctgattgggtttgagcaggttggccgtagtgttgtcgttcggaatcatcgggccgcgcagaatcaccgggccccggtgataggtgtcgcccaacggcgatgcatcctgctgaacgccggagacggcggcgcgcaccgccgcgtcacccgtctgccgcccggtggccgatgatttccctcgttcggcacctgccgcggcgatgatgtcgttcagcgcgttgttcgccgccgcgtgggcgagcttctgcgcggccagtttacgcagcttctttttcttgccgcttttcttcgacgcatccgttttcgacatgatcacgcactccttgtcttggatgtctccaacataccagcagaagctccgttacgacgccgactccagctcctccttctcgaaccgcttggactgacggctcaggaggatgccgctgatgagcgccgcgatcagggatgccatcagcacgccgaaccgtccttccgcagacagctccgtgttcgtgtaggccagagaggcgatcaggaacgataccgtgaagccgatgccgcacgcgcaggctgcggggaacatgtcgcgcacgcgcagtcccttcgccatcgtcagcccagccacgtgcgtggacagccatgccgtgatcatgatgccgagcggcttgccgatcaccagcgccacgatgatgccgatgaccacgggcgacagcatcagcgccggggacagctcggcgaagtgcacgccggtggcgaacagcgcgaatatcggcagtgcgagcagcgaagagaacggctgcagcttgctcgcatagcgttgcgcgcgcggcgacttctcaccgtgcatttcacgcgacggcgtcagcaggccgaccagcacgcccgccagcgtggggtgcacgccggcctcgaacatcatcacccatgccagtacgcctatcacggcgaccagcagccatgggacgcggcgcaatctcaccaggaacgcccagatggccgcgcatatggcgatgccgatgaaccagtaccatgcgttgagcgacgagaagaacaccgcaatcaggatgatcgccagcaagtcatcgaccgtggcgagcgtcatcaggaacgctcggatcgaaccgggcagcgccttggcgaacaacgcaagcaccgccagcgagaaggcgatgtccgtcgctgtgggaatcgcccacccctgcgccgcttcggcgaacgggacatccgcgccggtcgggatggtgacgattcccggcgcaggcggcgcgaaccgggagaacagggagatgaccgtgatgaacagcaccggcggcatcagcataccgcccacggcgcacagcatgggcacggcggcggctttcggatcggcgagcgaaccggtggtcagctcctgtttgagatccaatccgaccgtgaggaagaatatcgtcagcaggccatcctgcgcccaatgcccgatcggcaggatgatgttggtgccgggaatgcccagctgcgtctccgccaccgcctcgaacatgtgcgacgtccatggcagattagccaggaccagaccagcaaacgcgaacgcgagcataatcaggccggaaatacgatcggacgcggcgattcgccggatcctgacccaaaccctacccgtgatattcatgaaccctcaattccataccaggtgaacagcctgacgcggacgtatgcctgacatgtcaggattcggtgccatcagaccgactcctcattttacagacccccatcccactctacgccccgggctgagcctagcgaagcgagaccacaatcacaggggccaaaggcgagccgtgaagaaacagcagagctgcttgtaggcgaggagtgggggaggaaggcgacggacaatccatatccggcgaaagtcccatctattcgtcgccggatgggactttcgcgggaaaggcgtggggatgattccccgccgatcgtcatccggctatcgcctgtaccacaccatgcgatttttgacggttttggggctggtgtggccaagggcgattccgggcccattcaccggccattggaaaatggcggtttccgcgacccgtgctttgccacaccacgtgatgtgaaggctcacatcgcatggtgtggctctctgctgtgccacaccatgcgattttggggtgtttttcgcctggtgtggcacacgggatgagagcgaatcagccggacggatgggtagggactgagtgcgggctgttccattgagctgagaaccacccccagtcatgccgcgcatgccagccctccgccagcgggggcgataatgtcgggcacccccgctgtttgcctcacggctcgccccgccagcgggccgagaggcaatcccggttgccgaaatcaggcgcgctgcgacagggccacggcgatgttgtccagcacctgcttaagcagcgccttcgggcaggcgaggttgacgcgctcgaatccggctccgttctcgccgaacagcacgccctcgtcgaaatacactcgagcgcggtcgcgcatgaaatcgcgcagctcgtccgccgaaccgaagccaagaccgcggcagtccagccatgccagatacgtgccttccggctcgatgagccgaagtccaggcgtgcgttccgcgaactcgcgcagcagcgaaaggttgtcggcgagcacgcccatgagcgcatccagccacggttcggcccgctcatatgccgcttggcacgcgacgagtccgaaatggctgacggtcaggccggcgatgttctccgccgccacgtcgaacgcccgcttgagttcggggttgacggtgatgacgttggagcacagcaggccggcgatgttgaaggtcttggtcggggcggtgaactcatagcagtggccggcgtagcgctcccccagcgtgccgaacatcgtcacgtcgtgtccggggtaggcgaagtccgcatggatctcatcggccagaatggtcacgccgtgggcgatgcagatgtcgcccagacgacgcagctcgtcggcgctccacacgcggccgaccgggttgtgcgggttgcacagcatcagcgccgtgcaccgcggatcggacgccttggcctccagatcgtcgaaatccatgacgtaacgtccgtcgtcacccaggacgaggcggttgtcgagtatggtcaggccgttgtgctccgcggcggcggtgaaaggatagtagacgggtccttgcaggatcaccttgtcgccgggatgggtgaccgcacgcagtgcggtgttgaccgcgggcatgaccccgtccgacaggctcacccaggccgggtcgatgtcccagttgtgccgacgactcatccatgccgtcagcgcgcggaaatacccgtcggtcgcgtaatcgtatccgaagatgtcatgttgggcggcttcgaccagcgcttctacgatttccggagccggcttgaattccatgtcggcaacggacatggcgatcacgtcctcacttcccacacccatgtcatcctcgatcatgtgccatttgatggatgtggtgccgcgccgttcgaccacggactggaaatcgtacacgtctgctcctcgtatgtattcgatggcgccggaacacggtcgtgggcggatgctcctcgttgcgcctgtctgctgtgcgcccatccattggaaaagccctcggaagcattcgctttcaagggctttttgtgcgccgaacaggattcgaacctgcgacctgctgatccgtagtcagctgctctaatccgctgggctaccggcgcataccgcgcatattgaattatgcacaaccgtgaattacttcacggctcgtgcgccagacaggattcgaacctgcgacctgctgatccgtagtcagctgctctaatccgctgggctactggcgcatgttgtcttgtttgcggcaactcaaataaattacatcaatgtaatgactttagcaacttggcgtgtcgcgcgcgtgtcgcgaatgtgcctcgcgcgtccccgtcatgccacgaggcgccgttccccacggaccagtttgggcagaccctcacccctgaccgaggccgcgtcgacgatcacctgctgcacgtcatccatgcctggaagctcgaacatcgtctcctcaagggtcttctcgatgatcgaccgcagccctcgcgcacccgtcccgcgcgttatggcggtcgacgcgatggcgttcaccgcctgctccgtgaaggccagatccaccccgtcgacggcgaacatcttgcgatactgcttgaccagggcgttcttgggctcggtgaggatgcgcgccagatcggcctcggtcagctcgtcgagcacgctgaccacgggcagacgcccgatgaactcgggcagcagaccgaattcggcgaggtcgtcggcgctgacctgttcgagcagttcctcgggcttgacctcatggtcatgccaggaggccccgaagccgctctcgtggcgtccgagcctaccggcgacgatatcgctcagccccacgaacgcaccgccgcagatgaacaggatgccgcgcgtgtcgatggtcaccgtgtcctggtcgcggtgcttgcgtgtgccctcgaccggcaccgaggcgatcgtgccttcgagtatcttcagcagcgcctgctgcacgccctcgccggagacgtcacgggtgatagacgtgttctcgccggattttctggcgatcttgtcgatctcgtcgatgtagatgatgccgtgctgagccctctcgacgtccccgtcggcggccgagatgagccgctgcagcacggtctccacgtcatctcccacatacccggcctcggtgagcgtcgtggcgtcggtgatgacgaacggcacgttcataaccttggcgagggactgcgcgagatacgtcttgccgacgccggtagggccgagcagcagtatattggatttggcgacctcgacgtcggcgagcggatccgtgcggcggcgacgcccgagcgcctgcttcttgccgtcgaactgcccggccgattcgcgcagttccatgttgacgcgcttgtaatggttgtagacggcgaccgacagcgtgcgtttcgccgcgctctgcccgatgacgtaccggtcgagataggcgctgatctcggcgggcttgggcagtgtcagggcgttgacatcggcgctgtgctggcgttcctccgagacgatgtcgacgcacagctcgatgcattcgtcgcagatggccgcgcttgggcctgcgaccagcttgcgtacctgatgctcggtcttgccgcagaacgtgcaccgaggcacgtcctcgttgtaactcaccacgcgccccatgcagctctccttcgactatgcgtcccgttatgcgcactgttacgaggatacccccggcctgacggcgacgggggtatccacttgtgaagattcatgaacctcacgaacggtgttcgagcacttcgtccacgatgccgtaatccttggcttcctgggcggtcaggaacgtatcgacctcgatgtccttgcggatcttctcgacatcctgtccggtgtgcttggcgagcgtgttctccagccattcgcgcatgcgcagcatctccttggcctggatctcgatctccgtggccttgccgaagccctggtcgatggccggctggtggatgagcacgcgtgcgttcggcagcatcaggcgcttgcccttggcgccggcggccagcaggatcgccgcggcggaggcagcctgaccgaggcagacggtctgcacgtcgggcttgatgtactgcatcgtgtcgtagatggcggtcatggccgtcatcgagccgccaggcgagttgatgtacatcatcacgtcacggctcggatcctgcgattcgagcacaagcaactgggccatgatgtcgtcggcggacgtgtcgtcgacctgcacgcccatgaagatgatgcggtcctcgaacagcttggtgtacgggtcctgcgtcttcatgccgtacggcgtcttctcggagaactgcggaagcacgtaacggttctgcggcgagacggccgcgccgccgcgcagcgcgctctcgcgggctgctgcgggcatgaacccgacgacgccgcgcgggccggcgagacggtcggcgcgggctgcgaactgagcttcttcggatgccatttcgatcattctcccttcgtcatcgaatcgtgcgtggtgatgatcttgtccacgaacccgtactccagcgcctcggtggcggtgaaccagtggtcgtactcgttgtcgcggtagatctcctccaccgtgtggccggtctgttcggcggtcagctcgctcatggtcttcttcatatccatgatgagctcggcgttgatgcgcacgtcggtggtggtgccgccaatgccgccggacggctggtgcatcagcacgcgggcatgcgaggtcaggaaccgcttgcccttggtgccggagctcagcaggaactggcccatcgacgcgcacatgcccaggccgacggtcgccacgtcgggctggatgagctgcatggtgtcgtagatggccatgcctgcggtaatcgagccaccgggcgagttgatatacagccagatgtccttcttcgggtcctccgcggccagcatgagcatctgtgcgcaaatgcggttggccatgtcatccttgacctcttcacccatccagatgatgcggtccttcaacagacgattgaaaatcggatccggcatcgacggcatgtcgccgtccgccatcaccggggatgatgtcagcaaatctgccaccttatctccttgactcacagtatgttgtgtctcacaatacgttacagcaattcactctacctgtccgaaccgacggcagcgccctgcaccgcccttttcggctacccgcatagcggggggggcggaatacttgctctattgaaaatcaatttgccgtccttccatgtcggcagtgcccgaggttttgcgcactaccgtatctttcacccaacacgatatcgattcaatcactatcgacagtaggagcgaagtcatcttcgcatacccccagagaaccgaagatggccactttttctgatcaaatgagaattaccacggtgatgaatcaacgcccaacactcaattcatcattgcaacatgcctgccaagagaccacatcatgagatgagagcacgatgctcttcaacaatgtatggataagtcctcatggctaatctgtagtcaatgtcctgaaatatcgaaccatgtttgctatttcaggacattttctaatgagagcagcaatcaacccaacctgtgcagcagcctggacgatacgaaggcggatgccgccacggccaggccgaccggcacgaagaactcgatcggagcctcggtgagttccatgaccaggcacatggccatgagcggagcctgctgggatgcggagagcagcgcggcggccccgatcagggcgcacgcggtgaccgaatctacggggaagacgaacagccagagcagtccgagcatcgtacccagcgtggatcccaaggcgatgccgggctgaagcacgccgcccgatgcgccggagcggatggtcatcagagtgacgaacgccttggccacgaaggtgagcgccagcacgcccagcaacatccatagccggttcagttcaagcggagtcccggcgttgacgaccgagcccggagcgccgtccgagccggcgaggaacgtccatggcgaggccgctgcggacgcggccgattgtgccgcaccggaggtggcggccgtttcggggatgaatgtgctgaagccgagctgcgccgcggcacgcccgttgcccatgacctgcggcacgacgatagagaccagaccggtcaccaatccggcgatcggcatctgccacatcagcgaccgtctggtgggcttgtgcgattcggcccaccgcgagcccttgcggaacagtgcgccgacgacgccgcacgccgttccgcacagcagcgcgaacagcatcaggctcggcgtgctgttcatctgcatcgcgccgatgtcgtagaacatgtgctcgcctttgatggcggtcgcgacgaacgccgcagtcgcagacatccccaatccgaatgcgaccttctccaacgtcacgtcgacgagcagtatctccaccgcgaagaacatgccggccagcggcgcgttgtacacgcctcccagaccggcaccggcggcgacggcgacgaccatgcggcgatcgagcacgccatgcgcgtcgccttcgccgtcaccgatatggaagatgtcgcagaaccgctgcgccagcatggcgcccagctcgcgcggcgcgacctcgcgcccgatggaggcgccggagccgacgatgaatatctgcagcaccacatgcacgatggtctgccagaacggcatgcggcccccgttcaccgccttcttgacggacggcaccttctcggtcttcgtgcgcagcaggtaccatatgacgccggcgacgcccagtcccaacgtgacggaggcgatgcggcggaccgccggcacggtgaacgcgccgggaatgaactcgctttcgatgaatccgagcatcatgtattcgacgccgtacagcagcagcgtcagcaggccggcgcatgcgccgatgatcgcgccgagcaccagcgtggccgcggtcagccagccgatgcgcttccaatcggtcttctccatgatgcacctcttcgatggcgagtggaacgtccgggaacggcagacccgcccatgtcagcctacccgcggcatcctacacccgctcctcaccgcgcatatcccaccgtatatacgatttgacccggaacctttgcggttccgggtcaaatcagtcattctgcatcacgggcacgccgcgatagcagcgatgccgcgcgatttacgctcactcggcgtcggcggtgttctcgtcgtccttcttggcgagctcgtcggcgacggcggccgcggcggaagcggcttcgacactctcggactcttcgtcctcagcggcctcgccgaggaaggagctcaggtcgagggtctcgccttcggacttgaaggtgacggcgcgcatgccggcgagcaggcccttggagcggccgacttcctgcacggcggagccgagctggccgttcttgacgatggcctggatgaacgcggacgggtccatgccgtactgctgggcgatggaggcgaggaagttggtgacatcggcctgggagaccttgacgtccagcttctcggccagggcgtcgagcaccatctggtcggtgagctccttgacgacctgcttctcggcgtcggccttctgctcgtcggtggccttggacggatcggcggtcacgttcttgagctgctgctcaagcatgtcggccttgacgcccttcggcaccgggatctcggcgccttcctcaagcttggcgatgaaggcgtcgcgggcctcggtggcctgacggccttcggcgtcgcgctcggcggccttgcgcacgtcggccttgagctcatccagggtatcgaactcagaggcgtcctgggcgaagtcgtcgtcgagctccggcaactcctcggtcttcacggagttgaccttgaccttgacgagcgcctcttcgccttcgtgctcgccgccctgcagcttgctgttgaaggaggtctcctcgccggcggacaggccttcgagggcctcgtccagaccgtccagcatggtgccggagccgagctcgtagctcacgccttcctgggagtcgacggactcgccgtcgatctgggcgtcgaggtcgatgttcgcgaagtcgcccttggcagccggacggtcgacgccgaccagggtgccgaagcgctggcgcagggattcgaggcggttgttcacgtcctcatcggtgacctgggccttgggcacgtcgatctccaggccgtcaagttccggcagctcgatgtcgggacgacgctcgacggtcgcggtgaacttcagcttggtctcgtccttggcggattcgggcacttcctgcacgtcgatctccggctgggacatcggatggatcttcttctcctcaagcgccttggaatagaactccggcacgccgttgttgacggcctcgccagcgacggctgcgaagccgatgcgctggtcgatgatcttgccggggacgtggcccttgcggaagccggggatgttcacctgcttggcgatctccttgcgggcggcatccagatacgggttgaactcctccgggtcgacggtgatggtgagcttgaccttggtgggttcgagattcctaacgctgattttcacgcttgcgctcctgaaagtcgtttattctacttcatctgccggtaggcaacctctacatgataacgcgacttacggacgctgcgatgagattcacctgccagtcacgggcgccctgcgatttgaggaattccgcgacatcgcgcttgcgcggttcgtcggtccagcacaggttgcgcaggatctgcggcttgacgatgatttcggcgggggtgcgggtgtcgtcggcgatctgggagacgactttgcgcacgtcttgcagcagccgcatacgctgagggtgcctggtggcccagagcttcatcgagcgaggtgcgttcgcatgctcctcgtcggccacgggcgccggcatcaccggccattgcgacggcggcagctccagcgcgcgccgaatcgtctctcgccataccgagggcttgaccttgcgctgaatcggcgcgtaccgttcgaacatcttgtcctgctcgccgccggtgcgcatgcgcacgcgctcgttgagcgacctgatcatcctgaattcgcgggcgttgcggggctttcgcgacgcggcctcgactatcgaatcgtcggagagcagcagtccgggcgcgatgtcataggcgcgggcgagctcgtctcgcttctcccacagcgccttggccacggcgaggccctgatggtcctggctgacggtgttgatgtgcgatatgcgcagccagggcaccggatgctcccgtctgggtcccatgccggtctgcagcgcataccggaactcctcgtcggcccatccgtccttgccctgcaccttcagctcgcgctgcatcttccggcgcagctcaatcagcagttcgacgtccaatgcggcgtaattgcgccagtccctcggcagcggccgatatgaccagtcagcggcggaatgctccttggcgagcgtgacgcccagataatgctcggtgaccgcggcgagaccgaaccggtgcagccccagcatcctcgcggcgatctcggtgtcgaacagggcctgcggcgtcaggccgatgtcggcgaatccgggcaggtcctgcaacgagtcgtgtaatatccacacggcatcgccgaccgcgtcgttgaacatgccccagtcggcaccggcgcgggtcagggcgacggggtcgagcagcactatgccggcgccttcgcgcttgaactgcaccagccagtcctcatggccgtaccggaatccggaggcgcgttccgcgtcggcggccaacggcccggccgccccggccagacggtcgcatacctcccgaaatccttcaagtgtgtcggtcacatccggaacaccacctcgcggctgcgtctgcagcctcggctcatcggtcaactgacggctcctcctcgcattcgctggcggactgcacgaatcgcgcccagcactgcacctggccgcccgcgtccaaaccgccatccatgctagcaaggggtgtccatgagacacgcatctcgcagccggcggttccttcctgagcgagtccgaacgacgtgttctgcgtgacggtgaccgtacccgacacgtcacctaaggaggcgtcatccacgaacgagcgcatcccgtcccagtacatgctcggggcgaggccatcgttctcgtcggacggcaacggcagctgcgcgtaggcgacgcaacgccagtgggagtgccagtcctcgcgttcacgctcgacgtacagcagcatgatccagcccgaggccatgtgggcgtcgccgaacgaacgggagtcgtcatccgcgacgcattccatttccacgccgatgccgtagtcggccagcgtcgagggcacgggaagctcacggtagcgcatgcccgtcacccgtggcatggaacgcaccgattccaccgccgaccagaccgcgtccggcacgccgaccgggcgttcaggcatgtcggcgtccgggtgccgcatcgttgcggagcccctcggaaacgcgaagatttcagccatatatacaggctacggtgtcgtcgaagattttacggtatttccacacgcaagattgtgtaggttttcgagtccgacaccgcagagaacgattccctatcagtacacgacgaatccgtgcgactggaattgctccgtcacacgcttcttcaacgcggcggacgggcccttctgatgctcaagagggtacgggatgcgcagctcatgccacttcgggcgcccgagctggtggaatcccagcacgtcgatgtgttcgacggccccgtcgaagctctcgcagatcctggccacgttctcgatgttctcctccgagtcggtcagccccggcacgagcacgaaccgcacccagatcttcttgccggccttcgccagccgccgtccgaagtcgatggtgggctgcagcagccccccggtgaccttgtggtaggtctcctcgtcgcccgacttgacgtcgagcaggcacaggtcgatgtcgtcgatcatctcgtcggtgtagttggtgttgaggaagccggacgtgtcgaggcaggtgtgcacgcccatctccttggccgcgtggaacacgcgcgagacgaacgccggctgcatcatcgactcgccgccggagaacgtgatgccgccatgcgtggccttgaacaggtccttgtaccggtcaaccttcttgatcatggcgtcgaggtatacgggctgcccgtcgcgcatcttccacgtgtcggggttctggcagtactggcagcgcagggggcatccggacatgaagacggtcatgcgcgtgcccgggccatcgaccgacgtgttgatgtcccacgagtggacgaagccgatgtcgccgcttttgagcgcgtggatgcggtcgcgcctatcgaggccgatgggcgattcgaagccggaaagccctcccatcagggtctgcgaggcgtattccttcgacgctttgagcatatgcggccgtgtggtgcggaattgcgcgatatcagacatcatcgtcctccttgaaagtacttcctgtatttcatactacaaacgttttgcgcggcgtccgcccgctatggacttcatgtcgtgtgaggatcgtcacgcggattcccaagcgcgccgtcctgcccgaccatatgagaaggggacgaagccggtcggcctcgcccccttctcatatggtcgtcaccgtctgtcagtcggtgaccgaaccctggtggaaggtacgggagatcacgtcgagctgctgctccttggtgagcttgacgaagttcaccgcgtagccggagacgcgcacggtcaggtgcgggtacttctccgggtgctcgacggcgtcctcaagctgctccttgcgcaggacgttgatgttcgcgtggtacaggccgtggccgttgccggcgtccaggatgccgaccaggttgccgatgcgctcatcctcgtcgcggcccaggccgtcgggggtgatcgtgttggtcagcgagatgccgtccagcgcgtcgttgtagtcgatcttgccgaccgagaacatcgacggcagcatgccgtgcgagtccatgccgttctccgggttggcgcccggcgcgtacggcgtgcccttcttgtggcgggacgggaaggaaccggtgttcttgccgtactccacgttggaggtgatggtcaggatggactgcgtcgggacggcgccgcggtacacaggcaggcgcttgacctgacccatgacggtggagacgacccacttggcgatgtcgtcggcgcggtcgtcgtcgttgccgtagatcgggaagtcgccttcggtgcggtaaccgacgatcaggtcgtcatcggcgccctcgacgtactcgtactcgtggccttcaaggttcttcgcgtccttgttgtagatcgggtagaccttggcatacttgacggcggacagggagtcggcggcgatggacaggccggacatgccgcaaccgagggtgcggtacacctccttgtcgtgcagcgccatctcgatggactcgtaggcgtacttatcgtgcatgtagtggatgatgttcagagccttgacatacacttcagacagccagttcagggccttctcgtagttgttcttgaccttctcgtagtcgagcgtgccgtcggcctcgggagcgatgggctcgatgatgcccttgtcgatgacctgcatgccagtcatctcgtcacggccgccgttgatcgcgtacagcagggccttggcggagttcacgcgggccgcgaagaactgcatctgcttgccgacgcgcatcggggacacgcagcaggcgatggccgcgtcgtcgccccagtggttgcggatctccttgtcggactcgtactggatggccgaggtgtcgatcgagatcttggcgcagaagcgcttgtagccttccggcagcttcgggtcccagaagattgtgatgttcggctcggggccgggtccgaggtgctccagcgtcagcgtgttgagcaggcggaaggaggtcttggtcaccatcggacggccgtcgtcgccgaagccggcgtcggaccatgtcgcccagtacgggtcgccggagaagatcgcgtcgtagtccttggtgcgcaggaagcgcacgatgcgcagcttcatgacgatgttgtcgatgatctcctgggcgtcggtctcggtgatcttgccggactgcaggtcacgctcgaagtagcagtcgaagaacgcagagttgcggccgaaggacatggcggcgccgtcctggctcttgacggaggcgaggtagcccatgtaggtccactgcacggcctcctgcgcggtctgcgccgggcgggtcaggtccagaccgtactcgttgccgaggttgatgagctgcttgagggccttgatctgctcgtcgtgctcctcgcggaagcggatccagtgctcgatctccggctcggtgaagtcgttgcggtacggcacggaatccttgtcgcgctgcttgaacttgatcagcgcggcgacgccgtacagggccacgcggcggtagtcgccgatgatgcggccgcggccgtaggcgtccggcagaccggtgaggatcttgttgtggcgggcgatcttgatgtccttggtgtagacgccgaagacgccgtcgttgtgggtcttgcggtacttggtgaagatcttcttgatctccgggtccggctccttgccggcctccttgatggcctgctcgaccatgcgccagccgccgttcggcatcatcgcacgcttgcaggggacatcggtctgcaggccgacaacgacgttgtcgacctcgggggactcgatgtaaccggccgggaaggcgtcgatgccggccgggatgtgggtgtcgacatcgtagacgcgctgctttcgctcgaccgccaagtagttgtcgtcgaggtacttccacaggtgcttggtcttgtcggtcgcgtcggccaggaaggactcgtcaccggtgtacggggtgtaattcttctggatgaagtcgcgaacgtcgatgtccttctgccagtcgccttcgacgaagccgtcccaggccttggcctgaagctcttcggcagtaagagcggtcgcatcaactgctgtcatattcactccttgtgtcgtgcaacgcatcttcacgttgttgtcaagaaatgattctactagccggtcgatgtgagctggctgagagatggcgtgacttatctcacattcacgccgtgtcgtcagtcgtcgaagccgtcgtcgcggccacccgagggcgtgttctcgccccatttgcgccacttgcgattggcttccgcccacagcgcattgcgctccttgacgatcttccacgcctcaagggcatcctcgcgggtcttgtacggccccatgcggtgggagctcggcgagagcatgcccaactcgggctgctcgttcttcgtgttgaaataccactgcttgtcggtcatggcgtcctccccgcacccatggtagcgcgccgcggcgcccggcaccgcgcctatgcggcggccgggcgagcgctcccctactcacggaacgcgttggtgacgggcagacgccggtcgcggccgaacgcgagcgcggtgaccttcggcccgagcggatactggcggcgcttccactccgcgcggtccaccagtcgcatcaccgtgtcgacggtcttctcgtcgaagccgtcggccagcaggtcggcgcgaccgtgcgcatgctcgatgtatgcggcgagcaccttgtcgagcagttcatattcgggcagcgaatcggaatccttctgccccgggcgcagctcggcgctcggcgccttctcgatgctgctgaccggaatcatcacgccgccgggcagcggcgttccggcatcgccgttctcattgccgacgatgcgcagcccgccgatgccgacgcctgcggcagcggcccggttgcgccagcgggacagttcccagacacgggtcttgagcaggtccttgatcggcgcgtatccgccgacggcgtcgccgtagatggtcgaatagccgcacgccagctcggacttgttgcccgtggcgacggcgagcagaccgaggctgttggagtacgccatgacgatgacgccgcggatgcgggcctgcaggttctccgcggccacgccttcgagcttgagctggccctggtacacattgaacatgggctcgatcggctgcacgtcgtaatgtgcgccgatgttggccgccaggtcggcggcgtcgtccttggaaccgatggaggaatacatgctcggcatcgagatgccatgcacgttgtgtccgccgcaggcgtcggcggccatcgccgccaccagcgcggagtcgatgccgccggacaggcccaggcacacgccggagaaccggttcttcgccatgtagtccttcaggcccagcacgcaggcggtgtacacctcctcgtccgggtcgggaaggtccgcgatgtcgcccgtcgtctgatgctcggcgtccgtgtcgagatcgaagagtcccagatgctccatgaacatcggggaacgttccagcagcgtgccgtcgcggtcgacaacgaagctgccgccgtcgaacaccaggtcatcctgaccgccgacctggttcacgtagatcatcggggcgccgacctcggccgcacgcctgaccgcgaggtcgtaacgcgtatgggtcttgccctcctcgtacggcgagccgttcatcgtcatcagcacgtcgatatgctcgtcggcgagccgggcgaccggcccgccgtcctgccagatgtcctcgcagatcgccacgccgatgcgcacgccgtcgatgtcgagcacgacggtgcggtcgccggccgcgaagatgcggaactcgtcgaacacgccgtagttcggcaggaaatgcttgtcgtagccggcccagaccatgccgtcgtgcagcacgaccatgcggttgcgaggtttgtcggacgcgtggtcggtgccgaccgtgccgacggcgacatacaggtcgcccaatccgtcggcctccagctcggtcgccagccagttcgccttgtcccacgccgccttgcggaacgtgcggcgcaacgccagatcctcgatggggtatccggtcagcgtcatttccgggaagacgacgacgcgggcgccttcatgcgcggcgagatgcgcgtagtgcatgattttgtcggcgttgccgtcgaggtcgccgacgcaggtgtcgatctgggcaagggcaaaacgaagatgggtcatagtgccctatagtacccagccgagatgacggacgacaggggcggcacatgccgtcacgcgggatgatccgtcccaccgcccgtcagcgaagctcggcgagcacccgcagcgaggcgttgacgtagaagtcaacggcgggcccgatcgcgccgtccacgccgacgaagtgcggactgtgccagtcggcgcaccctggttccccgttcgagccgatgaacgcgaacaccaggcgggccccgcatcccgagaactccacgaaatcctcccccgccatgctgggatgtatcggcttgagcgccccataggagggcacgtcggccgcgaccgcctcggacagctcctcgtcgccgaccagcggcacctggatgcagtcccagtccacgtcggccgcgatcccgtacgcttcggccgtgtgctcgacctccgccacgaaacgccggtggaccagccgttcgtcgtcctggtcgaagaagcgcacggtgccttggaatcccgcttcggcgggcacgacgttccacacgtgcccaccatgcacttcggtgatggacagcaccacggcgtggaacggcgagatgttgcggctcacgatggtctgcagggcgaggatcatcgaggcgagcgcctcgatggggccggtgcccttctgcgggtacccggcatgggtgccctgggcgtgcagcgtgaccttgaacttcacgcagccggccatcatcggctgcgggccgatggcgatctgtccgggggcgtagttcgggttgttatgcgtgccgatgatggccttcacgtcatccgtcgcgccggattccacgaccgtgcgggcgcccaggcccacctcctcggccggctggaagacgatcttcacgctgcctgcgatgcggtcgcggtgatcggccagccagaacgccgcgcccaaaagcccggtcatgtgcaggtcatggccgcagccgtgcatcacgccggggttcagcgagctgaacggcaggccggtgtcctcggtgatcggcaggccgtcgatgtcggcgcgcagcgcgatgcgcggtcccggcacctctccctcgatgagcgcgacgacgccggtctccaacgtcgtgtcgagcacgtctatgccatgcccgcgcagcagacgggccagatacgcgctggtctcgacctccttgaagctgcgttcgggatgctgatgcagataatgccgtatgccgatcagctcgtccgtgaccccgacatgttcgaccatgatttacgttccttccccgcgagatgtcatgccatgttacctctgtcgcttcaatatacgcttggcgatggcgttcgcgatgccctgcacgatctggaccagcacgatcatgatgatcacggccgtccaggtcaccgtctggtcgaatttctgataaccgtccagtcggtctggtggccggcgatgtcgtatgcatgggaccagggactcatcgcgtctcctccttgtctgccgcggacggctgcggcgatggcgtcctcgtagcctatggtgtccgccgccgtgccgaagtcgatgacatcgctggaacgtgacagctcccccgagaaagtcgcgcaccagcgcatcgtcgcccgagaactcgtaggtgatcgagccgatggccgaaccggataccgtgtcgatgaaccgcttggtcaccgcctgctggggtgccgcgaacacgttgcacacatctccgcgctccacgacccggccggcgctcatcacggcgaccacgatgagggcgatgacgatgttgcgcacggtatggttgacgcgcaccggctcattgtcgggagagcccgcctgctatgttgctgctgtcatgttcgttcccactctgattggttgacaacgcccaccatacggcagcgacggcggcagtcgcggggcggggctgataacgcgttacggaatgccatccagcgctgttcatacactggggatgaccgaatttcgtatcgcggaggttgcgtacatggcatcggacgacatcatgacagcgggcgccggaggcgcgacggccaccgtgcgagccgacatcaaggcggcgttcttcgacatcgacggcacgctgacgagtttcgtgacgcatgtgatcccgcagtcctccatcgacgcgctgcacgagctgcaggatcgcggggtgaaggtgttcatctgctccggtcgggcgccgtcgcacatgaccgtcgtgctcaacatgatgccggtgcacttcgacggcatcatcgcgctgaacgggcagtactgcttcgacgaccacgggctcctggagaaggagtcgctgctgcccgaggacatcgtcaccatcacccgctggcttgacgagcaccccgacgtggtggcgaactactgcgaaaaggattacgtctacttcaaccagatcaccgacgcgatgcgggccacgtggcgccaactcggcaagaccgcaccgaccgtgaacatcgacgatccgcacgagagggcgctgaagtatgagacgttccagatcagcccgtacatcagctttgaagatgaagcgaagctgtccggcatgtgtcgcaatgtcagaggcgtgcgctggcatccggacttcaccgacctgattcccgccgacggcggcaaacccgagggaatgaagcggttcatgcggcattacggctggacgcgcgagcagaccatcgcgttcggagacggcggcaacgacgccgacatgctcgccttcgccggcatcggcgtggcgatgggcaatgcgaccgaaccggcgaaggccgcggccgactacatcaccgatgacgtcgaccacgacggcatcatgaacgcgctcaagcacttcaacgtcctatagctccctcccctcccgctggcgggaggtggcgcgcagcgccggagggtggtaacagacccggcacgtatacgaagagccctaacccgacgagggttcagggctcttccatgtgtatcggagcgtcggcttcgaattgccgccgcgcttacttcaccacttcgatggacatgatgccggcaggttcgagcggcgcgtcggaacggtcggtcggcacggcctcaagcttgtcgaccacggccttggattcgtcgtcggcgacctcgccgaagatcgtgtggtgtccgtcgagccacggggtcggcacggtggtgatgaagaactgggagccgttggtgccatgcgccttgccgtcgcggccgcgacgcaggccggcgttcgccatggccagcagatacggccggtcgaacgtgagttcggggacgatctcgtcgtcgaagtcgtagccagggccgccggtgccattgcccagcgggcagccgccctggatcatgaagtccttgatgatgcggtggaaggtcaggccgttgtagaacggctcatgggacggctggccggtgaacgggtccgtccattccttctcgccggtcgccagaccgaggaagttcttcacggtcacgggcgtctgatcgtcgaacaggttgatggtgatgtcaccttcggaggtgcgcatgatgatggtagtcatggttccaagtgtctcatgggcttgagaccgggggagagccgttctgccgtcatgcttcgaagacgcgacggactcaggtgtggatcccgggccaccggtggctccggatcggatcacgccggccatggcacctttggctgcacctgagattccgttttcaaaaggggcgtcggggttgaaggggctgacaaggtacctaggcgcgccggcacctaccaaagcacccggcttctcggcatcagtcgtcggtttcagctttttcatgaactcttcatcttggcaataataagtatcatcgataagatcttcgactgtcacgccaagagctttggcaataaggaacacttgcctcaaattaattttcgtttcccctttaagcatcaaggtgatggtaggccgcgagactcctaaggcgtgggccaagtctttctgaatcttgccggtcaatcgcatatagcggcgaatgttgtaacgtgccacgtcttcaaaacgttgcgcctctattttcacctgctctgaagtttctgtgacttccatgggttaatcctttccaaatgaagataattatatcaaacaatgtttaatattgctaacctatttggcgtgtttgcatttgtggggcgaaaaaatatccacatggatgaactcatgccgccgaatgcttttcttcctgctgcccaaaaaacgttgcatcgcttgggggagattgtcgatatagggatatatggcattgatcgatcctgttggagatgtggtcggacctctgtggcaattactaatctttgtcccctcgactgcgaaagtggtatttccttggtggagtcttgggaaagcatagatatgtgctatgccagggaacttttggaaattgctgggcatcccgccgcgaggcaaattaaatatcggtcttcgcgtagggcggggcgttatatgtcaaatggttgcgcatattgtgatgcgttattcggaaacttctgtatagatgaggatattctggatggacaaagacccagtctgattgcttctgtgaaaagacctttgcaggaatgggccgtcatggtaactcaattccatctttgatttgaaagtttcctctccgctagtgctgaaaccgcattgttgagatgcggtttttttaatttcgacacgccgtaagttaagctaacttgaggttaaaaaaaccaacccatatactgaggttagaaattttaacttagctgaaatgaggttaacgatgtcgaacatgaagaggtggatggctgaggtgggtttgacccatcgtcagcttgccgtccagcttcatcagtcgccagccagcgtgactcagaaagtcaattcgcacacgcattggcagcgcagagactgtgccgaacttcgcgagcagtatggtctgtcgtctgatttcgttcaagatctcattccgtatgaaaccgcatttcccaatggcgcgcaggaggttcgatgatggctggtggaatttacgaacagcttgattggccggataaccggagcgattatgtcgaggtgtgcgacggatgccacaccgcgatctggtcgacccgctggaacgaggagacatcggacggcttcgacgctttcctcgccaggaacggctggcatgactacatcgaccagctcgatccccggactctgaacctttgcccggaatgcgcgctgcgcgcgctgcagcggggtgagatccggacgcttgccgattggcggatccgccccgtgcgctccaacacgcacgccgaccgggaggtctacgcccagctgtccgcccgcgaacgtgtggtggcgggcctgctgttgaccgaggggagggcgtcatgagcaacgaagtgtcatgcgacagtgtggcccgccgcgtcaacggcgaaaacccactggatgtccttgtcagcgtttccacgccgtatggcccgttgctcaccgacgattatggtcggtccatacgttttgccgagtacggagacggaccatgccgcttcggggatcgtcccatccaggtcatgaagccatatgagtggctcgccgaccgtgtctacgtatttgatgacgaggccgtcgcaccgttcaaagacgatgtggcccgcttcgtggttgaggcctgccgctgcttcgttggtggtgacggagaccatgatcgcagcgtggtgctgtgccgcgaaggagtcgcagaacagcttgatctttcgtccgacgccttcgcaccgatggtcgggtctgacggcaatgccgtcagtttcagctatcagccgtgcgaccgccttcgctgcgtctgctcgaccaatccccaaaaaggccttggtgtgttccatgtatggactgagcgaggcaccacctaccaagcggttctgggaccatgcgcctatgagcgtcggcctgagaaagccttgaccctgccagacgaactctggtccaggaatgaatcctggatgcgcgatttcttcgagcaggagacttccgatttcctctgcctcggcgtggtttcgcgccggacgaatatcaggttcgttgagggaggtggtgcgaggggttgatttcatttggttttctctttctctgaatcgataaaggaggtgttggtctgatggcgattgacggtgtaggggtactggccatggattccggtgccggtggcatgagcgacgaagccggaagacttgttttctcccgcgacccgtcgggaacattcatcgacggtatggtcttcggaacttcaggaggcggtgagaacgccaatcttgaagtgctgtgtgcgttgccctacgagcttgtacgcccacatgctagtgcctctgtcctgggtccgctggtcggcgtagggaatgtgaagaggctgtccctgagcgtcaaataccttgatggtgagatatccgtcgggcggtacgaccgtgtatccggctttctcgttgagcaggcgcgcgccctcgttggtggggatgctgagtatcagttcagcgccgtggtctgccgcccaggagtcgcagaacgccttgatctgcgatccgaagccttcgcgccgatgcttcctgacgatcgagatcccttcgatgatggctgcatgctcggcgaaagcctctcgtatctgtgcggcatggaccccgctcgtcccggtgcggtatatgagcgtctcggctacgcaaagggctggctggatgagggccgcgcctatcagacggtcctgtccccatacgcctatgtacgtaggcctgatcgttccatcgtcgtgtctgacgactgctgggacgctttgatcgaagtctttgatgtccctgatgagcaggctcttgattgcctttgcctcgccatccgttgcggcggcgcgtggcccgtcgacggcgagggaggtggtgcgatggtctgatcccattcgtttttctctctttctctgcagctaaaagaaaaaacgcccgttcccgatgctggaacgtcggggacgggcggtgcaaccaatattccgagcggccgcggatcccgtatcttgccggatcccggtccgtggccgcccaatgcattgtcttggagtagtgatcacacatgaacgaccttactaaagccttccgcatgtcttgctctgtgtttcccgagtgtaaccgggattttcacgcgtcggtttggacgttcccggtcgtggtggcattcgcccgccacaacggtccgggctccgtcgattcccgtcgcctggcgtcgatgatggcgcacccgtccatggaagggagactcgcgtgaactggctcgcaatcgcattgatcgtgttcgtcgcgttctcatggctgatgacgctggccctgtgccggacggcacgtctcggcgacgagatgcacgccagattggccgacgagcgacgcgccgcccaacaacgtgaggaggggcgaccgtgagcaacatcgcactgtcatgggccttcaaatgccacgtgggcaacgcctcggcgaaggccgtgctcgtctacctcgcggaccgcgcggacgacgacggcaccacagcctatccaaagatcgcgaccatcgtcaacgtcaccgaactctcggaacggaccgtgcgcaccgcgttgaagactctccaggagcgcggattcatccgccgcggcgaccaacggtacgcgcgcctcggcaaaggcggacggaaccgcctgccccagtactgccagatcgtgtgggacctcgcggtggagaccgacccgtcgaccctcaagtggatcggggagacgcacaccgcggaacgggatcccgcgaccatgggcaagaccgtggacccggaggccggaaccgtgttcgagaacggcgaatccgaggacgtgctgccggaaaacgttggaaccaagccgattcccagcactgcaaatctcgcagggctggaaaaagggccggaaccggcactgcaaatcccgcagggccagcactgcgagagctgcacccccagcactgcaaatctcgcagagctgtatatataaggataaaaccctccaggtaaaccctcctagtaaaccctccttcccctctgcccctacggggcatctccccgcaagcggggcgaccgccgccgaaaaagaacaactcgacgaggacgacaccgagatcgccgaagcggccggacgggtcctcgcctcgctcggcgagcagcgctcgatgctcggcctggccacgccctcaccgaccaaagccgaccgcagggccatcatcggcctgtaccgcaggctcgtcgaccagggagcgcaatggcccaccctcgtgatggtcgacgcgatcagcttcgccatgaacggcgattggtggcccaaacgcatccgcaccggccgggccctcgccagacactgggacgaactcaacgacgacatgatcctcgccgccggccgcacagacggcgacgcacacgcgcagacggttccggcggccgcgcaggaaccggatgctgcgccatggctgcccgactgggccgtggagacgctggccgagttggacggccaggacgcgacggccggaggggaggcgacggcatgaccacgcgcatcgactgttccgaggcgggcttcagcgaattcctcctcgccaacccgcagctcgacgggcacgcggacctgatctggcagctgcacgccgtctactggcgcaacaagcgcctcggccatcccaaggccgtcggcctgctgatccaatacgcccgggcatgggccgcccgcaatcccggcgaaaccgccataggacgcctccaggcccacaagacgccgacgacgcaaggacggcggccatgaacgggcgggacatgatgccggcctgcgcgagaatcgccgcggtcgacccggccatggcggatcgcatgtggaacacgacgaccgacgacgatggccgggacctgatcgacgaacggatgcgcggcaagggccgcgtgctgtgtgccgcgtgccccatgcgcctcgactgcatcagccgcgctctcgtcaacggctggaaggacaaggccgtgtacggcgggctcgactatgcgagccgctggaccctcgcccgactgatcgcccgtgacctccacatcgccgacggcggcctgcaccggatcccacagagtcgggtccgtgactggctggccgaacatccggactgggccgaacgcatgcgccgtgatggccgcgactactggcgacggaccaaacgccgccaacgctcgcgccgcgaatacacgcacgacgatccgctgttcctcccgaccgaacccgtgccgaagggcctggtccagggcagcctcttctgaccgcttcccgtcgcgatccgcgtgggacgcggcacaaaccgcaataccgaaaaaccaactaaccgaaatgccgaaaaaccggataccgacataccgagataaggagaaaccgatgaacgacaagaagaaccgcgagccgatggtgatcgcgttggcgacgggcaagggcggcagcatgaagaccaccagcgccgtgttcctggcctgcgccctcgtggaccagtcccggggcgagcagcgcgcgctcgtcgccgacgcggacgtgcagggcgacgcgaaggactggtggtacagggccgccgagctggacgacccgctgccgttcgacgtgatgtccgccgcgccggccgacatcgcgcacctgcacgggatcaacggccgtctcgacgaccccgtcgactgggtgctgatcgactccgccccgtacgggcgcgcgttggacgaatcggtgaacaacgccgacctcgtggtcatcccgtcgagccccagccgcatcgacctcgatcaggccgccggggtgaaggacctgtgcgaccggcgcggcgtccccgccgcgatcctcctgtgccgcaccgaggccaacacgaccgccctgcgcgacgccctggcatggatcgacgacgcgggcatcgcgtgcttcgagacgctgatcccgaaacggcaggacatcctcaacgcgaaatccacccgcccccgcgggtcccgcctgcacgagtaccgcgacctggccgccgaactcaagcagaccatgcgacagctcaaggacgaggaggaggacctgtgaggaacatgaacctgacgccccgcccgcgcgacctgaccgcgctgctcgacagcgaccggacggaaccggcggataccggaagaccggaatcggtggataccgagataccgaaaaaccggagggccgtgaaaccgaacgacgcggggggctgggtgaagaaccgcaaacaccttggactggccgtctaaccgtccaaaaaaacatccgcaccccctagtgcccgaaaggttgcgcactttggatcatgcccgtccatggcgcgatgaccggttcgcttcctgcaggttgtcatcgagccgggacatgtcgaggtaacgccggttggaccattcgttcgcggtgacgtacctgatgcgcgcgcagacgagcatcagcgcgctgttcccgtccgggaagcctcccacgacgcgcgtgcgccgcctgatctcgcggttgggccggttcgatcatgtcgttcgtgcggatgcgcctgcggtgcccgtccgggagctccggcagcaggtaggtcgtggtctcgtcgatcccctcccgcaggcggttcgcggcggccttcagcctcctggactccatctccgcggcgacggtcccggccttgtccaacgcggattcccgggactccatggcgaataccgctttcagggccgcgcacgcccattcgcggtgggtcggcggcatcttggagagcgcgtcgcgcatgaaatgcaccatgcaccgcaggtatctcgcttttggaggcatggagttgacggtggaggccagtcccgcgcaccggtcgccggccacgagccgcacgcccttcaggccgcgttcgaccatgccgcgaaaggactgctcccggctggcggaatcctccctcatgccctcggcgacgccgatgacctcgcggtgatcatccttgctgacgccgatggcggccaggatgctgacgttctccgcgcttccgccccaggagcgcttgtgccacacgccgtccacgaacacgtatgggtactcgtcatccaacggcctcgtgcgccattcgtcgatctcggcgtacacgcgcttgagcttgtcgctcaatgtccgggacggcatgcggtcgccccacggcaactggccggtgtcgtcggcctgcctggtgggcacgccggccgggtacatgccgatcagcgcctcccctacgctttccccgcgtctgcggcagcgtccgatcaccgcggactcgaacagggcgcccttcaatttcggcaccttgagctcgagcctgccggccttggcggccaggctccgctcgtagtggccggcccggtacgcctgccgaccgccggaacgctcgtatctcgcggcgttggcgatctcgtccgcctgaagcgtcgggcatcgcgttgacgatccgctcgaccttctcgcgcaccatggcgtcgagcttgctctcgaacatggcccggtcgaactgtatgatttccttggacatggccccgtgcctctttccaatcgcggtttttcattgtccggcgactgaaaatcgcacccggcacggcccatgtccctttccatcaagaccggaatccgaaaatgcgcaagaactcggacgttatcggagcttttccggataattgcaattatccttattgtttctcatcatttagttgttcattgtccctttgatttgtgtgcagaacctttttgtctgaaacgtctctttttccagttcctctacagggcgtcaggaaagattggaatcgctttattccttcttatcaccgtttggttccttgggtagtgcgcaacctttcgggcactacctgcgaaagagtttgtatagggttgctgtggatcggttgtggacgaagctcttcgatagagtatggccgaaaaacttctagtgacggatattgtgaacgtctttgctgttctttagctgaaggcagtgttccttcgttcagaattcgaaatctggctaatgaagtgttcagcgtgcttttgactaagagagaaagtactattacacatgtgactgaagaactttttactcctaagaacatcatcgtgaccggtggctgtggcttcatcggatcgaatttcgtgcattacgtggtcgaccagcacccggacgtgcatgtgaccgtgttggacgctttgacctacgcgggcaacatcgcgaacatcgcgggcctgccggaggaccgcgtcgagttcgtgcacggcaacatctgcgacgcggagctgctcgacaggatcgtgccgggccacgacgcgatcgtgcattatgcggccgagtcgcacaacgacaacagcatcgcgaaccccgagccgttcctcaagacgaacgtggagggcacgttccgcctgctcgaggccgtgcgcaaatacggcatccgctaccaccacgtgagcacggacgaggtgtacggcgacctcgccctggacgatccggccaagttcacggagtccaccccgtaccatccgtccagcccgtactcgagcacgaaggccgcgtccgacatgctggtgcgcgcgtggacccgcacctacggtttgaggaccacgatctccaactgctccaacaactacggcccgtaccagcacgtggagaagttcatcccgcgccagatcaccaacatcctcgagggcatccgcccgaagctgtacggcaagggcgagaacgtgcgcgactggatccacaccgaggaccactccagcggcgtgtggaccatcctgacccggggtcgtatcggcgagacctacctgatcggcgccaacggcgagaagaacaacatcaccgtgctgcgcatgatcctgaagatgatgggacagccggaagacgcgttcgactgggtcaaggaccgtccgggccacgaccgccgttacgccatcgactccaccaaactgcagaccgagctcggctggaagcccacgcacaccgacttcgaatccggactgaaggccaccatcgagtggtacactgagaaccgcgcctggtgggagcccgcgaaggccgccaccgaggccaggtacaagcagcagggccagtaagccgggccgcccttttctgcagaataggaaatcccagaataggaaatgggcttctgcggaataggaaccgttgcaaaaagagcttttccttattccgcagatcattgcccgagcagaataacaacatcaaggaatgggactcatggattttgagaaggaactgaaggtcgagaggacgaacatcccgggtctgatcgtgttcgacctgccagtgcatggcgacaaccgcggctggttcaaggagaactggcagagggcgaagcagacgaatctgggcctgcctgatttcgggccggtgcagaacaacatcagctacaacgcgaagaagggcgtgacgcgtggcattcacgcggagccgtgggacaagtacatctcgatcgcctcaggcagcgtgttcggcgcgtgggtggatttgcgccccggcgactcgttcggccaggtgtacacgaccatactggatccgtcgaaggcgatctacgtgcctcgtggcgtgggcaacagcttccaggcgttggaggacgacaccgtgtacacgtacctcgtgaacgcgcactggagcctggaacagaagaagacatacacgttcgtgaacctcgccgacccggacctgcacatccagtggccgatcccgttggaggactcggaacgctccgaggcggatctgcaccatcccatgctgaaggacgcgaagccgatggcgccgcgccgcacgatggtgacgggctgcaacgggcagttgggccgcgcgatccgctcctacgtggacgcgcatggtttggagggtttcgagttcaacgacatcgacacgttcgacttctccgacccggcccagtacgaccggttcgactggtcgctgtacggcacggtcatcaacgcgggcgcgtacaccgcggtcgacaaggccgagacggcggaagggcgcgcgctggcctggaaggccaacgctcagggcccggccctgctggcgcgtgtgtgcgcggagcacaacatcaccttggtgcacgtgtcgagcgactatgtgttcgacggatcgcgcgaactgcacgacgaggcggaggcgttcgcgccgctcggcgtgtacggccagtcgaaggccgcgggcgacatcgcggtcacgaactgcccgcgccattacatcctgcgttcgagctgggtgatcggcgagggccataacttcgtcaagactatgatgatgctgtcgaaccgcgtcgcggaccccggggacacgctggacggggtcaccgtggtggacgaccagtacgggcgcctcacgttcaccaaggacatggcggacgcgatcttccacctgttggattccaaggccgggtacggcacgtacaatctgaccggttccggcagcgtggaaagctgggccgatatcgccaaggcggtgttcgaccagaccaacggtaacggtgacagggtgcgcccgatcccgaccgaagagtacttcgccaacgcgaaggatccggtcagcccgcgtccgacccattccgccctgaatctcgggaagatcgaagggacgggataccacgcgccggactgggaagaatcgctgaaggcatacatcgccaaggaactggccgagtgattcaaggggaagacgcttcctgataatgcgatgaaaccgcgcagactcctttgcgcggtttttcaatattggattgacctactaggctggaagcgcttattaccaaagacacgtcagaaagcaggacgattatgaagggcatcatccttgccggtggttccggtacccgcctgtatccgttgaccacggtcacgtcgaagcagctgctcccggtgtacgacaagccgatgatctactatcccctgagcgtcctgatgatagcgggcatccgcgacatcctgattatcagcactccgcatgatctgccgaatttcgagcgtctgctgggtgacgggagtcagtatggcgtgactttctcgtacaaggtccagccgaacccggacgggcttgcgcaggcgttcctgctgggcgaggagttcatcgacggcgagccgtgcgcgctggtattgggcgacaacatcttctacggcaacggtctgggacgtaccttacgcaaggctgtcgctgtagagcatggtgccacagtgttcggctattacgtggacgatccggagcgatatggtgtggtcgagttcgatgagaacaagaaggccatttctatcgtggagaagccggaacgccctgcatccaactatgcggtgaccggtctctacttctacgacgagcgtgtggttgaattcgccaagcagattaagccgagttcgcgcggcgagttggaaatcaccgatctcaacaggatgtatctcgaagacggctctttgaacgtgcaaacgttaggtcgtggctatgcatggctggacacgggcacgatggacagcctgtttgaggctggcgagtttgtgcgcacagtccagagggcgcaaggtttgccgattgcagtggccgaagaaattgcgttcgagaatggttggatcactcgtgagcagttgatggcggccgctgagaagtacggcaagagtccgtatggtaagcatcttaaggatgtcgctgaagacaaaatcattctcagatcaaagaaaggttagagactgtgagccttacatttaggaagatttcggtaagttgacgattggcatctgagttcaattgcgatttggaggaagtatgaacttgtttagcaaacgtaaccgtgtgcttcttcgcgagctcactgttacagattttaaattacgctatcagcagtctgctttaggatatttatggtctattctgaagcccctgatgctatttgcggttatgtatatagtgtttgcgaagtttctggcgatgggaggggatatccctaactacgctgtgtatcttttagctggtatttctttttggaccttctttgcggaggctacaacacagggcttgcaggcaattgtctcgcgtggagatttgattagaaaaatcaattttcctaaatacatcattgttctgtcaggaacaatctctgcgttaattaatcttttctttaacttggttgtagtctttgtttttgccttgttaacaggggttaagtttcgctggacagtgttttttttgccattgaacattcttgagatgtatctattggcattgggcataggcctctttttaggatctctcttcgtaaagtatcgtgatgttggatatctttgggaagtgactttgcagttgtttttctatgcaaccccgattatttatccaataacaatggtgagtgccacgcatccttttatggcaaaattaatgatgttgagtccgacggctcagataattcaagacatccggtataacctagtcacagattacacacagacgctttggtcgatgtggaacaatccgcttattggcctggttccactgtcgctggttgtgatagtactggcaatcggttcttggtactttaacaagagttctaagcaattcgctgaggtgatgtaagtgatagcgatgaatgacaatattgcgattgaagtcaaagatgtttccaaaagcttcaagttgccgcttgagagagcctctagtctaaaacaagcgatctttaatgctgtaagtgggaaaaaggggtacgaagaacatcaggttctacgtgatatttcctttaaaatcaacaaaggagattttatcggaatcgtaggacgtaatggcagcgggaagagcacgttgctgaagttgatggcacagatatactatcctgattctggaagtatcgacattaatggtgttttggtgccatttattgaattgggtgttggttttagtcctgaactaaccggacatgataacgtttatctcaatggggctctgatgggcttttcaaccaaagagattgacgcaatgtatgacgatatcgttgatttcgccgaacttggtcagttcatggaacagaagatcaagaattactccagcggcatgcttgtccgtttggcgttctctatggctattcgtgctcagtccgatatcctcctgctagatgaaattttggcagttggagatgaggcttttcagcgtaaatgttatgcatatttcgctaaattgcgtcgtgaaaaaaagacggttgtgctcgtaacccactccatggattcggtgcaacgtttttgtaatcgcgctattttgattcatgatggtgatcttaaaattgatggcactcccttggaagtcgcacaagcttatcaagagttgaatagtcaacgtcttgatctcgctaaccttgaatctcaattttctggtggtgacactgaggcgtcgatttcggagcaagaagaggaagctcgtcagcgaaaggagaatgttgatttcagaatatcccatgagattactgatagtgagcttatcttcaatctagatattcttcctaagagaagtttagaagatgcggttttaacttttgttattaatagcgaggtcggagagattgtttttcgtgtcgccagcgatgataagaacgttaatcagaaaatcgcgttttccgagggggaaaatatacatctgcgcctttctgtggataacatttttcctaatggtattttttcagtgcaagtagcagtgaagaagaaagatagaagcgaaaactatctaatggcaaataatgcattgttgtttgaggttcatgctcctgtcgacgtgagtcagaattggaagcctgacttcgattttgtcctgtcttcaatggagggataatatgaaatacggcctttttaaatatgagaccgagaacatcggggatgaaatccagagcattgcggcaaggcgttttttgccatctgtagatgcttatatagaccgagacagactaggtgagtactgtcctgatgaggagacaaaaataatcaccaacggctggtttatgcatgcgccatatcagtggcctccaaagtccggtaaagtgattccccttactgtatcaatgtatatcgatcaggctgattctaaggttcttgatactttttttagtgatacgagtattaagtatcttaatgatcacggtcctgtaggggcaagagatctttcaacgttggagcttttacagaaacatggggttgagtcttatttttctggttgcatgactttgactctgcagagggatccaagtattcctaaaggtgattttgtcttagctgtggatgttcctcagtctgttgtggagatggttcagagtcataccggtcgctcggtcatacacgcatcgccgtattttgatgcaaatatgagccaagatgatcgttttcagttggctgagtatttcttgtatttgtatcagtcggccgctgctgttatttctacgagattgcacgccatgcttccggcgcttgcacttgagacgccagtctttttagtcaaggatcgaagtaaatacgacgaaaaaaggtatgcaggattagctgagctggtgaacagtgcgaccgatgaagaatatcttaatgattattcactttttgatgttgacgcaccgaaaaaaaatcctgagtcttatctgaaaatacgcgaacggttaattgaaaaagctgctaatttcacgggttttgatagtgatagctcttttcgaacggttgatttttctcacattgcagataatgaatcgtatataaggctttttacgagaggttttcattccctgaatcgcgaacttctcttggaaggcgataagaaatggctccaggagcaatgtgatgatctgcgcagaattcggcagcatcttgatgaggagcttcaggacgctcaaaaaaaacagaatgatctttcccttcagaatgatattttgcgtaaacgtatcgaagtaatggaaaaccgtatcgaagtaatggaaaaatctagttcttggaggataggtaggacaattactgctcctggacgtaagctaaaaaatatgattagggggaactagaagtgaaatatatcagcgtttttttccaataccttcgacacaacggaatcaaggtcacttttgagcggtgcctttcttttatgaaacgtaagctgaggcgttctcatgcagcgcaaagcgttattccgaagcgccctattgatgttatgacatctgtggaggatgtcgtcaaagctgactttgtcactgagccgtatattgcgcctaagaaaattaataaaacgaagttgaatattggatgggttctttcgcccatcagtattggtagtggtggtcagcatacaatcgctcgttttgcgaaatcgttgcaagagcgtggacataatatcacttttttcatctatgagagcatttcgcggcagccagctgattattctcaccagttgttgaaagaacattttgacattgatgttccctgtctacctatgagtcaggccgaaaaagaagacatcgatgtactgttcgcgacgggatgggaaaccgcttatcctgttttcaacatgaagaatccggcccataaaatgtatttcgtccaggattttgagccgctcttttacggaatgggctctaaagcggtgttggctgagaacacttatcgtttcggtttttacggtattacagctggatgttggctgacgaaaaaggtcggagaatacggcatgaaagctgatttcttcgactttggcgcagacctagatatctatcgtcctactgagaaaactccaaagaagaagcagatttgcttctatgcaagacctgtaactgagaggcgagcctttgaaatcggcgtcttgactttgacgaagttccatcaaatgcaccctgactacaatatcgttttctttggttgggatgtgtctgactatgacattccattcccctacgaaaatcgaggaatcatcagtcctgcggaactttcttcaatttaccatgactctcaagcatgtttggtgctttccctaacgaatgcatcgcttctccctcttgagttgcttgccgcaggatgtgttcctgtgatgaacgatggggagaacaatcgcttagtaatcggagagaactcagacattgtctacacgttggactcgccaatcgaattggccaaaggattggatgaagttgtctctgatcctgacattgaagcaagatgccagcgtatctccaagagtgcggagagctcatcttgggatgcgtcatatgagaagtttgcgaaaattatcatgcgagaggtgactactgtcaaccatgagtgagattaaagccactgttttcatccctacctattatggtgaagacaatcttgatgagctttttgaaagcttgttgaaacagaagacagattttgagtatgagattctagttatcgatacgagctcaaaagatcgtactcccgaaattattaaagcttggttgcctaagtttaagcattttcggtatgaaaccattgcaaagcctgatttctcacacggaagggtacgtcaacaggcagctcaaatggcccagggtgagtatgttgtgtatctgacacaggatgcaacacccgctcatgatcgatggctgtatgagattattcaaccgatggagcgattccctatagttgccggtgtcatgggtaagcaggatcctcgtcccaatgctcttcccctgctcaaagaagaaataatacgaacctttaagcagtttggtccagacttcggaacaacggttttctatgaggatgactttattgactctcaacaagtttttgatctagttacgttctactcagacgttaattcagcggcacgtaagtctgtgctccttggagacgttccgtatcaggatgtgccatatgcggaggatcagaagtttggcgaggatcttgtcaaacacggttatgtcaaagcctatgcgccaagagccaatgtatggcataccaatgagattaaattacgtgattacaagaaacgtatgtttgatgagattgtcggtgtgcggcgtgttggcaaaacaatggatccaatttccatggcattcgttattaagcagatgattcgtgcctatacattaggctcaaagttcatcctgcaggatcatcaatattcgtggaagcgcaaattgtattggctggtggtcaatccactttttgtcgcagagaagtggaaaggcgttcgagcggctattgctgttgatctaaacgaccaggcgacaatagatgcgaattctttggaaaagcaacaagagaaatagtgaatgcgcggcattaagttgtcgcgcattcactatttcatattcttgattttcatatcgtatattcttttttctatcagtcttatccatttaagagaattgcagattactctatctttgaatgaaagagacttgactaaattcgcgacttgcaatttgtcaattctgaactgttgcttttcggtggaattcttcgcagttcttccttcatctttgagattacccgtaagagtgtagtagcttcgcgctggaataataccattttcttggcaaagaacaaagttttttttagctgcaacgatgtgatcatgatagaacgaggcgctacgcatcttgtgcgtaacagagtcgggtctttgtagccagtaatacagggttgcgtcgacgtcaactaccgttttcatccgcagatatagctctcctgctattgcagtgtcctgagcgtaaataccttcggggaaccgaactccatcccatacctttcgtttgtataaacggcaccaattcgcctcattaaaataacgagcttcagtgtttttgccagtcatctttcctagaacgcgaaatagcttgctgaaaacagtttgatatgactgtagaggattgctaaaagatgttgttttgcctgtaagggctgtatcatttgacgctttcgctttgatttcttgaatctgcgaaataccaaactgttgccaacgggctttgctcatgtcagcatgattggagactagcgcatgaaataatatttcgatattgtctcgtgccattatgtcatcattatcaataaaagcgatatagtcacctttcgccaaatccagtccagcattctgagctttggcaatgcctccattttcttggtgccttacaataattctgttgtcgttagaagcatataaatcacaaatttgcggcgaagaatcagtggaaccatcgtcgataagaataatctggagattgctccaagactggtttttgactgagtcgagacaaaatggcaaatagtgttccgcgttataaacggggataatgattgaaacgagtggcgtcctgtccattgtttccttctatcgtattgtcttcggactcaaagctttcttcagtctacactcatgaagtcgctttcttttagatagttttttccagaggtctgatcgtactgtacaagcttgtagtctgctagcagttgcttttgcgttttgttcatgctgtcagaatcagccactgtgccgtcggattgaagataagttgctgttccgagcccgattccgcccctattcgagatgacacggttaatcgcaggtatttcttcgtggagtttagttagcaaagctaggtagggcgaaactttttcattcatatgctcagctgcggatgacatgaaataattcgatgaagagaacgctgcttcaaaatcgtcaagcttggcatttgcagatggggacgcatcgtttgaccaaatgaaataatcggcttcatgaagcaggactgaatcgtctggatcttgatcttcttttaaataaatgccagaaagatgatctccatagaaaatgactgtaatgggcttgttgatctggttttaactggctgaggaagttaagagtcacttgatctgtgtatttcaggcccgtagaaaaaaagttaatcgcactatgctcatcatcaggtgtgatatgaactgatttttgttccgcttttcctctaactcgatgggagatgatggaaccatggcaaaaggcacgagacgcgcgcccggttgtcggcgctgggccgggatccggccgggatcggccgcggccgggtgacgagcgtcgtgcgggaatcgggagtcaggggcgtgcgccgcggcgggacgtccgtcaccgccagaccggcgaaggggcgcgggcggcgggcccggcctcgtgggacgcgggttcgagtgtttatgttcaatggttttaagaccggttgagcgtttggtttttagtccgaaagagcggtaggaattagtccatttcatcgttgatggaaaacaagtgacaccggtctgtcgttatcgattagtttcccgagttgaaaaaaacaaccattgacggttctcgggaaaggaaaggaatgaccataccggtgtcggttcaacaacgtatcaggctccttgaccagcagggaacgccatggcgagccatcgcccgtgatttgaacgtgtccagggacacggtcaggaaatacgccttgatggaggattgctcgcccaaacccaaaccatcgaccacgcggccgaggaaactcgacgggttcacgcccgtgatcgacgagtggttgcaagcggaccggttcatgccccgcaagcagcgccataccgccaaacgcgtgtacgacagactcgtcacggagaaagggttcaccggctcgtattccgcggtgcagcgttacgtgaagcaatggcgtcaagaacatcgtcccgcctgtgacgggttcatggagctggaatggcggcccggggtcatgcaggtcgatttcggcgaggccgtggtggtgctggcgggcgtgaaaaccaaggtgcattgcctggtggcgtcgtttccgtattcgaacaagcgttacgtggtcgcgttgcctggcgagaacgcgcaatgcgtgtgcgagggattggtcgagatcttcgagcatatcggcctggttccgatggtgttggtgatggataacgccacaggggccgcgcaccggaccgcttgggacaagatcacgatcgtcgggctcttccagttgttcctggagcattaccggatcgaggccaggttctgcaatcccaggagcggttgggagaaaggcagcgtggagaacgcggtcgggttcctgcgccgcaacctcatggtcccgttgttgaacgtcgagtcctatgcgcagttaagcaagcatctgctgtcgcggtgtgacgaactcggcaacgacaagcattaccgggctgatgaaagcgtgaacgacttgttcgaagaggaccgggcgggcatgcggccattgccgcgcgtgcgcttcgacgcggtcgattggcaggaacggcgcgccgacaaggaaggtgtcatacaggtcggttcgtatcgttacctcgcgggcccggcctggcgtagctggccgctattggtgggattgcgcgcgttcgacgtggagatccgtacccgcgacggccgcaaggtggcctcgctgcccagggcttatggcgagcaggccggtacggtgcgtagcccgtcgtcgctgctgccggcattggcgcgcaagccacgcgcgtggggcgaatcacccgtgcgcggtgattttcccgagggcctgagaaccctgatcgacgcgcaggactccgcccggcgcaaggccacgttccgcttgttggagcgcgtgggtgccgcttgcggtttcgacgcggcctgcaaagccgcggaacacatcatcggccagggcagaccgatcgacgaggcagccctgagcatcatggccagacggatagcgtccggcgaggcgccggccgatgttcccgcgcccgacctgagcgtgtacgacgacttcatgaaaacaggcgatggcgatacgctcaaggagcgggaaggagggaaggaccgatgagccggatccagaaccccgcgccggacgccacccgacgccgcgcgtccacgaacaggaaaatggaaacgatcatgcgattggcgcgccgactgccgttgaccaggcaagtgctcgccgaccagctcgaaaccgcgaccccgtcgcaaatggagttcatggaccaatggatgaacgcggagatcgagtccagggaacgatcgaaacgatcccggctgctcaagcaggccggtttcccggccgtcaagacattggacggctatgactgggagaacattcgttttccggtggattggggcaggcggtcgcttgaatcattggagttcgcgagccgtccggaggatgtggtcatgttcggacctcccggcacgggcaaaacccatctggcgatggcgttgggaaggaagacctgcctggaaggcatgacggtacggttcttcaccgccgctggcctggtcatgcgcttgttgcacgccagcacggaaggcaaactcgacagggaaatcgcgtccatcggcaaggcccgcctgttgatcatcgacgagttgggctacgtgccgatcgacgaggaaggcagccggttgttgttccaggtcatcaccaacgcgtacgagatgcaatccatcgtttacaccacgaacatcgagttcagcgggtggggccgggtgttcggggatccgaacatggccgcggcgatcatcgaccggaccgtgcatcacggcaggatgctcaggttcgagggcgagtcctatcgcaggactcatgctcttatgcaatgaaacaataaaacacgagcaatgacaggccagttccgaactggactaaaacctaccgctttttcggaaggaaaactcacgccacactggcctataacaacttgacaaaacacattcgaggcgggggcgcccggaccggccgcacgtggccggcatcgcctgcgtgcgcatggccaacggctcgttcggctgcacggcgttcgccgccgacgtgctcgcccgcgggatcgccggccgggcgtgcgccgccgccatggacaccagggggggggctggtgccgcgggcgccggaacaggcggtatcatgggccgcctcgcatggcggcatggacggtctcacgcaccgttccggccatggcacgtggcgcatcggcctcgtgtacgccaccggggtcggggaatgcggcatgcctccccccggccggcacggccggcgacggcgggttctagtgatcgttgcaacacctgacctaccgcaaggaggatcaggtgatgaaaagccatcatcatgacggggaccgcgacgcacgccgttgggcgttcaacggcgtcgaatacccgacgaggaacgagatgtgcgaggcgagacgcgccgagtacgtgcgcctgctggatgaggagggcatgaacttcacccaggccgcgcacgcggtcggcgtctcgaaacgcgccggcaaggcgtggcgcaacggcaggacgcgcgccacgggaaggaacgagaaacccctggtggactggtatcgttccaccatggacaaaccaaagaggatccatgcgcgctatctgagccaggacgagaggatcgccatcgcggaccgtctgcgtctgggcgattcgatccgcgccatcgcccggctgctgggccgcgaccccggcacggtcagccgcgaggtcgagcgcaacaggaatcccgagtccggcggttacgagccctaccgcgcccagcagaaggccgcggaccggctcaaacgccctaaaccgcgcaaggcggccgtgggcacgcgaccgtgggacgagatcgccgccgggttgcgcaggcattggagcccggagcagatagccaaccggctgaggctggacttcccggataatggggatatgcacgcgagcgtcgagacgatctaccaggccatctacctgcaggccaggggcgaactcaaacaggagctgaaacgcgccatgaggcaaggccgggccaagcgcaagccacagggcgacggcgggcgcagaccccggttccgcgagcccatggtcatgatcagcgaacggccggccgagatagaggaccgcgccgtgcccggacactgggagggcgacctgatcaccggcgccaagaaccaaagcgccatcggcacgctcgtcgagcgcaccaccaggttcacgatcctgctgcgcctgcccgacgggcacgacgccgaacacgtccagcaggccatcatcgacaagatgcagcacctgcccaaactcctgcgcaacagcctgacctgggaccagggaagcgagctcgccctgcacaaacggatcaccacggcactggacatggccgtctacttctgcgacccgcactccccgtggcagcgcggtaccaacgagaacaccaacgggctcctgcgccagtacttccccaaaggcaccgacctatccgtctacccggaggactacctcgacgcggtcgccgaggaactcaacgaccggccacgcaaaaccctcgggttcatgaagcccagcgagaagatcatcgaactactcaacaccgcaagctaacctaacaaccaacaaaaccaatcaggcgttgcaaccaccactagaatccacccgacccgtacggcaacgccatggccgagagcgccgacggcgcgtacaggaccgggctcgtccggcgttgcaagcccttccgggatccgagggacccggaatcggcgacgttccggtgggtctcgtggcggggactcgaagcgtccgcaccggccctcgggccaccggacaccggaacggaccgaaccgagtattatgtaaaccaagcggcgcaagccgccccactataaggacggaaaaatcaggccatatcaaagcgcaggccgtaattcgtaaataatggcgctttccagagcggtggttagtgggttaaaagagatttcagcgagagagaagcaggagaatgaatggtgaagaaaagagaagacattgagaatttgcgagcagtcgcaataattcttgtggttctagggcacagcgttatcctgtattcggataaatgggcgctgtatcccacaacagtctcagcccccccctctaaacggactgaaagacataattaaccttattcaaatgccgttgttcttttcgatatcgggattctgcctcgtatattcattgaatgggaagcgttctttcaggggttttctgaaaaacaaactgcgacgtgtcgtagttccttttctgattattggcgcattgtggttgtatccgttaagaatgcttgccgattatccggcatatcaggatgtgaacccggtcaacgtgcttgtcaagtatatttactttggctatgacaacggacatctctggttcttaccgacgttgttcctgatgctggtgctaaccgacctgattgcccgcgttccgcttttcgaaagcaagccatcactgttcgatttaagtcttgtggcgattgccttgctgacggttgcgattcccgtgtcttggccttatttagggcagttcggccagaactatatgtggttcgtggtgggtgtgcttttccacagacatgaaaagtggattagagaagtatgcaccggtggaatgaagattgtgcttgtctgtgcggcaggtattggatgtctgattaccgggtgtggcatcgaatcaatgctacttggcaaaatcctctctttgatctgcgttctggtggcatacctcgtcgttccgagtcattcgacagcgacactgcggaaaataagccgcaacagcatgggaatataccttttccactctccgctgatatatctatcctttaatttttggcctaatatttcgccatggctgatggtgctgattaatttcgtgggattcggtgccgtagcttatggaatgaccgaactcgtcagaaaactgggtctgggaatagtcataggggagtaggtgcgcggctaaagcttgcgaaattataacaatgcggtataggcgaattacgaaagcggtgaatcgtcgtttttggaattatgaaagcgacactgctcacagtttgtacgtagtttcatatgggcgaggcacagcaatcaataccagcgatattgatatcctcatgctgttgcctaatactgctaaaaagagatttgatgcctacgcacagaatggtcaatcagctcttcttcaggtcgttgggtgacttgaggaagctagatgtagctgagttgcttccgttcgataattccagagtcgtgcgcatggtgtccattgcttcggcgactttcactgcggttgatacagttgatgccgccattcgggctgtgctggtcgggttacaggatgagccgaaagaaggcgtcaaggaattcattctgagaatcaattacgtgggtgttgcccgcttggtcttcgcggtgggcgtcgatgccaaaacagtgtgggagcacaggggcgagcatgtgagatcgcaacagaaggatgtagctgacggtcaggtggcattgaatctgctgttgctgaagcctgagcatcagtctgttttgttctctattgagcggttgtccgtttataaggacatcgagcgaggtaaaccaaagagtcgtgctgataaggagcaatggcttgatcaatggggtaagcgacttcctgagggctgtcatctgcttaatctcggtcaagtgaagcaggaggcagaggatctcgtagcaagagatggcggtctttggaagcgactggttctgattgagtttgctcggtttaagccgtatgagctgattgaatctggtgaagacgaaactggcaagaaaggtaagagtcctccgtttgattcgaagattcttgacgaaatgtggtgtgaggtgttcggtgatccggacaaatcgtctgtgaaatatgttgccaaagtcttgaggcggaacgcgagcatcttggacggcagtcgtaacaggaaaatcatcggtgctgcgggaactgtggcaatcatgggtgctactggaggtgtcgcatttgcgatggctctggttatagcaccggtgcttgcgggttcgtctgttgctggattatccggtgctgcccttaccagcgccagtcttgcggcagttggatatggatcgttggctgctggcgggcttggcatggcaggtggaacagcgataatcgctggtggtggtgcggctctgggtttggctagtggtggtgcggcgacagccattaccgcgctgctgaccggaaccaagggagagtttgcgcttaatgaatgcgccaagctcctcactttctgcaaagattcattggtccagggcgataaagcagaggagttgattgagtcaattcgacacgaattagccaatcaaatcgggcagatggaaatccaacaggccatacttttcgaacgttccaaagattccagcctaaacaaggaagagaaaaagaaagccaagaacgagcttgcttctttcgagaagagtttgcgatacatgcataaatgcgaaaaggagatagccaaactggttggtggtcggcctcatgcggagagcgcagcagatgtcttgaacggtgccggcaatggccgattgattgaaaattgatggcaatgagcgcgaagcattgtcatgctatggggcgaaagcgctcgctgatttctggtgcagggccagcggttggaccagagaggacgccggcgttcagccacgcgtatttgctcgtcgtgatttgccggttgcccagtgggaagtagcgagaacctagtgggaagtgcgcggttgaggggctaaggatgctggaatcctagtgttttcaaagtgctctggcttcttgggggagctctattggttccgaatcttcgatagctactgtgcctacatggaaatctagtgggcttgcatggaaatccagtgggaagcagagaaatgtgtcgtaatctcaatgatttcaacggttttcaaagatgctaaggtgctcggtcttccggtgacatggcgactgcatggaaatcacagggtcatgtgttgtgctcgccggcttgggcttcgtcctaggctcgcggcaagtctttccccgtagtcttcttctcggagcgtgggagtcgtattgccatgatttcatgctcgtcggtaggttcataagaagcgctaatattacattagttcgttcgattttacattagttggagatctgctatggtttaccggccagaggaagtggtgaacaaggttcagagacttctgtctgatgtggaaacagaagtggtggagtacaagtctgccaagaacaattttgatttcgacgatttggggaagtatttctctgctttgagcaatgaagccaatcttcgtcatgccgatgctggctggcttcttttcggagtgcgtaacgatcgaacgatatgtgggactggataccgcaaggaagcgcatgggccaagtgtcgggttgcgcaagttgaagcatgaggtggcgctgtataccaatagcggcatgacgttcgaggaaatatatgagctgacgatagaacgtcagcgagtggtggtctttcagattccccctgcatcattcgctacgcctactacttggaaaggcgttccttattctcgagagaacgaatccattgtgcagatgcctgctttcaagctgactgcaatctattcccaagcaagacctgattggtccagtcagcttgcatatgacgccaatgttggcgatcttgattcggatgccgtggcttttgcctgcgaggagtattcgaagaagtatgcgcctaggcaacgggcgattaagggattctcgtctgaagagattttgaccaagatcggtctcctgattcatggacatgtgaccaatgccgctctggtgctgcttggtaagcctgagtccacggttttccttggtggaatcgagccgcgcatcacttggacgttgtataactcggcgaatgatgtggtctcatatgagcatttcgagcccccgttcatgttgcaggtggacaaggtgcttggcaagattcgcaacgagaaatacaggtttttcacggatccaaatacgttgttccccgaggtggcgcaacgctatagcccggagattattcgagagctattgcataatgccattgcacatcaggattatcgtttgtcggggaagatcaatcttttggaatatgaagaccgccttgtgtttatgaatgaggggtcgttcattccaggaagcatagatgctgcgctggctgtcgggtacaagcctccgtattatcggaattctctgcttgccaaggcaatgagcaaggttggcatgattgatcagaatgccatcggcatcaggaatgtcttcgagatgcagaggaagcgccggctgccgttgcccacatacgatttgtcgaatcgctctcgcgtatcggtctcgatctatggtaccatcctcgatgagaaatattcgcaattacttgcgtccttcccggatttggatttgcagagtgtggtatggctcgacatgattcaaaagggcttggtgatagagagggagcaggctgtttcgctgaggtcacgcggcttggtagaggggcgttatccccgtctgatcatttcgtcggatgtggcgaacgccatgggcaagcagaaagagtatgtgcgcagcaagggcttggataacaggatatgcaaggaactgattttggagctgcttcgatctaggccttcttcaagacttgaggtgctcaacgccattgatcatgcattgccaggggcgctaagtgccaagcagaagggagagcgggtgagctatctgctccagagccttcggaagcaaggaaagatttactcagaaggtgctacttcggctgctaagtggcatcttcaagagtagatggctgttttcttggttgagtgctgaagcaaactaatgtaaatttttgttacctcagaaatttcattagtcttgaaatgcttgatatatggcggttctgaagctgggtatggccactggcgaactaatgtaattttcttaagtccaaaaattacattagttcgtttatatgtttgtacaagacgaatctcccccgattccttcttctcgccacttctggttgtatgctctagcggcatggtaagaacgctctggcatgccttccttgctgtacatgccgattgtgagtgtcacccgtgatggtcgcaggctcgacccggcatggcgttgatggccgcgtacatcgacgagcacagaagccgtttcagggtcgggccgatctgcagggtcctttccgaatcgttgggctgcgggtttctcgcgccgcgcggctaccgcatgttcagaacacgtcccgtcagccgcatgcgggcgaggcgtgaggcgctggcccgcgccgtcctccagatccgctcggatctcttcatggccgtgtacggctgcgggaagatgcacgcgcagctggtcgcccagggccgggatccggccggggtcggccgcgaccgggtgatgaacatcatgcgcgggcttggcatccggggcgtgcgccgcggcaaaaccccggtgacgacgaaacccgccaagggcacgggcggcaggccggatctggtggacagggggttcgaggcttgtgcgccgaaccgcctgcacgtggccgacatcacctacgtgcgcatggccaacggctcgttcggctgcacggcgttcgccgacggcgtgtacgcccgtcggatcgtgggatgggcgtgcgccatgaccatgaacacgcaggagccgccgttgcaggcgttggggcaggcgatctcatgggccgcgtcccgcggcggcacggatggtcttatccaccacggcgaccatggcacgcagtacatcagcacggtgtacaccaccggggttatggaatatgggatgctgccgtcgaccggcaccgtcggcgactcgtacgacaacgccatggccgaaagcgccgacggcgcgtacaagaccgagctggtatggcgcagacccttcgcggatctgaagacctggaattggcgacgttccggtgggtctcgtggtggaactcgaagcgcctgcaccagtccctgggctacaggacaccgcaggcggtggaaaccgagtattatcaacatcaagcggcacaagccgcctcactataaggacggaacaaaaatcaggccacttcatacattttagtgttcagctgtggacgaacgagtatctagcggatgtctgaaaggtggctggaaggttaactgggtgacgggcggcaaacagatgtgttcaaggtggacaacatatgcgcgcgcaagtgttgggcgtcattcgctggtagtgcaccaaaaagcgctgtctgcatgaagccttctacagcagtcccgccatgtagatcggcagtttgaccacgtcattttccacaaccagcggtttcggatgcagcacgtatctggtgccgaccttcttatcgaattttgccttgaatttgtctaacgagaccgtgcggtagcgtttcgatgacttgacctcgatggggctgaccctgtacttcattgccgcgttctcgtacggttcgacgatgaggaagtcgatctccatgcggttcgacgggtcgtcgcgatcgctgcgcgaatagaagaacagccggtgcccgttgacccggagaagctgtgcaacgacgttctccgcgagcatgccctcgttgatctcgatgcgttctaggaggatgtcccggtacaggttgcttccggtctgttccgagtcggccagggcgagcgtagtgagaagccctgtatcggcggcgtagcatttgaccgtcgaatggtcctcgctaatgctcaagcccacgctcggatcggtggaattgaaacagtcgttggtaatgaacgcatcggaaagccagaagaaggcgtcctcgtaatcgcgggttttcgctttctctcccagcgatgtgatgttgaacttcttctccttcttggaaagctgacccaccaggttgtcgaagatgcgcgtgatgcgtatccggtcgctgccgccatgcttggagatgtcctgcttgtacagtcggaggatgttccgtttgacgttgtcgactttgctgaaatcatgggtctcgacgtacttcgacacagcctggggcatgcctccgaccagcatgtattcacggaatagccgcatggctttcctgtgcagcgaatcggggagcggcctgcgcttcttgaacgagtccgcgatgagcgcggacagtggcttttctcccaaagcccagaggaattcatcgaaatccatgggattcaggcggatcgactcctcctctgatggaatgaggatgtccttgacgttctcgcggatggagacgagcgagcctgtctcgatgtagtcgtaacgtccgtcagccaccagctgcttgatggcctcgcgggccttcgggtacagctgcacctcgtcgaaaatgatgaggctatccctcctgtgcagttccactccgtagaaggatgacaggtacatgaagaacgcgtcgaggtcgttgcgcaggtcgacgaagtagcccagcacgtcatcgggggctttcgagaagtcgacgagcatatacgacgcatagttccgtcgtccgaattcctccgcgatggtgcttttcccgacgcgccatgcgccctcgatgagcagggctgtgcttccttgggaagaatccttccaggaagccagtttttcgtacgcttttcgttcgaaagtttccatgtctcaccgccgtagatacaccaaatcaaggataactaaggtgttgtatgtacaccaaatcaagggtaatgtaatggtgggttgctgatcggcttgaattagatttctgacaggtggtcttatatatggtagattctggcgttcgtccggacgtatttcgcttatatgtggcagctcgtttttgtgacagaccggttagggggtaattgtgtaccctctaactgcggtctttctggaatgaactgccatacataggcgagatgcctccggtcagccttccgaatctgccatctataagccagtttgtggaatcgctttatggctatgcacccctgcgatgcgattgaatatccgcggcaaggcaggacgaagaagaccggtaagacgccgagttcaagttcaacatctcgaagtaagtgtttctctggctcccctctttgaggggagctgtcgctacaagcgactgaggagcggcacggataaggcctgagaagtcgtcttctcgggcctttgtcatgacattgttctgcaaggactggctgctgcagcagcataatgtgtgttttattattcggccttggcggcttgctgatcaatccaattgttgacgtcggtgaccgcctcgtcaagggttgctttggcggctttgttgtatttggaatctacaggttggcgatttccgctccgaatggccagagcgcaagcttggccatcttgaacgcttgaatgccgagcgggatgccgatgatggagatgcatagaatcagtcccaccaatgcccatccgattgcgatggccaacccgccaagaatgatccacaggatattgccgagaactcgcatgatttgcccctttccgattccggtcgatgcctcgcatgtccggcttcacttttttgccagacatcatgacggaaacacgagacgcaacccttggctcgcccctgattcatcctcggaccgctacccaggcggatcgtatgcggtaggcccaatccttttgtaaagattttgtgtattgtcgggcatgcgtgggtttcaccgtcgatctgaatgatgataggcttctcgatgtctgccgtacgaagacccatcaaggagatgccatgaacctgtatcgctacgcgatgttcatcgcacacgcctgccgtgggtcgttcgtcggcaatattctgtttgccaatccacaaatggccctattctcgatgctggtgtagcggggacacgccttatgccgggatgtaccgatggcccatccgcagtcgacgtcgcatgaatcgctcaccatagccatcaacttacgcaaagccgcgaatcgtttgccgtatatgaatgcggaacggatggcggcttttcctttaccccggactcatcggtgtccccgcatcttgacacaagtatgaggccggatcgcccacacatgccgttaccaacagaaggaaatgctgtgacctcacagaaaaccgcggaatccgggtccgccgccagttccgtaaagcctattgattcgcacgcccgattcatcgtcgtgggcgtgatcgtcgtcggctcgttcatcgcgctgctcaaccagaccgtcatgtcaccggccttgccggcactgatgcgtgatttcaatatcaccaccggcaccgtgcagtgggtgaccagcgtctacatgctggtctcgggcatcatggtgccgatttcaggctatctgattgataaattctccacccgaaagctcttcgccggagcccttgccactttcatgatcggcacactgctgtgtgccgttgcgccgaatttcgtgctgttgctcatcggacgcgtattgcaatccgccggctccggcgtgctgttgccattggtcgccgtagtgccgatgctcgtctatccgccggataagcgcggcaccgccatgggcatggccggtatcgtcatggccgccggcccggctatcggcccggttgtcggtggtctggtgattgacagtttcggatggcgcctgatgttcattggcattgcagtcgtggcactggtcatccttgtcggaggcacgatgatgctcaagaacgtcagcgagttgaagaacccaaagctcaacgtcctgtccgtgatcctttcgaccatcgcgttcggtggcctgctctatggcttctcgtccgcttccacgatgggatgggccagtccggtcgtcattacctcaatcgtcgttggtcttgtggccttcgtcgcattcgtatacaagcaagtcaagctcgatgagccattgttgcgcgttgacacccttgccacccgcaacttccgcaactccgcgattctggtcactctgatcaacgccgcagtcgccgcaaccaacgtgacgttgcctatcttcatccagaatgtgctcggccaatccgccaccgtcaccggcatggtcatgctgcccgctgcggcggtcggcatcatcctgagtccggtcgccggtgccgcattcgacaaattcggcccgcgcggcgtgggcatcggcggccttgcgctcatgaccatctctcttggtcttctcggcaccatcaacaccaagacatcagtgctgtttgtcgccgtgttctgcgcattgcaggcatctggtcaggctatcgccaacatgccgatcaacacttggggcgtcaacgctttgccgaacgacatgatcgcccatggcaacgctatcgccaacaccggccgccagatcgcggcagccattgcgacctcgcttctggtcaccgcagaaacatccgtgaccgcctcgcacatgtcccagggtgtgaagtccgccacggccagcggcattgcgttctcctacctgctgtgcgccgccatctcgctggtcgccctgatcatctgcatcttcaccgtcaccagccgtgccaaggagaaggccgcacgcaacgccaaggcctacgaggcgcaagcctccgccgaagtcgcggccgaaaccactgaaggccagcccgccgagcatcactacgccggcgcatacgtggcccccgcctcctccctgttcaagcaggcccaggaacagtccatcggcgggatcatggacgatcagccctacagctgcttggacagcgatgacatcacgcatgtggtgcgcgagttcatccgcctcaacgtttccagccttcccgtggtgaacggcgatggcaggctcgtcggcttcgtcagcgacggcgatgtcatgaaatcgattgccacctatgaatcccgtacggtttccaccggcaccggttcgacgatggtggtgttcgacgacgaaaccgtggcctccaaggtgcaggcgctctccggcaagaaggtgatggacatcgccacgcgtaaggtcgttgccgccacgcccgaccagcatgttggagaggtggcccgaatcctcgccaagaagcagttcaagaaactgccggtggtggatggtgatggcagactcgtcggtgtgatccgccgtaagtccgtgatggaacatgccttcgacgcgctgttcccaaaggatgatcggtgattcggcatcatcatcgctgaatagaatgaatggaatatgaggcttcccttctcgcgggggaagcctcattgctttgtccgcggagtcttacggcacctgcgcaagggcaacgtcacgctttcatgatgcacttgaatagtgtgttcctatcgttgcatggtgacgctaatgcatggcgtcacgatactgaagcctgccatctaacggcgggtacggctcgttgctggagtcgtgcacgcatacgcgcgtcggcgtgcgtatgccgtgatgtgacctttgtagtggaattgaagagttgagaggcttctgctgttttcgtgggttaggttcttggttgtggtaggtgtatgtcgagtccgtcgcagcggagcatgacgagcgcgatgaggctgccgacgtggcctgatttctgttccccttttattgtgagacggtttgtgccgcttggtttgcatgatactcggtttcgatctgttccggtgtcctgcagcccagcgactggtggagacgcttcgagttccaccacgagacccaccggaacgtcgccaattctggctcggccaggtcggcgaatggcttgcgccgccacaccagctcggtcttgtacgcgccgttgacgctttcggccatggcgttgtcgtacgagtcgccgaccgtgccggtcgagggaagcatgccgtgttccctgacctgggtggtgtacaccgtgctgatgtgtgttttgccaaattgaagtagtccagaatggcgtgtcaattcaatctcgtactctacgggcccgtcggcgccggcaagacgcatctcgcagtcgcgttgggcaggctcgcgtgcatgcgcgcgataccggtcgggttcttcaccgcgaccgggctgctcatgcggctgcgccgcgcgaaacgggggcggctcgacgcggagcctcggcagatcgccagggcgaggctcccggtcatcgacgagttcggctacatgccgatcgacgaggagggctccgggctcctgttccaggtcatatcggattcccacgagacccggagcgtggtctacaccacgaacatcgagtgctccggctggggggggggcgtgctcggcgacaagaacatggccgccgcgttgatcgaccgcaccgtgcaccacggaagactcaccggattcgagggaggctcctaccgtagcgagcacgccctcatgaccagatagccaggaagaaaagggcggcgggttccgacggcgcagtttctgttggaaaccagccgcctacactgctgaaaaatagtgcccatactgtggacgccaacttgcagaaacacacaacttgaccaccgagaagcgcgccgaccgccagtacgacgtggagttccgcgacgtctcgttccgctacccaaacgcgctcgaggacgcgtggggcgttgcggcacgtcaacctgaagttcaaagtcggctcccgtcttgcggtagtgggcatgaacggcagcggcaagaccacgttcatcaatctgctgtgccggctctacgacccgatcgaagggcaaatcctgctcaacggcatcgacatccgcaaataccgttacgacgaatacatgcgcatcttcgccgtggtgttccaggactttcggctgttcgccctgccgctcggccagaacgtggcggccggtgcgcactacggcagtgagcgcgtgatggactgcctgagtaaggccgacttcggcgaccggttgaagacgctgccggacggacttgacacgcccctgtacaaggagctcgacaagaacggcgtggaagtctcgggcggcgaggctcagaagatcgacatcgccggcgacaagacggccgtgtatatcagccaccggttgtcgtcgtgcaagttctgcgacgacatcgccgtgttcgaccatggcgcgatcgtccagtatggcacgcacgaccagctcgtggccgacgaaaacggcaagtactacgagttgtggcatgcgcaggcgcagtattacgtcaaggagtaggcgccgcgggtggcggatgcattgtcgtgcgtcggcatgggcggcagcccgacggtgccgcccatgccggaaggccggtaagtacgggcgcccgcggccggtcagagcggcagcaggtcgctcaggtcgtcgcgctcgccgacggcggtgatgcgtcccgcgtccttctcttgggaccatgtggtgatgccggcggcgagacggagccacacctcggggtcgagctcgatgacatcgggcggtgtgagattgtgagggtcggacgccgggccatccaggatcttcacggctccccatggtgcgactcgcacttccacgccggggccgggcgccttgcgctccagcagatataaggtgtatcgcaccgccatcgcccatgtcggtcggggcagcgccggcatcagggactccgagtccgccccgtcctcgcgcagtcgctgcgctgcgtcgttccactgctgccacgcgcgctcgcccgcgggtatgtctcgttctcgaattgcggccatgactccattgtgcctctaggggtgacgattgccttttcgcatcggccggcggttctaggtgtggtttcggatgcttgcatttctgcaaaagtgtttcatcgggcttgcatcaggtgttgcaatacgttgttttccaacgtggcaacgttttctgtcgtctcaaaatgtggttgatatatagccgatttggcgtatttatggcaaatcctgtatgatattccatgtttctgcaaacgattgcataacgttacgcagcgttcaccggaacttattggcgtggtcaccaagccgtcgcataataacacaggaagcataatccggaaagagagtcagacatgactgaaatcactgcacccaagtcacctgtcacgaccgccgagttcgcggacggcatccgcgaacagctgaagtacagccaaggcgtcaccgtcgagcaggccacccccgccgacgtgtacgtcgcctcctcgctggtggtccgccactacctgcaggacgcatggttcaagacccagcaggacatggtcaatggcaacaccaaggccgtcggatacctgtccgccgagttcctcatgggcaagcagctgcgtaacgcactgctcaacgccggcatgatcgaccagttcgacgaagccgtcaaggacctgggcttcgagccgcaggacgtcatcgacgtcgaacacgagccgggcctcggcaacggcggcctcggccgtctcgccgcctgcttcatcgactcgctcgcgtccctcggcgtacccgcgttcggctacggcatccagtacaagtacggcatcttcgagcaggccttcgacaaggacggcaagcagatcgagaagcctgactactggctgaccaacgaagagccctggggccacatcgactacaaccgttcccagaaggtctccttcggcggcgaagtcgtcgaagagaacggcaagaaggtctggaagccggcctggtccgtgcgcgccgtgcccgtcgactacatggtccccggctacgcatccggccgcgtcaacacgctgcgcctgtggagcgccaagagctacgacgaattcgacctgctcaccttcaacaagtccgaatacctcgacgccgtcaagccgcaggtcaaggccgagaacatctccaagattctctacccggaggattccaccccgcagggcaaggcgctgcgtctcgaacagcagtacttcttcgtggccgcgtccctgcacgacgccatccgcgtgttctaccccggccagagcaagcccgacctgaccaccttcccgagcaagatcaccttccagctcaacgacacccaccccgtcatcggcatccccgagctcatgcgcatcctcatcgacgagtacggctacgactgggacaccgcctggtccatcaccaccaagaccttcaactacacctgccacaccctgctgcccgaggcgctggaagtctggccggccaagctgatctccgaactgctgccccgccacatggaaatcatcaacgagatcaacgagcacttcctcgccgaactcaagaccaagacccgtgacaaggccaagatcgagcgcatgcgcatcgtcaccgacgaggagaaccccaaggtccgcatggcatacctcgccaccgccggtggctcccacgtcaacggcgtcgccgaactgcactccgaactgctcaaggacgtcacccttcgtgacttctccgacctctacggcgacaagttcaccaacgtcaccaacggcgtcaccccccgtcgcttcatccgcctcgccaacccgcgcctgtccgccctcatcaccgaaggcctcggcaccgacaagtggctgagcgacctcgaactgctcaagggcctcgaacccctcgccaaggacgacgaattcgtcaagaagttcgccgccgtcaagcaggccaacaaggaggacttcaccgcctacgccaagcgcgaatacggcttcgacctcgaccccaacaccatgttcaacaccatggtcaagcgcctgcacgagtacaagcgccagtccctcaagatcctcgcgctgatcgccaagtacgccgacatcaagtccggtcgcgtctccgccgacgatgtgcttccccgcaccgtcatcttcggcgccaagtccgccccgggctactacctcgccaagatgaccatccagctcatcaacaacgtcgcccgcgtcgtcaacaacgaccccgacgtcaagggcaagctgcacgtcttcttcccctggaactacaacgtccgcctcgcccagcacctcatcccagccaccgacctcgacgagcaaatctcccaggccggcaaggaggcgtccggcaccggcaacatgaagttcgccctcaacggcgccctcaccgtcggtacgttggacggtgcgaacgtcgaaatccgtgagcgtgtcggcgccgagaacttcttcctcttcggcatgaccgtcgacgaggtcgacaagctctacgaagatggctactcgccggccaagtactacgaggccgacccccgcctgaaggccgccatcgacatggtctccgacggcaccttctccaacggtgaccgcaacacctacgcccccctcgtcgccgactggctcaccaaggactggttcatgaccctcgcggacttcaccgcctactccagcatccaaagtgagatcgaagccctctaccgcgaccccctcgagtggaaccgcaaggccgtcctcaacgtcgcgaactcgggctacttcagctccgacaggtcgatccaggattatctcgacaacatctggcacacctccccgttggcctgattacggagcgtcctcgtcgttgctcctcagtcgcggtacctttgtaccgtttccttcggtgcgcctagaggacgcacacgtaatcagtccaacgggctgcgcccgcttgccgactgacggcgtgtaacgtgattcgcccccgctggcgggggcgaattttgttttacatcactgcgcagcgcggcgaatggcgaacacggcgactgcggcgattggcagcaggaagccgcttgcaagcatcgccatcaccgggcttgctcggcgtggtcggctgctggccaccattcgacgcgatcgcgaccgcgaacgacgcggatacgcctgagtctcgatgttcaatgatccggaaagatcgtaatccaaggtcttcgcctcatcgaacgtccagctcacccaaggctcgggcttcacactgcccttggactgccagtcgccccacgcggtgtcggtattgccatcgcataggttcgaaaccggcgtcttgctttgcgaatacgacgcttcgagcttgccggcaccgcatacgttgctgccgtttttcgatcgtggcggcggtggggcatgtctcgacgaagaggggcaaggttggaatcgccatgcagtgagccatccagaacccttgtctgccgcattggggctctcaaaactcgcagatacaccgcaatacttgctgaaaatggtctataactgcgagttttgagagccccaatgcggcacaacatgcgagaagagcctgcctgcgaaatgcagacaggctcttctcgcggacacatgtgtgcctacgacgattgactgttagatgaactcaggcggcttccggggctgcttcggcctcatcggcgtcgcccttgtcggcgtccttggtcaggccaaggtcgaccggggacgagctgttctcccaaggctcctcccacggatcataatccgggttctgctgcttgtagatgtacagaccaaccacggcggccagcagcgcaccaaagaacaacgcaaagaacttccaaccgtttgaagacttgttctccatgacggctcctttcccaatcctggttggcttgcccgttcaaaaccaactctgggttccatcttaattccaaaaatgtggcgattgcgtgcgggaatgcttttgctttgccggcggtgcgcacgacgagccgggagcgtgttgtttcaccgtccggcgaggagatgcgattccgctacagtagatgacatgagtaatggccgattcagtttgtttcccggtgcgccgtcggcgcacaacctgttctccaagcgtgcgattcaatatcagtggcggtcgaacggccccgtgttcaccagcgcgatcatcatcgcgtgcgtcgccgtgtgggttgtcgagatggtgttcagcctgttctggcctcttggactcgcaaccatgatctattacggccggttcgacccgatgacggcggtcgcacaaccgtggatgttcctcacgtcgatgtttctgcattcgccgaagtcggtgctgcatatcctgttcaacatgctggcgttgtggagcgtggggccggtgctggagaagatgatggggcattggccgtttctcgcgctgtacgtgctttccggtttgggcggcggtcttgggctgatgtcctgggccgcgctgtggccgggtggcaccgggtggcttggtggtgcctatggcgcgtccggcgcgttgttcggcctgttcgcggcgatgctggttgtgtaccggcgcatcggagaggatatccgttcgatgctggtctggatggcggtcaacttcctgatgccgttcctggtgggcggcatcgcatggcaggctcatgtaggcgggttcatcgtcggcggcgtattcacgtggctgctgatttccggcgtgcacgcgttgcgtggcaagagcctgacgttccggacgatggtgtacggggcggtggtgttggcgctgatcgtggcaggcgtgctggtctgtaatctgagcaatccagctctgacgtacatcatgtgattggcctcttacccggtgaaagtcccacctggcgcggcgtgttcgagaacagcaggcgccgttacgggtacaggcgcgtccacctggaattgaggggcgcgggcgtcgtcgtgtccgccaaacgggtcatgcgcctgatggcccggcacgggctcgtgcccgtgtccaggagcgcgaggcgctactcctcgtacaggggtgagatcggcgaggcgcccgtcatccactcggaccgcggctgccactaccggtggccggaatggatacgcatctgcaagggccacgggctgacccgctcgatgagcgcgaagggctgcagcccgggcaacgcggccgcggaggggttcttcggccgtctcaagcaggagttcttccacaagcgcgacttcacgggcgtcacggtcgacgggttcgccgacgatgctcgacgagtacatgacatggtaccgcgacgaacgcatcaagaccgagtacgggatgagcatcatggacaggcgcatcaagctggggctcgtcggctgaacacatgtgataacctgccagacaaccatacagacaacgaagtccaacaaaacgtcaccgcccccgagcttgtgatgggacttttgtggggtgggcggggcgctggagaatggctcggggtggaggcgtcgcaccaatgtgaattacatgcgtgtagttttccacatgatgtggagaactttgtggacaacttgggtataagttgggtataactcgtggataactatggtgaataagtccgtgtgagctctaacaatgttggaaatactgggttttgacacattgtggacaatgtgcacaatgcgaataagagttatccacaattgtgtataagtatgtgaataatgtggataacatggggaaaaccggtggatagacagtgcacaacttgatttgcggagcatccgttacgggtctcgaagccagggcgcgatgacgctgccgggataccatggcactatggatatttcgtctcagaccagtcggttcattgcggcgcaccgcaatcaggatgtgcgcgacctggcgctcagcgccaaacgcgtggacgggcttgacctgccattcgcgctcgaccagatcgccggctggcagactgcgtgccgcaagctgccgcaatgggccgagaccgacggcatcgtctatccgccgcacatctccatggaacagtgctcttcccagttcgccgcgcagtacaaggccggcatcgcaaggcgcgtagcgggcgccggcggtgcgatggtcgatctgaccggcggattcggcgtcgattgctcgtatatcgcgcgtggattcagccgggcggtctatgtggagcgccagcctcacctgtgcgagctcgcggctcataatttccgggcgctggggctcccgcacatggatgtgatcaacggcgatgcggaggattggctgcgcggcgtcgttgacgcccgcgccgcctccgcagactcggccgcagtcgattcagctacagccgttcccatcgcgctgatctacctcgaccccgcgcgacgtgacgcgcatggcggccgaacctatgccatcgccgactgcacgccggacgtactcgcgctgaaagaccgtctgctggccgtctcgccgcacgtcatggtcaagctgtctccgatgctggattggcgaaagacggttgcggacttcaacggttcggtcggcgaagtgcatatcgtctccacaggcaacgaatgcaaggaactgctgctggtgctcgaccgcggttcgcacgacgccgtacgcgtgatctgcgtcaacgatggcgacgtattcggatacgtccatgacatgaagaccggcgcggattctgacggcgtggtcctcgccgccgcaggagaaaaaggcagtcagggcgggtctgcagagccgccacacgccgctccggaacagcccaggtatctgtacgagccgaacgcttcgctgatgaagggcggctgtttcgcgctgctggaagaccattatggtatgcgccagatcggcccgaacagccacctgctgatatcgggcacgccggcgccgcagtttcccggccggggatttgtcattgaaaccatcgcgggtatgggcaagaaagagctgaaacgggctctagcgggcgtcgacggggcgaatatcgcagtgcgcaacttcccgttgaccgctgtccagctgcgcaggaaactcaagctggcagacggcggcgatgtgtatctgttcggcacgacgtccgtcgatggccgtcatgtcatcgtccgcaccgtgaagcagtgaaaccgcgaaaagggtatgacaacaacacagtttggcggtggcgcagcaccatgccgcgccaccgccaaaccgtaacgtcgcttaccgtcgatatggagctggctaccgcgaggggatctcgccgctcagcgccaccacatcgtcatgatgaatccgaccataatgatcgcgaaggcgattgccaggttccaagcaccgatacccgggatcggccacgtgccgttcggcgacaggtagtagaccacggcccagatcaggccgatgatcatcagcgcgcagaacagcgggacgaaccagcgcgggttcgacttggtgcccttgatggtctcctcgacgcggcgcgtgttctccgcctgccgcgacatcatgcgctgcatctgcggggtcatctctgacttgtcggcggtggcgttgagcaccgcctgcaccttgtccatggagacgccgtaatcgtcatcggcctcgtcggtctcgttggtgtccgtgtccttgacgtcggcgtcggtctcggcctgccagtccttctggtcttccgagtcggtttcgtgcagctctgtgtcagccataagcgtagtctccattcaataggctaaaaaatcataatagcggttacactcgaaagttgaacacactgggaggaatcatggccagacacaccagcaggcacgccgcccggcgcacgtggctcggcggcttcgcggtgtgcctgatcgtggctttttccgggtatctgctggtgacgaacgtgcgcgtgaaccgcacggcaacggtcacttccgacacggcggatctggtggagcagcgcgtggagcatgtcgaccagctgcagaaggacatcaccgacctgagcgcgcagatcaacacgctgaaggatttcgccaacaacagtggctcctccgagcagccctcgggcacgagcgaccccaagcccagcgacaccgaggacgcgggctccggcaccatactgccggcggtgcacggtcccggcatcaccgtgaccctgaacgactccccgttgtgggagaacatggtggacagctcgggctcggccgcgaacatcaacgattacgtcgtgcatcaggaggatgtggaggctgttgtcaacgccctgtgggcgggcggcgcggagtcgatgatgatcatggaccagcgcgtgttgttcaattccgcagtgatctgccaagggaatgtgcttctattacagggcaagaaatactcgccgccgttcaccgtgtcggcgatcggccccgcagatgctatgattcgggctttggacgactcgaacgcggtcaagttgtataaagagtatgtcagcgcattcggattgggctggaaagtggaaaaaaaggacgatctcgtgttcgggcagtctgcggcgacgctgcagccgttgcggtatgcgtccgtggtcaaggacgggagcgaggaatgaagcattcgcgcaactctcaacagattcaaggcgattttcaggatttcgaggcgcctgcccctgctgaaccggagtacgccggggaagtgaccatggcgctgcctccggtgccgatgcccgatccgaacgcccggcgcggcctcgcgcagccggcggccaagcgcagcgttctgtggtcggtgctggggatcctcggcgaggtgctgatgacgctggcggccgtctgcgcgctgtacgtggtatggcagatgtggtggaccggcgtccagtccgagcacacgcaggtcgagacccgccagtcggcgtcatggtccgatccggccggcggcgacagctcgaaggtcgccaaggcgcaaagcggcgacgtgccggtccagccgacgagcgcaagcgatggcgagctcatcgcgcaggtgtacgtgccccggttcggccaggggtgggtgcgtaacgtggtcgaaggcacggacgaggccgaattgtcgctgcatggtctgggacattatccgtccacgcagatgcccggttcagtcggcaatttcgcggtcgccggccaccgcaacggctatggtcgaccgctgggagacgtcgacctgctgcaggagggcgacgcgatcattgtgcgtaccaaggactactggtacgtgtacaagtacacgacatacaagatcgtcaccccggagcactccgaggtcatcgccgctaacccggaggatctcaacacgcctcccagcaagcgcatgatcacactgaccacgtgcgagccgaaatacaccacggccacgcatcgttggatcagctatggcgagctgagctattgggccaaggtctcggatggcgtgccgcaggagctcgccacgtcgtcgaactcggcgaaggtggcgttctccagcagcaacacgagccagtcgttcgtgtccaagctgggcacgctgcagcccatcgtgctgtgggcgctggtggcgtacctggtgctgtacatcgcggccctggtggcctggcggtacccggtgctgcgcgagattcgcgccggcaagcgccgccgtccggacgcgagcatctacggatggctgctgcgtcaccagcccggtccgctggtaatcaggtgggcgctgctgatactgctgctgttcatcgtcagcgtgtcgctgattcagtgggcgtgcccatgggcggcaagcaacatccccatcctgcaaagcatgtcgaattacgcggtcgattagcggcatggccggttggcggcgataatgggaacgcatgggatggcggtcggcgctcgccggtgccatcccataatcagaacgagacgaggagcgtcatgacggattcggcacgcattgtggtggtggacaattacgattctttcgtatacaccatcgttggatatctgaaaaccttgggagcgacggtcgatgtggtgcgcaacgacgcaatagacccctcagatgcctctgtgctggacgaatatgacggtgtgcttatttcccccggtccgggcgctccggcggattctggggccagcgaggacgttattcggctatgtgccaagctcggcaagcccatgttcggtgtgtgccttggcctgcaggcgctcgccgaggtgttcggctgcacggtcagccacgcgcccaccatcatgcacggcaaaaccagtctcgtcgagcatatcgatgatgagatcttcgccggcgtcgccaatccgatgaccgcgacccgatatcattcgctggccgtcgagcccgacaccgtgcccgatgacctggtcgtgacggcgtggacgaaggatgaccatatcgttcagggcatcaagcaccggtcgttgccgatgtatgcggtgcagttccatcctgaatcggtgatgacgcaggacggctaccggctgctcgccaactggctcgccgtctgcgggcagaccaacgccgtggccaagtccatcggtctgcagcccaaggtcaaccgctgacacgcacgtgtgtgtggcgccgcgcgtgacgcgtgacgcgcatgacaacgatgatggcccgtggcatgaggaatgccacgggccatcatgtgttctgggccgatgtgtgtagaccgcgcggctgggccgcccgtcttgccgatcgacccgccgcgattgccggttgcgcttaccggccgtcaggcggccgatcggtcacaccgcaatggcaatcacggccattcccggcggttcagttcccacctgtcgtcgtgccgccgttgccgttgttgtcgggatcctcggtggtgggcttcttggcggtgaccgagatggtgctgcccttgtcgacctgcgtgccggccgcgggatcctgcgtttcgatgaccgcatcatcggtcgcgtcgccggtgaccttcagcgtgaagtcgctgcccagcgtggccttggccttggcgatcgtgttgccgaggagattgggcacgctgacctgcggcttgccggtggacacgtagaccgtgatctgcgagccctgcagcaccagttctccggaaccggggctgactcgcgtcaccgagcccttctccaccttgtccgaggcctcctgctcgacgaccggcaggaacttcatggacgagagcttgtccagcaccgtgtccttgggctggccgaccagaccgtccggcaccttggtcatgcccgaggagatgtacagcgtgatcgtcgtgcccttgggctgcgacgtgccggaggccgggtcggtgctcacgaccttgtccttctcgatggtggcgctgtcggcggtcttcgtgacggacgacaccttgaagcccagtttctccagcgcgttgcgcgcatcctcctgggtgtagtcgctcaggtcgggcacggtcaccgacttggggcctacggagaaccagaccttcacgtccgagcccttgacggcctgagtgtcgcccttgggggactgcttggtgaacgtgccggcgggttcaccggaatccgaatcctgcatctcaacgaagttgaacccggccgaggtaaccttctccttcgcctgcgccttggtcatcgtcgccgtgatggtgggcacggtgcccatctccgtggcggatttgcggctcatggtgtagatcacgccgaagatgatcgccagcagcaccacgccgctgatgatcgacgcgatgatgatcttcttcttgcgcttctgcctggccgcctccgcgcgttgctcggcgcgagacttgaccgccagggcctcgttcgggttctgcgccggaggcaccatctcgaactggccggtcgccgggttgtacgcctgcgtgggctgacccgcgccgacagcactcatcggcacggtagcgccgccgtcctgctgctccgcggccttgcgggccttcacgttggccagatcggtcagcgggttgaacgccgccgcgaccggcacgccgccgttcatgaacgtcaggatatcgttcttgaattcggccgccgtcgcgtaacggttctgccgatccttcgccatcgccttcgcgcagatcgaatcccacatgcgcggcaggccgggcacgagcgtgctgggcggcgtcgccacctccgacacgtgctgataggcgatcgccacagccgagtcgccggtgaacggcggacggccggtgagcatctcatacagcacgcagccggccgagtacaggtcggagcgcatgtcgacggtctcgccgcgagcctgctcgggcgagaggtactgcgcggtgccgactacgccctgggactgggtcatcgtcgcagcggagtcgtcgagcgcgcgggcgatgccgaagtccatgaccttgaccacgccctgctcggagatcatgatgttgccgggcttgatgtcgcggtggacgatgcccatgtgatgcgagtattcgagcgcgttgagcacgccgagcatcacctgttcggcgtctcgctggctgagcgggccgttcgccttgatcacgtcacgcagcgtctggcccttgacgaactccatcaccaggtacggcagccgctccgtgccgccgctgtcggtcatcacggtctcctcgccggagtcgtagatgttgacgatgttcgggttgttcatctgcgccacggagtgcgcttcgcggcggaatcgggacaggaagatcttgtcgttggccaggtcggcgcgcatgatcttgatcgccaccgtacgtcccaggcgcgtgtccaatgccacgcgcacttcggccatgcctccacgccctacaagttggccgagctgatagcggccgttcgccagcgatgccggcatattgctgctcatagctattcctctcgattcttcgggtcggtcgtcgccgtatgcccgccaaattggttacggttcatggtgatcagcgtcgccgtgtgcggtgtgctggatacgcggcggggcatgcgcccgccaagtcccatgatggtctcatccatctgcgcggtctcctgatcgagcagacgtcgttctatgcgcgacagcgtgcgcgaaacggtcagcgcgtccttcggacggtcaagcggatccttggacagcatcgacatgacgaactgccgaagctgcacatctatggaatccggcagcgggggcaccgggtcgttgacgtgtgcggcggcgatgtcgaccggcgtggtgccggtgaacggccgatgcccgcacagcccttcgtacgcgacgacgcccagcgagtagatgtcggattgcggcgtggcctgtttgccttgcgcctgctcgggggagatgtactgcgcggtgccgacgaccatgccatcctgcgtgatctgctcctggttcgtggagtaggagacgccgaaatcggtgattttcacctcgcccgtagtggagaccatgatgttggccggcttgacgtcgcggtggatcacgccgtggctgtgcgccacgaacaggccgcgcgcggtctggatcagtatcggcagcagttccgtcgcgggcagcgtgccacggtcgcggtagatgtcggccagcgagtcgctgggcacgtactccatgatgaggaagccgatgctgtcgtgctcgtaatactcgaacagcgcggcgatgttggggtgcgccagattggcggaattgtgcgcttccgcccgcagacggtgcagcttggcctcgacgttgccctgatcgtcgcgcagcgccttgatggcgacgggacggttgagctggatgtcgtggcctttccacacctctcccatgccgccctgcgccagtcggcgatccaggcggtaacggcggtggatgagttgtccttcgacgagtttcattgtttcagggcctcctccatcagtgaacgcatgatcggtccggcggcttccacaccgtactgattgacattatggataacaacggagaccgcgatcttcgggttgtcggcgggggcgaacccgataacccatgcgtcgttggtctggttggagctgccgatctgcgcggttccggtcttcgccgcgaccttgatgccgctcagctgcaggctgggcgcgtcatgctcgaccaccgactgcatcatctggttgagcttggacgccgtgctggagctgaacgcggtggacatcacttcgggcgtggcttcggacagcgtactcaggtcgctggcccgcacgcggtccaccagcgtcggcctcatgagcttgccgtcgttcgcgatggccgcggcgaccatcgcgttctgcaatggcgtggacagcacgtcgccctggccgatggacgccagcgccaccttgtcgtcggacagcgtgtcggggaacttggcggcgacggacttcatcgggcgcccggacgacgaggtgccgtcgatggtgatcgagcttccgtagccgagcttcttcgcctgctcggcgatcttgtcctggccgagtttcacgccgagctgggcgaacgcggtgttggacgagtatgtcagcgcgtcctgcagcgtgatcttgccgtcgatgccgttcgccgcggtggtggtgttggtcaggttcgtcgaggttccgggcagcgtatagctcgctccggcgggaatctgagtatcggtgtcgtagtcgccggattccagcgccgtcgcggcgacgatggtcttgaacgtggatccgggcgggtacagctgcgaggtcgcacggttgatcatcgggctgttggcctgcgcggcgagtttcgaatagttcgcggtggctttcttcgtgtcgtgcgtggcgagagcgttcggatcgtagctgggggcgctcgccagggtcaggatgcggccggtcttgacctcgatgaccactgcggcgccgtcgttgctgccgagttgctggtaggcgagctgctgcagcttgggattgatggacgtctcgatggacgcgcccttgttctcgacgccggtgaacagcgatttcagctgatcccagaacagcgcgtccgccttgccgctcagcagcttgttgcgggatgattcgatgccgcggtcgccgcgctgggtgaccgagaagaagccggtcaccggggcgtacaccggcccgttcgtgtaggaacgctggtatgagaacacgtcgttgaccggggtcgactgcgcgaggatcgtcccgtcggacgcgagtatggcgcctcggggagcgccgtattcctgatacagcgcccttgcgttgcgcgggtcggagctcagcgagttggcgcggatggcggtgatgatcgtggtggacatgccgagtaccacgaacaaggcgatgacggcggtgaacagctgcctgaggtatttgttcatcgcgcacctgcctcgatgatttccgtggtctggttgttcgccgccgcgtggcggggttccggtggccgctcggcctgcggttcgcgttcgggtgcggactccttgtcagtgcgttccttcagctcgcggtcacgcagcaccgccagcgcctcgtattggaacgtgtcggacagtgtgtccggctccgggcggttcgccgcgttcgagatgatcatcagcagcgcggcgagcaggtagttcgcgatcagcgatgagccgccggcggccatgtacggcatggtcatgccggtcagcgggattaccagcgtgatgccgccgaccacggtgaatacctggaaggccatcgtgaacaccagtccggaggccagcagcttgccgaacccgtccttgatcttcatggcggtgatgaacccggacgcgatgatcagcaggtacagcaccagaacggccatcagaccggtcaagcccagctcctcgccgaccgacgaatagatgaagtcggaattcgcgaacgtggtcagacccggctgcccgtgacccaggccggtgccggtcatgccgccggaggccatgccgaagatgcccgtgaccagctgccacgagccgcctatgcggttgtactgctcgtcgctgaacgggtgcagccatgagtccacgcgctggccgacgtggctgaacacgctggccgcggcgaccgcgcctacggcgaacgcgatgaagccgatgacgatccagcttctgcgcccggtggccgcgtacagcatcgcgacgaacatcgcgaagaacatcagcgacgtgcccagatcgcgctgcatgatgagcacgcccatcgagatcagccacaccatgatgatcggaccgaggtccttgatgcggggcagctggagtcccagcaccttcttgcctcccacggcgagctggtcgcggtggtcgaacaggtaggcggcgaagaagaacgcgaggaacagcttggcgaattcggcgggctgcagcgaatatccgccgatgcggatccagatcttggcgccgttgatgttgcgccccagaccggggatcatgggcgacagcagcagtatcaggcctatcaccatgttcacgtacgagtatttgcgcagcacacgatagtcgcgcatgaccgccacgaggatgccacacagcgtcagggctatgcacaaccagatcagctgccttgagccgaccgaggaattaccggacttgtcgatgcgcgcgatcatcaccacgccgatcgcggtcagcatcagcacgcatggcagaatcgcctggctggcgtacggcttgaaccgcagcagcagtccccacagcacgaggaacagcgcgccgaccacggccagcaggccgatgtagttggcggggaagtggccgtagacgcgcaggaacatctggtagaaggcgacgacgctgatcagcatggcgaacagcagcagcgacgcctgacggagacgtatggggatcattgggcgtcaccgccgtctgtgccggtggacgatgcgtccgtgccggtatcgcccgcggtgccatccgcagtgccgccgtcggtctggctgctgccggcgcttgagtcgccgtccgtgccgttcgacccggatgagtcggatgagtcggatgagtcggacgtgccgttgcccgcgttgccggacgacttggacgtgttggaattgtcgttgaagttgcttttctcctgacggatgacctgcacgtgctggatggcctcgtcatagctgttgaaggtgatgccgtcctgcagctggtcgcgccacgcctgcggcagcgagtcgatgtcgatgttcgtgcgcttgacctcgtgcgacagcgccaggccgaacacgttggtgttcacgccttggtacacggccaccacgccgtctgcgttgccgatgaagtatttcgtctggctccagcggtaggcgccgaaagcgccgcccgtggcaagcgcgagcgcggcgatcacgatgaggattgcgatcagacgattgcggcggccgcgcttgcgcgtctccttgcgctgcgtctgccgctcgtgatggatggccttggcgacgtcgggatcgttgggatcgtcggtgacatggccgtcacgcttctggatgaccggtatctcgccggtgtcggggttggcgcgttcgccgttctcctcgcgcacggccgacggctgcgcgacgcgcggcgacggctgcgaggcgggctggctctgtatcagcgcggcggcgcgttgcgctggcgatgcgttcgcgtcgcgcagcatgggcgcggtggcgacaggctcgttgaggatgtctgcgatgggctccaggctggcgctcgccgctccggcgaccagtggggtctggtggggcaggtcgaaggcatccgcgtcgagagccagcgtggcgtcggcgatgaccgcggtcacgttgtcggtgctgccggccttcaaggccatcgaaaccagctgctgggcgcattcctcctgatcggagtaggcggtgagcgtctgctcgatggtggaatcctccagcacgccgcacaggccgtcggagcacagcatccaacggtcggttggatgggcggcccgaatggcgatgtcggggtgcggatcgatgtcgaagtcgccgagcacgcgcatgacgacgttgcgctgcggatggttgcgcgcctccgcggggctgatgcggcctgtgtcgatgagatgctgaacgtagctgtggtcctgcgtcatgcgggtcaggcgaccgtcgcgcagcaggtacgcgcgcgagtcgccgatgtgcgcgagcacccagtagcccgcgaccagcgccacggcggtcatcgtggtgcccatgccggcgagcttgcgctcgcgcttcgccttgccgacgatcgcgtcgtgagcggccatgacggacgtttccatcatccgggcgacggtgctcacgtcgccgttgacgtcatcgtgctcgatgtgggcgagtgaacggatggcgatggtcgaggcggtgtcgccgccggcatggccacccatgccgtcgcagatcgcgatgaggtgctccccggcgaacgcggaatcctggttgttggagcgcacggtgccgacgtcggacaccgtggtcgagtacaggaacaaggtctgtgatgcaacggaatttggcatgagccgtcacctcaattcgaaggtggtggcgccaatgcgcaccggcatgcgcgggggcagcagcatgggcatgttcagccgctgctggttgacgatggtgccgttggtgcttcccaaatcctcgatcgcccattgaccggaggcgggatccttatatatgcgggcgtgatgcgaggagacgaattcgtcgtcgagcaccacggtgttggacgcggcgcgtcccagcgtgatggattcgctggtcagcggcacggaggcgccggccttcgggccatcgatgatgaccagcagcgtgggaccggattgcggcgtgcgctgctggctttggcgcggcggcgtaacgggcgcggtctgtgcggcggccgggccggacggtgccgggccgtcagaggatttcatcgcgcgcttgtctcggcggcgtcgggcccgcgacggctgcgggctgaacgcttcgatgtctttgtgcagcgatcgcaccgcaagccagacaaagacccacagcaggatcaggaatccatacttgaggatcgcaaatgtcagttcggtcataacggaaagtcgactcctggctcggggtcactcctgctctcgtgaggaagcccagaacaggatgcgggtgcggccgatggtgatggtattgccgtccagcagcgtcgcggccggcacctgatggccttcgacgtacgtgccgttggtcgagcccagatcgcgcgcgatgacgccgttgggggtcaggtcaatttccaggtgcttgcgggagatgccgggatcgtcgatgacgatgtcgcagccggagccgcggccgatcaccgtcttgctctcggtgagcaggtaggggttgccgttgatgtcaagcatcggatggtcctcggcctggtcggtggtggtcacggggaccgcgttgccctgcacggattcggagctcaggttgaagctgcccttgggcaggtcgaggtcctcctcgaagatgaccatcacggggccgacgaacgcataatgctggctcttggcgtattgcgtgaggttgtccgccagctcgttggcgagcacttcgctgccccactgttcgatgcgatcgaagtcggccgtgctgagcttgaaacggtattcgttcggggctaccgtgcggtcgcggccgaccggcatggcttcggcgtcgatctcgcgctccagggcgctggaaaggtcgacaggcttcaggtctttggagccgaacttggaaaagactccgttgaccgcgccttctacacttttctcaaaacggtcgagaacgctcatggtgatccctttctatatccttacccatcctatacgtcagtggggaagtcaattgtgatttctgaggaaaaagcctgtttgagcgcaaaatttccacttctgacacggcgttgtggggcgtgagacctatttggaccgatgccgtccgcctgatgcgccagcccgcggggcgatcatggggaggcaagggggagggcggccggcgtggtttgcccagtgcggtggctaccgtggtgggcatgaacgatatgacgactcttcatgatgcaatcggcgattttccccgccgcaaggcgcagacgttgcggttctcctgcggtgccccgcgttccgcgaccgcgattggcgacggttcccgcgtgctgttcctgcgttccgacggccctgaggacctggtgacctcgctgtggctgagcgtgttcgacgcggacggcacacatcgggaggtgctgctggccgacccgcgtgtgctgcttgcggacgctgatgacgaggacgtgcctgccgaggagaaggcccgtcgcgagcgcgcccgtgaaggcggctcgggcattgtctcgtattcggtggatgcggctggccgccgtgtggtcttcacgatcaacggtcagctgttcctgaccgagatcgccgaagacggcagcggtcgcacccgtatgctggcggcggatgacatcgccgcaggagagggtgccacgccggtgcttaatccgcgcatatcgccggacggcaggcatgtggcgtacacgaccggcgaacatctgatgctggtcgacatcgcgccgcagtggccgtctgacagtcgtcatgatgacgccaccgacgacgactgcgacggccagccggcgccgcacgcgcacggccaccgctgcggcgacgaggagtcgggcgccccctacgacccctccgccgacaagctcagcacgctgtggagcgtgtatccggacgatgacgccgacgagaacacatggaagatcggtctggccgaattcgtcgccggcgaggagatggaccgttacgacggcttctggtgggggccggactcccgtcacatcatcttcgagacgttcaacgcggcacctgagccgatgtggtacatcagcgacccggcgaacccgcagacgccggcctccggccgtcgatacgcgcgtgcgctcaccagcaacgccgatgtgcgcctgacgctggcggagctcgcgtacgacgggcacgacgagtatgcgggactgggcatccagcagatctcctggaaccgcaaggactatgaatatgtcgccgcggtgcactggtccgccggccatgagccattgctgctggtgcagaaccgccgacagacgcgtgaccaggtgctctcggtgcatctcggctccgaggcctctgcgggctcggcgccggtcggctccacgaccgtgctggaggagcatgccaacgaccagtggctcgacatcatccagggcacgccggccttcacgccggacggacgcctggtctgcgcgctcaacgacatggacgccgacaccaaccggctgacggtggacggccgcccgttcacgcccgccggctggcaggtgcgagaggtgctcgacgtcaccgatgaggacgtgctggcggtcgtgcagcgcaccccggaactggacggatacgaggcgcccgacggactgagcccgtggcgaggcaacgccgatggccatgacgcccgcagcttcgacgtggtgagcttcgattatgatggcaatgtgctgccgatgaccgcacggcccggctcctggtcggccagccggcgcggcgagggcctggtggtctccgggcgcgacatggactcggcgaaatccgtgatgtcgcactccttcacgatgcgcccggtcgacgggggagccgcgccggaaaacgatggcgatggctccgccgcgatgagcacgctcgtctgcccgatcgacaaccatgccgccgaacccggtttcgcgccgaacgtgcgcttcgcccggctcggcgagcatcgcctgtacacggccatcatcgcgccgagcgccgatagcccgtacgcgaaggccgacaagctgccggtgctgctcaagccgtacggcggccccggattccagcaggtcgtgttcaaccaggcgtactactgggacgcgcagtggtgggccgaccagggcttcctggtcgtcaccgccgatggccgcggcaccacaggccgcgggccgcgatgggaccgtgagatcttcgagaacatgaaggacgtcacgcttgccgaccaggtggaggcggtgcatgcgttggcccagaccgtcgaggagctgaaccgcggcaccgcgcaggacggcgacgcgtcgcgcatccccgccccggacctcgacaaggtgtgcatgatcggctggtcgtacggcggtttcctgtcggcgctcgcggtgctggacgccccggacgtggtcaaggcggcatgcgccggcgccccgcccaccgattggacgctgtacgacacgcattacaccgagcgctacctcgggctcgacccggcggcgtacgagcgcaacagcatcatcgccgacgcgccgaagctcgcccgcccgctgatgctgattcacggcttcgccgacgacaacgtgaccatcgcgcacagcctgcgcctcagtcaggcgctgatggccgccggccgtccgcacaccttcctgccgctgaccggaatcacgcatatgaccaatgacccggtcgtcgcggagaacctgctgacgctgcagcgcgacttcctgcgcgatgccctcgatctgtgaccggtcgcccgtttcggggcggaatggaacggcattccgccccgaaacgcggcaaatgcgacatcggcggcgcttgtgcacagtatgtccgatatcgcgttcgacatatgggcggttcgtgtccacatatgacctcggtggtgcgctgtgggcgaatccagctcttacggctggggatatactctcactgagcatgatcgggcggaagatacgaaacgaggggtttggtgcgtacgatttggcgaatattcacgcgcgacctcatgcgcatcctgcgcaacccggtcgcggtggtggtgacgctgggcgtggccatcatcccctctctgtatgcatggttcaacatcctcgccaactgggacccgtattcgtcgaccggcaacctccaggtcgccgtcgccaatgaagacaagggcactacatcagatctggtcgggcggctcgacgcgggcaagcaggtcgtcagccagctcaagaagaacgaccggctcggctggacgttcgtcagcgccgacaaggccgtggaaggcgtgcagtccggcgaatactacgcggcgatcgtactgccgaaggacttcagcgaaagcctgatcaattcgatcaccggctcttccgacaagccgaacatcatctactacgtcaacgagaaaaagaacgccatcgcgccgaaaatcaccgatacgggcgccacgaccatcgactcccagatcaatgcgacattcgtctccaccgtcagcaagacactcgcccaaacgatgacgaaggagggcggcaagctcagccagtccgccgacggcacgcgcaccagcgtcgtcaacgacctcaacggcctcatcgagcagctgaacgacatcgactcatcgctcgggcgcatgggcggcacgttcgacgatgcggaaaagggcatcaaacaggccaagtccaccgtcgcctcgctgaaacgtcagatctcatccgcgcagaaagccgcgaaacagtcacagagactgctcacgcaggtgcagggcagcgcccaatcgttctcgtcgtcgcttgcgggcgcgttcgataacggatccgtgcagctgtccggcatcggcgtcagcgtgaacaacgcggcgggagacgcgctcagcgccttcaacaccgcacaaggcagcatcgacgacatcaccaatgctctgcagaagccgatcgacggcgcggctacgctgtccagcgacctcaaggacgcgatgaacaaggccggcatcggccgcgacaccgccatcggcaagcagatttggcagcagatagacgcgctcgacaagaccgtgaacacccagcagggccagctcgacgccttccacaaggacacgtcacagttcatcagctccggcaagagcgcggccaccagcctttcggacgtcaccagcaccgccaccggcagcggcatcggcatactcaaccgcgcacgcacgacgctcaccggaaccgtcaccccgaacctgaccgcgggattgagcaacttcgccacgctcagcggcacaatcgacggcacgctgtcatcgctgtcatccacgctcggccagtccgacagcctgtttgacgagctgtccgacacgctgagccaggcgaaaaccaccgtggccggcacgcagaaatcgctcgccgacctcaccgacagcgtcagcggcgtgcgcaccgacatcgccgcgctcggcagttcggccacataccagaaaatcaagcaggccctgaacatcgacggcgacagcttcggcgaattcatgggcacaccggtcaaactgtccactaaaagcgtctacccgatggacaactatggctccgcggtcaccccgttctacacgaacctggcgctgtgggtcggcggcttcgtgctcatcgccatctacaagctagaggttgaccgcgagcggctcggcgacgtgaccgcgtcgcaggcgtatctcgggcggtggctgctgttcgtggtcgtcggattcctccaggccctgatcgtcatgatcggcgatctggtgctcggcatccaatgccagcgtccggtgctgttcgtcctcgccggtctgttctgctcgttcgtgtacatcaacatcatctatgcgctcgcggtcgcgttccggcatatcggcaaggcggtcgccgtgatactggtgatcgtccagattccgggcgcgtcgggcctgtacccgattgagatgatgccggacttcttccgggagctgcacccgtggctgccgttcacgtacggcatcaacgcgatgcgtggcccgatagcgggactctacggcaaccattactggagcgacatgctgcatctgttcctgtacctgcccgtcgcgctgttcatcgggctggtcgtgcgccggtacgcgctgaacctgaacgcgctgttcgaccggcggctggccgaaaccgacctgatgatgaccgagcacaacgcgatggtcaacgagtcggtgagcttctcttcgatcctgaacgagttctcgaacaccgaagagcttcgcaaggtgatccgccgtcgcgcgaaacggttcttcgggcgctatccgcggctgatccgcgccgggctggccctgctgatcgtgctgccgttcgtgttcctcatcctgctgttcgtcatcccaaacaaggtggcgatgctgacgacgtggatcctgtcgataatcatcatcgatgccttcctgatcgtggtcgaatacatgcgggaccggtacgcgcggcagctgggcgtcagcgccatgagcgcggacgcgttccgcgacgccgtgctgcgtggatacacgcaccggcacctgacgttccgcacgtccgggaggtcgccgcgcaagcatgcggccgtctccaaggcggctcgggacgacggtgatgccggggccgccggcgacggtgacatcggggagctcggtgaactcgacggccttgactggccggcgcaaccgatttcaggcaatgacgatgccgaaggcggcaataacggcaatgaggagagcgccggggagaccaccgagcagataccgcccgcagggcagatgccgttcgccgggcaggaggacgagacgcgatgaaaaatatctggaggatcttcacgcgcgacgtctgccacgccacgcgcaacgtcatcgcgatcatcgtggccatgggactgatcatcgtgccggcgctgtacgcctggtacaacatcgccgccagctgggatccgtacggcaacaccaaatcgttgaaagtggccgtggcgaacgtcgacagcggatacaaatccgacctgatcccggtgcgtgtcaacatcggcgagaccgtcgtcagctcgctgcgcgccaaccatgacctcgactggcagttcgtcgaccgcgacaccgcgatcgacggcgtgcattctggcgaatactacgcggcgctgatcatccccaagcagttcagcgccgacatgatgacgctgttctcgccggaaatgaagcacgccgaactggagtactacctcaacgagaaaatcaacccgatcgcgccgcacatcaccgatcagggcgcgtccacggtcgccacgaccatcgaccagaccttcgcgaagaccctcgcgcaggtcgccctcgacctggtatccagcctgctgaaattcgcgcaaagcccgcaaatgagcgagtacgtatccaacgccacgaaacacatttcgtcgatttcgtcgcagctgaagtccgccgcgtcacaggccgactcctacgcaagcctgatgggcgcgacaggcaaaatcatcagctccaccgaccgtctgctcggctcgaccggatccagcgcgtcggacgcgaagaaagcgctgaaacagggcacggccggcgtgaaaagcctggacgaggccctagccggcgtctcgacgagcatgagctcgtcgctgtccgacgccgcgggagcctacgacacgatcagcaagcaggtggacaccgcgttctccgacatgggctcccaatcctcccagattaccgacaagctcaccacgctgcagcgcaacatccaatcgcaggccgacacattcggcacatacgcggaggcgctgcgctcgctggccgacgccgcgcacctgcaggcggtcaaggacgcgctcaacaacgcggctcagcaggcgcagaacacgcagaacagtctgcagaaggtcgccgacagcatcggcgacgcctccaagaaaatcaccgacggcaccgccagtgcggacgacacgcgcaaatccctgaagaagcagatagccgccgcgaagcagtcgatcaccgacatggcgaacacgtacgacaccacgatcaagccgcagctcgacgagctgggcaagtcgatgagcgatgtcgtcaagcagtcggggagcgtcatcgacggactggccgccaccgccaccagcatgtccggcctgtccggcgacatcaccggcagcctgtccgacgtgcaagcctcgttgggcgacgcggcgaccaccctgaacgcctcggccgagaaactcgactcgctcaacaagcagctgacggcggtcgtcggaggcagcggcatgcccgatctctcgcagatcacgtcaaccgaccccgattcgatcgccacgctgctgtccgccccggtctcggtgaaccgcatcgcgctgtacccggtcgccaactatggttccgccatgacgccgttctataccgtgctgtcgatctgggtgggcgcgatcatcctcgtcgccatgatgaaggtgtcggtgtccgaccgcgagaaggcgaaggtgctcggcctcggcgaaacgctgccgatgggcgagacgatgggcgtgaaggatgccgtgatcgccggacggaccgcagggccgggcgcgatgctcgacgtgctgcgcaagccacgccccgagtcgcccggcaacgcgcgacggttcggcctgcacccgtatcaggagtatttcgggcgatacgccattttcggcgcgatggcgctgctgcagggcacgctggtatgcctgggcgacatgttcttcctcggcgtgcagtgcgagcatccgctgcagttcctgatggtcggctggctgtgcgcgctggtgttctcgctgctgatctacacgctgaccgtgtcgttcggcgacatcggcaaggccatcgccgtggtgctgctggtcatgcaggtggccggctcgggcggtaccttcccgatcgagacgttgccgccgttcttccagacgatctgcaagtggctgttgttcccgtacggggtcgatgcgatgcattcggcgatggcggggtcgttcggcaacgaatactgggtgtcgatgggcaagctggcgctgttcatcctgccggcgctgctactcggcctggtgctgcgcaagccggtgatgcggttgaatgattggatcatccgcaatctcgaatccaccaaggtcatgtgacgtgagtcggcgggcgagcggtgggctggccgcgcgggtgcggcggccggtagccgccggttgccggccgtccggccgcccggctgtgacgccggacgaagccggtcgtttccccgcccgtcgccggcgtgaaaggcggtacagtggaggctatgcaagtgaagcttatcgacgagaaccgctatgcagacgagatgcgcgagatggtgctgcccgcgcttgccacatgccggtccgaaggctggatggcgccggcggacgacgacggtctgccgccgctgcagcgtgcgggcaaactgcattacgtgtgttacgacgcggcgaaattcgaccggttgggcgaggacggtgccgccgccacattccgcggtgccgtggtgatctcccacgggttcacggagttcgccgcgaaatatgcggagatggtgtggtacttcctgctcgcagggtactcggtgtgcgtgttcgagcaccgcggacatgggtattccgcgcgtgacgtcgacaattcgtccctggtgtggattgatgattggcggcggtatgtggccgatctggcgaaattcgcggagacggtgggcaaggattacgcggatggccgtccgctgaacctgtactgccattcgatgggtggcggcatcggggcgagtgtgctggagacgcatccgacgctgttcgacaaggccgtgctgtcgtgcccgatgatcgcgccggtgaccggtatgccgaactggctggcgtcggtgcttgccggcgcgatgtgccggctcgggctgggacggcacatggtgttcgggcagagtgagttcacgccggagctggatatggccgattacgagggcgcgagcgaggcccgcgtgcgctggttccaacagcagcgcatcgacgacccgcatcagcggacgttcgcggcgacattcgcgtgggtgcggcaggcgctgcgactgtcgcgtgccgtgcagcggccggaggcgtgcgacaatgtcgagacgccggtgctgctgttccaggccgggcgcgacgtgtgggtgctcaacgagccgcagaaccggttcgcgcaggaggtcaactccgatggagggaatgtgcgcgtggtacgcatcgagaactcgctgcatgagattttcagcatgcccaatgccgttcttgggccgtatctggagcggattctgggcttcttcggctcatctgagatgccgacgttctgatggtttgtgacggatgccgaccggatgagtccgcaaggaaagatgtcgtgaaacctgccgtgaaacatatcgtgaaacagtcgaaaacgccggccgccgagtcggcgcccgagactgcatcattcgagcgtacgccgaaagccatgctgctgggtgccgtgctagtgctgcttggcggtgtgctgtggggcatcaacgccacagtgtcgaaattgctgatggccgactatcacgccgacccgctgtggatcgcctgcgtgcgcgagctcgcggccggcgcgttgttcctggcctgtgccggtgtgcgtacgccgaaactattggcaggtgcggtgcgcgaccgacgctcctacccgatgctgctgctcgccgcgctgacctgcgtgctgttcgtgcaggtctcgtatctgtccgcgatcgactggacgaactccggcaccgcgaccgtattgcagacgttgaacctgctgttcgtgctggcgtatgtgtgcatacgcgggcgccgctggccggggctgcgcgagagcatcggcgtggcgttggcgtttgccggtacggtgctgatcgccaccggaggagatctttccacgctgaagctgccgctggtcggattgctatggggcctcgccgacgcggcgtgtacggcggcgctgtcgattctgccggccaagctgatagcgcgatggggcaatcttgcggtcaacggcatcatgttcgtcatatccggtttggtgctgatgccgttcgtccgcccgtgggccagcgcgccgcagctggattggttcggcgtgctgctgatggtgttcaccgttgtcggaggcacgttcggcgcatattggctgttcctggccggcgtgatgcgtatcggctcgatgcgcggcacaatgctgggtaccagcgagccgatcgccgcgacgatatccgccgtgctgtgggccggtgcggtgttcacgcccacggatttcgtcggcttcgtgatgatcatcgtcatggtgttcctcgtgcgctagcacgcgtggcccgcatgccgacatacggtctctctcgcgtgcgacgcgcttcaccgactgtttgcgttcttaagtgcgcgccgagacgacaagtccgcgcacataggaacgcaaacagggcgatttacgttcctatgtgcgcatggtcgtcgttttggcgcgcacttaagaacgcaaaaccacgtttcgcccgccaggccaggcgtcgcgggatgtgtggatagtgataggtgagcatccgaatgcatagaacgggggctgccatgcatgagtcatcgtataaggccggttcggggcgacgttatcagtccgggcaggggcgtccgggtcgcgttccgcggatcctcgccactgttgtcgccgtaatcgcgctcatcgtgggcggcctcgcactggttcgggccgtcgcaccccatgcaatcgcgaagctgacagcggtatccgtgcgcagcctggcaatcggcgcggcggcgctgatcgtcgtcgccatcatactgatcgtcatggctcgcgtggcttcccgacgcggcaaccgagtgagcgtgcgtggaaccgcaggcggagccatcgtcgccgtcgtattcgcaatcatgctgaccgtagccgcgctgctgatctccaacctgttcaaggacggcatcgtcaagccgtcatcgcccgacaagtcacctgctcagagtgcgcagaacatgcaacaatcagttgaggaggctggcatctactgcgagtccggctggtcggaactctcatcgcaagggtatccgggtgtgacggacgtcgagatatgcctcaagccgcgcatcgcctacgtcacgttcgataacgaattcgctgccgacatgtaccgcgcgcctttgcgatacaaaatcgccgagatgtttgacgagcaagcgaacagcaccgactccaagggagactggcggctgttgagtggcaagaaatggtcggtattcagctacaagaccatcattggcaagctccagaagcagtggggtggaaccgtcgagaaaataggatgacggcggatgatccgggtgcgatgcaaccgcggcacatgaggcgcggacgcggtgctccgcgaaggctatgatggaaacgtgaatgacgtctcgaatcagccggcagcgaagcccccagccgaatcatcctccgagtccaccgaatcctcccgtttcacacgcggagacagcacgctgaccaccgtagggcggatcgtcatggtctacgcggtcgtccagctgctgatggcgatcagtgcgctcgcgtcactgtccggccttgatcccgcggcttccgtgcaagtgatcggcgggtggcgcatcggcctgcgcgtggcatggttcacgctcggcctggtgttcgcgggcaattgcgtgctgtatctgatcggcggatggctcggccgccgggccggagcggacacgtccaaatcccggccgttcatggcactgatgtggctttccgtggtgaccacgcttatcggtctgctcgccgcgcgggcgaccacatccggctgggaggcgtggttttcgcttctgatcgccgtgatactttccctatacgcgaccaaagtcgtaaagcgcagcacgcgcatctgagcggtgacatcggcggctggcctacagacgagcgaaacgccgccaatcgacggtgctgtgagtgaacgcaacgcaaagaaaaatcaggtatggtgagacgcatgagcgagcagaacaatcacgatacaacaaacaactcccggcgcaacccggccgcggcggacggcccgtccatgcagacggcctatttcgcgggcggatgcttttgggggctggaacgctacttccagaacgtcgacggtgtcaccgacaccacggtcggttacgcgcagtcgaaggtcgaatcaccctcctatgagcaggtgtgtgcgggcgtcaccgacgccgcggagaccgtgaaagttgtgttcgacccagcgcaggtgacgctgcgcacgctcacactgctgttcctggaggtcattgacccgttctcggtggaccgtcagggcgaggacagtgggcggcagtaccgcaccggcatgttcttcacggacgcgacgcagcaatccgtgtatatcgccgcgctggagcagctggtcgatcggcagcccgcccgcccggcggtcttggtcgagccgctgcgcaacttctacccggccgaggcgcaccatcaggattatctgatcgccaatccgggaggcttctgccatattccgctggccgccatcgcgaacgtgaaacggcggcagaagtatgtggaaaagatctgggacctgacgctcgaacagttcgcggtcacgcagctcgcggccaccgagcggccgttcgtcaacgcctacgacgaggagttcgagccgggcatctacgtggatgtggtcagcggcgagccgttgttctcatcgcgcgacaaattcgattccggctgcggttggccggcgttctccaagccgatcgcggacgagctgttgaccgagcacgcggatcatcgcatcccggggcgcgaccgcatcgaggtgcggacggccgacacgcagatccacctcgggcacgtgtttgacgatgggccagccaatcggggcggtttgcggtactgcatgaactccgccgcgctgcgcttcgtgccgcgctcgcgcatggaggcggaaggctacggcgactggttgcctgcggtggatggcgaatagccgttcagagagccgttgcgcgccttttcctccgcgccagccatcgccgccattggccatggactagcgcaacggtcgcgatgagactggccgccgcagccaatcccagagaatacacgaatcccggagtgctgaagccgtgggcgatcaccagggcgttggaaccgatgcagatcgccgcgaacgaggcgagcgtcgcgatacgcagccatggcacccagcgcgccgggattcttgcgacggcgagatacaacgatgcgataacgacgacttgcaggcatgatgcagcgacgaattgccacagcatcgccggatcatgcagaaatgcggtttcggggaacattctgatgatttcgcggatggtgttcggcaggcgccaccatttgagccatactagccaagcgtccactgccactgcgatgccccacgccaatcctgtgcgcaggcgcagctgtggcgacgcgcgtcggatgctgctcttggcgatgagcgtagattctctcatcgtcggctccttcgaaggcgaatcaggtatatcgcacattgtgaaggcgcggttgccgcgaatcgccgccaaacctcatacgaacgggcagacttttcgcgggaaggggcagctatctgcgtttcagggggttgatttcgtgttcgccaaacgtctatctacgtttcgaggggttgccaaaacgcgatgcccggggtattgagcgccaatcgccattggaatcatgcggttttgggggcgtttatacttggccaccaacccctcgaaacgcagatagatgttcggatcaaaccgaatcgccccctcgaaacgcagatagccttctgacagcgcttatctgcgcaatctctcacccgacaaggtgacggtacagctcaggatccagcggccgcgcaagtctcagtgtggagagcgtgaccttcaccgtaccgtctccggccgcgttcggcttggtggtgagcgtcggattgtcaaacgcggcgacgtgcccgacgtaatagtatttgccgtcggcctcttccgccttgcgcatgacgaacagcggaacgaaatgcgtacggccccagtccggtcccacaccgctcagcgcccactggaattcgggagattgcggggtgcgcccgttcttgctgaagtacttcatctcctgtgcgttcaggaactcgtcttcgtattggctggccgcgtacttcacgaagatgggcatggtgttggtgtctttgtcgagcaggtacccgcctacgttctgaggcgtgttctccttcttccatccgcacagccgcatgacgtcggccatggagtatttgcgctcatacaggaacgcatggtcgaaagcgcgtcgccggctctgcgcctcctggaacaggtctcggcaattggccagaccggtgcgcagcgtgtctgcgagaaagatgcgaaacgtgcgattttcggcgagcatgttgacgaagccggagcttaaacgataggccggttcgccctgatcatcgtcggccagcgtctccaccagtggcaggttcccgaaacgtttgcgattcggtccggtgaagtatgagtagtcaagcacgctgatagcggagtcgaactgcgcatccgagagatcagcctgtgggaagtccgcacggatcgcatcaagcagcgcatctcgactgattggcgcggatgcgttccagctgacaggagtctcgtcatccaggcgctcttcggcaagccgacacagccgttcgaggatggccaactcatgagggcgcagcccgggcagcagcaattccgtggccatcttgaggaccgcgtcttcggtgtcggttaccgggtccagctgatcctcaaatgttgtctcgtggttcttgccgccgccgaggctcttctcgcgcgatcgcacgaaatcgaggtagttgctgcgcttcgtggccaatgtatacggcaaggaaggatcgtaggcgtagatatccatgagcatcggaatgcggccgagctcgtatcgcacctgccggtattgttccgatagcttcttcatttcggaccagttggcggtgtccagtgatttcagcacgcgttccttggcgatcgggtcgaagcttatggaggacaacccgatcgatttgcgctgcaggttcttgcgcgcgcggtcgcggtcaccggtgttgccgtacagggccacggggatcaggtagttgttgttgtagttgccgataaaatcgatgaccacgacgctgtccttgtacgggaacttgcgcagtccgcggccaagctgctgggtgaatatgatgctggactctgtgctgcgcagcatcacgatctggttgacggcggggatatcgacgccttcgttgaacatgtcgacggtgaacaggtagtcgagttcgccgtcggtgagctgccggacgtattcgtcgcgtttttcctgcgataacggcttgccgttgacgtctttgctggtcaccgctgccgtgcgataggggcgttccgcttgctggttccaatgctcgttgaacaagcgggacagctcgtgcgcctcctcctgcctgctgcagaacaccagcccggtgacggggatcccgaattgcccgtattcctgcagcttgtcgatgatatagcgcacgcgctgctcggtggcgagctgcccgatctcgtatttgagctgtttcgactccttcgcgtcgagcccctgtgaaacatcgaggcggtgcatgtcctggtccgggtcctcgtcggaaccgagatattctgcgacgccgtaataatggaacgggcagagcatgttttcgtccagagccttctgtagccggatctcataggcgatgttgtggccgaacaactcgaagatgttgatgccatcggtgcgttccggtgtggcggtcatgcccagcatgaagtcggcgtccctgaaatggtcgatgacgcgctgatacccttcggcgcccgcatgatgaacttcgtcgacaagaacgtagtcgaactcgtcagaggcgaattgcgccagggcctccggctgacgcatggtctgcaccgtggcgaacacgtagcgccgatcctgttgtttgctggtgccggtatacagtcccagctcggattgcggacaaccgagcaccttctggtaggatttcatcgccgctttgaggatcatttgctgctgggcgatgtacagcatgcgccggggccggtactcacgcacgtcgaacgcggaaagataggttttgcctgttcccgtggccgacacgatgatcgcacgatgctcccctttctcgcgtagtttcttcaggctcgcgagggcttctttctgcatggcgttcggctggatctcacggccttcgagggacttcagaatgtcgcgccgtggcggcgcgtacttcttgaaatcctcctcatactgtttgatccattcctcggtgagcggcttggaatcggcgatctgtgagtcgatttcatctcgcacctgcgcgaccagttcgccattggcgagggatgagaccttgagattccattcgcgttgagtgttcaatgcggcgccggtaagattcgaactgccgacgaacaggtcgtagtacggggtgccgttgcgcatgcggcgcgagaatacgtatcctttgggatggaacggctgcccttgagcgactgatactgaagagtcggagcctgcccacacgcggacgtccacgcctgccgtccgctgtaggtgaagcagttcccagaaagcgcgtgggtcgttgaaatgattcttcgtcgacgtgatcagtctgctgacctgctcgggcgcattggcatgatgactgcggaagtcctcgaacaaactgagtatggcatcaggagagacgaaggcgacggagatgtcgaaggaatcgctgttcgtgagcgcatcgctgattccatcatgcatggtgaggtcgcctgggcggttcgaaatcagcgttggcttatagctttcgggggcgtcctgccggggttcgatcagtccggagatgacgctttccagcacggaatgcgtggcatcggttttgaggtctgactgcgggttgagtgattctcgcgtattcatggccggctcggttcctcggaggtgtccgacgttgtctgggtgaggaagcgcatgcctgcgatgatgccgacggccgtacggtcgaccggagcccaattcagctgtggcattgcggaaggatccagccaacggatgtccgtgtgctcggtcagccgtggcatgccgttgattaggtgacaaatgaatgtgatgagtcggaccgtgccgaagtcgtaggcgtactcgctggtgcacacctcatcggcgacctcgatctcacagagcagttcttcttcgatctcccgatgcaatgcctgacgagccgtctcgtaaggctctattttcccgccggggaattcccaatatccggcgagagattttcccggtccgcgttgcgcgcataacaccgctccatcgcgtacgatcgccgcacccacaacgttgatgatcttggcatgagagtccatggttacccgggatacaacggcggcgtttgataatgcgattgtgcggacgggtgtcatgagtggcatgtgaagtgattgcaattgctgtcggaagtttcagctactgaaagtttgacacaaaccgctcggcaaataccaccaccagcaggtatgaccgcggcgccgcggttggaggtcggctgcccgcgatccttcagcgagacgccagcacaaccgtcaccatggcagctgcgccgcgttgctgtcggacgaaggggccgcaagattcgcgtcgctcgtgtagctcgtgcccggctccggtgcgacggtctcatgcggatccggaatcgctgcggctgcgctggctgtgctcgcgcccgtgctcgcgcccgcgtcaccttccagtcctctggccacctcatcgagaaaatcgtcgacttcgtcgatgtcgtatccctctctgaaacgcacattgctgaaggtcttctccttgatgcgccttgcgagcgagtggtcgtcggtcgccatgcggtcgacgatttcgtcaaggaagtcgtcgacctctctggcgctatacccttccttgaaccgcactgtggtgaacgttctcgatgtgatggcgtctgcgctgatcatgactgatcctgtctgtcgctggatatctcgcgcttccactctactctcgcctcgcttgttggaattgcgattatggaagcagcattgaagcccgccgcgccctctgccgtcacggtggtgatcaccagctgcaatcagggagcgctcatccgtgaagcagtcgaatctgcgcttgccgaattcggtgcgccaggacgcgacggtaccgctcctgccggtcagtttgcgccggtccttgaaaaatcatccctatatcaattcccgtcctgcccacctacaggacgggacgattcacctgctcggcgctagactgaagatgtcaatcgtagtcaaaccaaaggcggtcatatcatgattctcgtcaccaccacgccgtcggtcgacggttacgtcatcaatagctatcagggcatcgtgttcggtgaagtgatttccggcgtcaacatgttcaaggatatcggcgccggcctgcgcaacatgttcggcggacgcagccagggctatgaagaggagctgatgaaggcgcgcaacgaggcgattcttgagatgcagcagcgggccgaggcaatgggtgcgcacgccgtggtcggtgtggacatcgactacgaggtgcttggcgccgacaacggcatgctgatggtcaccgcgtccggcaccgccgtgcaactcgcccgccgcggctgaactgtgccggcaccagcttgtgtgccggcaccggcgttcggcgaaacatcgcacggcgacggtatcgtaaagcgttgcgccgcgaagcgcgacggatgataccggtggaaaggaccgtgtgatgactcaaccgcaggcatatgcagtgaccgagggtgacgggttgcccgtggtgttcgtgcatggcatgggcgtggaccaccgttcgctgatgctgctggatgaggcattcttgtgcccggagtcgggcgctgccgcgtcgcggtcgctgaagcgcatatatctggatttgccggggttcggccgcactccggcactgccggcacgcgcgtgcggtctgccggagatggccgactggctgcagtccgccatcgacgatctggtcggcgcgggggagccgttcgcgctggtcggcaattcgatgggcggtgcactcgcccgtgagatggtggctcgcgagtcatcgcgggttcgcgggctggcattgatcgccccggtggtggatccgcggcgcactcgtcgtcatgtcgccgagcatgtgatcgccgagccgaatccgacgctgatacacgcgctgcctcaggatcagacgttcgatttcgtaaccatgggcgtcaaccagtcattcgccgcgtggcgccgctatcagtcatatattttgccgggcatccgtctgtgcgaccgtgacgcctgcgccagattggacgcccgttattggctgaatgacgacccggagcgcgtattcggcacttatgccgggccgactctgttcgtcaccggacgacgggatcagatcgttggttttgaagatcaacgggccctgttgtcgcattatcccgacgccacgttcgtcacgctggatgatgccggccacaacgcgcacatcgaccagcccggagcggtgattcgtctgctccgggagtgggccggccggctgtgacggtaggcgtccacgcgatgtcgggcgcggcacgacgtatgacacgcgctacactggcgcccatgaccggtaaaatcgaagcctacgaccatctgcctgaaacggctcgtgcgatacgcgagcaggtgttcatccgcgagcgtgactggcggcctgaattcgacgagtgggatgccgtggccgtgcatctgctggcgttcgacgggaatcggaccgtggcgacatgccgattctatgcggatcccgaccattccgatcagccgggaaggtacgtgatcgcgcgtctcgccgtgctgcccgacgcgcaaggccgcggtatcggctcccaactgctggccgacgccgaacgccgtattgcgcacagtggaggaaccatcgccgcggtacattcggagaacgaccactacaagttctacgagcggcgtggatatcaactcaccgacgaactctacgacgacggccgccacggttggttgatcaaggcgctcatatgatgcaacttacgggttgaaatagccgaaatccgtgattccccgtgcgaaatcgccgttttcgggcccgaaaacggcatttttgcacggggaattgcccagaacggcgatttcaacccgtaatttacgggagcgagtgggggctctttgtagtaatggccggttatcacgtgatccgattgatctcgcaatcagttggtttcgcgcgacgacaacggcgacgacggaggacccggacacggcaccggggccgaccgggacgaatcccacacccacgtcaaacgggaccaaaccgaccagaaaccaaagtctaaaacaccacgtctagtccctaaaacccggtatccggcatatatgagaaaccccggagcgttggcgttccaacgttttccggggattctccatacgtgcgagtggggggagttgaacccccacgagcatacactcactgccacctgaagacagcgcgtctaccattccgccacactcgcagacaaagagataacttaccagcgatacgcggataatgcaattcggcgtgtcgcggtggggcgccgtaatgattgtcgcggcgggtgctgcggtgattgttgcggtgacgcccgccgcaagcacccgtcgcagcgctccctcacctcacccgcgcggcccgttcgcatagaagcgggcaagcgactcgtcgcggaattcgtcgaagtaaccgccgtcaatcgaggcacgaatatcgtccagcagctttacgaagaaacgctcgttgtggatcgtcgccagcgtgaacccattgaattcgcgggcgcgcagcaagtggtccacatatgcgcgcgtgtaatgctggcacgtgtagcagtcgcacccctcctcaagcgggccgaaatcgaacttgtgctgggcacgcttgacgttgtagcgcccgtcgcgcgtgaaaatcgccccgttgcgcgcgcacctcgcgggtgcaacgcaatcgaacgtgtcgccgccattctccacacatgcgaagatgtcgtcgaccgaggcgatgcccagcacgtgccgtggccggctttccggcatcgcgtcgcagatccacgcgcacgtgtctgcgatgatacgcttctcgatcgcgccgccgatgcccacgccgtcgaagtccagcgaggcgatctgctcggccgcatgcctgcgcaggtcctcatagttcgcgccctgcaccacgccgtacagtgcctggtacggtttgcccagccgctcctcggtcagccgctggtgctcggccacgcaacgctgcgcccaacggtaggtgcgttccaccgaggcttcctgatacgagcgcgtgttcatcagcgtcgtcaattcgtcgaacgcgaacatgatgtccgcgccgattttatgctggatgcccatcgagatttccgcggagaaacgatgacggtcgccgttgagcggcgatttgaatgtcaccccatcctcgtcgacgaacgccagtcgttccttgcccgccgcgatcacgtcgtccgatttcatgccggtcacgtccatcgccagcgtcttcttgaatccggctcccagcgacagcacctggaatccgccggaatcggtgaacgtcggcccgtcccagttcatgaatcgcgcgagtccgccggccgcgtcgagcacgtcctggccggggcgctcgaacagatgaaacgcgttggacagcagacattgcgcccccagctcgcgcatggtctccggcaggacggccttcattgccgcctgcgtggcgaccggcacgaaggccggcgtgcggatgtcgccgtgcggcgtgtggatgatgccggtgcggccgtaacggcggccgccacggcctttgccgtcagctgaatcgggcagttgcgtaagggtttcgaaaaagaatgcgctgcggtcgccgggcctgccatcggccgcgccgcgcgggtgctccagaaaactcgtcatacgattactctaggcgatggccgggaaggcgggagatggcgctcggaaagcctgctgcgggctttcccggcggttcgtggcgtatcgttgtctcaagctgtccggctgatgcgtccgcttttcggacgggatatccgcgggtttcagaagaatcgttttgctgctgaccggtcggaaatgtcgtacgaaacaaggccgaaggcctgcttcatgataacggtagataattcattctctccttccaatcaacgttcaggaaacatccagagcaggtatctttactcttacgtagagcttggcggcgcgctggctcacagatacgagccccaacccgcctgctgatacttacgaatattgaaggagacaacatggctgacaacaacaacggatactggcccgccgataacggcggccagcctgagcagccgcagaacgacaacctgcagcaggacgctccgacgacctcggatgcgcaggatcagcaattcgcccaggagccgctgggcgcgcctcaggaagcgcccgcgcagaacgacgacgcgcagcagccgcagcccgaagcgcaggatacccgtccgacccagccgttggcgcctgtcgcgccgacctcagagcaggcccaggcttccgaaccgactcagccgctgccgccgcagccgacgcagccgacgcagccgctgtaccgcccggcaccggaatacggcgcctacggcccgactccgactcagccggagccccagcagccgcagccgacccagcagcagaatcagaacacgggcaacggcggcaacccgttcttcaacggcaacccgttcatgacgcgcccgacggacgacgcctcacagcagaatcgccagaacggcaacacgccctacggtttcccgttcggcccgcaaggcccgaacggcggccaggatcagggcatggctcagccggaagacggcggcaacgcgtctcgcggcggaagctccgcggccagccacatcgtgaccgcagtggtggccgccctggtggccgcggcgctgtgcctcggcgttggatacttcgcgctcacctatggttgggtgagcacgccgacgacgacatcgctgaccaacgtccagtcgaacaagtccggtaccggcagcgccaccgccaagacgggcgaggccgccgactggaagaccgtggcgagcgaggtctccggctccgtcgtgtcgattcaggcggcgctgagcaacggcaccgccaagggatcgggcgcgatcgtgagcgccaagggctacatcgtcaccaacaaccacgtgatctccggcgcccagcagattcaggtgacgctgtccaacgggcagatgtacaccgctcaggtggtcggcaccgacaccaccaccgacctggcggtcatcaagctcgacaacccgccgagcgacctgaaggctgtggaattcgccgactccgacaagctcgccgtcggcgaggacgtcatggccatcggcaacccgctgggctatgacgacaccgccaccaccggcatcgtgtccgcgctgaaccgcccggtcaccgtgaccgatgactccggctccgacatcgtcaccaacgcggtgcagatcgacgcggccatcaaccccggcaactcgggcggcccgacgttcaacgccgccggccaggtgattggcatcaactcgtcgatcgcctccaccgcgacctccagtgattccgccggctccatcggcatcggtttcgcgattccgtcgaacctcgtcaagcgcgtggccaacgagatcatcaaggacggcaaggtcaagcacgtggccctcggcgtgacaatcaccaccggcacggtcgaggcggacggcgtgacccgcgccggcgccaaggtcaccgcgggagcctccggctccgccgtggtgtccggcagccccgccgacaaggccggcctgaaggtgggcgacgtcatcgtggcgtacgacggcaacgcggtgagcagcacgtattcgctgctcggctatgtacgtgcgtcggcgcttaacgacaaggtgacgttgaccatcgtgcgcggtggcaagaccatggacgtcgaggtgacgctcgacaaggaggagtccgcggtgaacggctccggcaactcgaactcgaacaacaaccagaacaaccagaacaaccagaacaaccagaatggcaacggccagaacggtaacggcaatggcaacggcaacaacggcaacggccagaacgggtacggcaacaacgactacggcaacggcgggttctccgatccgttcggcctgtggtaaattccgctcccgaagccgctgacgctgcctgacggctgacattgcccggcagttgacatggctcgatgatggaggggccggtgcgcttgcgccggtccctccacttgtgtctgcggccatgttcccgcgggccgttggcgtgtcctttcgcagttgttgctagagttggtagaagccgcggatggcatgtgccgccgcgcaacataatcgaacgaacaattgaatatcgaataatctttttacgccgtgtatcgcctgccctcgccgttttaggcagtgctgccgatgggttaacaaggcgtgggtcgcatgccgttcgtgattccgcgcttgttgctgggatgacggacggtccgtatacgagcgtaaggagatacgatgcgtaagttcatctatctttgcagtcatctgtgtgttcaagtgccgctgttgccgattgccgtgctcacggtcattccgcttgccgtgtgcccgtcatggcggccgtggggagcggcggatattcctatactgggcaatcccggcgtgggccagtggattgtcatcatcgtggtggcgtacacgatcatcgacaccgtgcgcggcatgatcgacgatttgcggcatggccgggtcggtgtggatctgctggctgtcgtggcgatcgccgccacggtcgccgtgcaggaatactgggcgagctgggccgtggtgctgatgatctcgtccggcgaagccatcgaggaatacgcccaatccaaggccgaaagcagcctgaccgcgctgatgacggccgcgccccagaccgcgcacgtcgtgcgacggcccggcgtggacgtcgctggtgtcaacaccggcgacggcagctccgacgaccggggcgacggcttccgcaaggtcgccgctctgccgtcttccgccgccagcgggtcgtccgacgctgcgacttcccactatgacaccgttgccgtggaatccgtcacccccggcgatgtgctgattgtgctgcccggtgaaaccgtgccggtggatggcgagctgttgtccggatccgccacgctcgacctgagcaacatcaacggtgagccggtgccgcgcggagtgttcgcgggcgcccgcgtcatgtccggcgcggtgaacggctcgaccacgctgaccatgcgtgccaccgaagccgccagcgactcgcaataccagcgcattctcgcgctcgtcgcggccgcgcaggattcccgcccggcggtggtgaagaccgccgatgtgctggcagtgccgttcacggtgctcgcactggcgatcgcggccgtggcatggttggtgtccggtgtgccgacgcgcttcgctcaggtgctggtgctggcgactccttgcccgttgctgatcgccgcccccgtcgcgtatgtggcgggaaccggccgactagccaagtcgggaatcctgatcaagacacaggacgtgctggagaacctcggccgcgtcacgcacgtgttcttcgacaagaccggcacgttgaccgtgaagcagccgcaggtgacccgcgtcgagatgctgcccggcgccggcactcacctcaatgaggaccacgtactgatgatggcgggcgtggtcgagacctattccgtgcacatcctcgccaaaggcatcgcgaaggccggcacggaagctctgtcccggctgcatcggcggttcgaggaggggcagcggctatgcccgcagcccgatgcggactggcctggtcacgggcgcgattatccggtcgtcaagcacattgatgaagacgccgggaaaggcatctccggcgaagtgaatgggcataaggtgcgcgtaggcagactgtctttcgcggcctcaagcgaagatgggttcctgccggttgagcggatcgtcccgggccgggccacgactgatggagaccggcggtccggaaaacaaggtgaggggcggcttgcggacgagatccgtacccgtttcggcatgctcgcgccggatgaaatggcctcgtacgtgtcggtcgacggtcatctcatcgcccggatcgtcctgcgtgacgtgccgcgcgcgaacgccaagtcggcgctcgcgagcctgcgcggtctcggcgtcgccaagctgtccatgctgacgggagacaagcgatcctccgccgccatcatcgccagtgaggtcggcatcgacgacgtgcatgcggaattgttccccgaagataaggtcaccgctgtcacgaccgcgaccgtgacgccatcgcgcggcgtgacgatgatggtcggcgacggcgtgaacgacgcgcccgtgttggccgccgccgatatcggcatggccatgacggacggcacgtcgactgcggcctcggagtccgcgcaggtggtgatcctgaacgacgacatcgccgccgttccacgggccatcgccatcgcccgccgcaccaaacgtgtgatgctgcaagccgtgctggccggtctcgcgctggccctgatcggcatggttgcggcggcgttcaacttgattcccgtcgtggtcggcgcttttctgcaggaagccatcgacgtggtaagcatcctctgggcgctcaccgcgctgcttgaccgtgactgacgggccgtggtcgacgggcgcagctggaccggtcgtgatcgaccggccgcgcccgtcgccggacgatcgggcgagaacgaatgtgacattcgacaacaatgggggcaatgccgggaaatcccgccgttgcccccttccgtgattcggtggcttgcgataacctataacgcgtgactgaatctgagaacaatgaacttcgtatcgccgtgatcggcgccggtcccgccggcgtctactcctccgacatcttcctgcgccagctgaagaagctcggcgaggagctgggtctgggcaccaaggcccgcatcgacctgttcgagaagctgccggtcccgttcggcctggtccgttacggtgtggcccccgaccatccgagcatcaaattcatcgcatccgcgctggagaagacgctcgacaaccccgacatccacctctactgcgacgtggaattcggcaaggacgtgaccctggacgacctgctggcgcgttacgacgccgtgctgttcgccaccggcgccgtcaaggacaaaccgctgaacctgccgggcgccgacctcgacggcgtgtacggcgccgccaagttcgtcgaatggtatgacggataccccacgggtgcgcgcgaatggccactttcggccgagaacgtcgccgtgatcggtggcggcaacgtggcgatggacgtcgcgcgcgagctcatgcgcaacgccgacgacctcaaggccaagaccgacatccccgacaacgtctacgaaggcatccagggcaacaaggccaaggtgctgcatctgttcatccgccgtggcgtcgcccaggccaagttcagcgtgcaggaactgcgtgagatggagaagctgcccggcgtgcagctcatcatcaacgaggacgacttcgagctggatgacgacacgatcgaagaggccggcaaggacaagctgacgcgccagatggtcgaggagctgttcaccatccgcgagatggccgaagacatggaagacgacggcgacgtcgattacgagggcaaccccgcagatcgcaagtattacgtgcacttcaactccgctcccaccgagatcctcggcaaggacggcaaggtcgcgggcatccgcgtggagaagaccgagaccggcgccgacggcaagatgcaccgcaccggcgaattcgaagactacccggtcgaggccgtgtaccacgcaatcggctacaagcccgccgaagcgcccggcatcacctatgacgagaagggcgcccatctggccaacgcgaacggcgatggccgcatcaccaccgaggccgccggcggtgacgtgcgcgaacgcctgtatgccaccgggtgggccaagcgcgggccggtcggcctgatcggctccaccaagtccgacgcgttgatgatcgtcaccaacatgctggaagacctcgccaaggcggccgaaggcggccgtgtggccgtcgaccgcgaccccgagtccatcgaccgcctgctcgccgagcgcggtgtcaagccgattgacttcgccggttggaagaaggtcgacgccttcgaacgctccgagggcgcgaaggaaggccgcgagcacaagaaggtcgtcgagccggatcagatgcgtgagcttgctcacgcctgagcgacctgtagcgcgactcgtatacatcgatcaagccgcctcccgcgtgacattgcgggcggcggcttgtttttgcccgtacttgtatcatcccgtgcctccggaatcatttcattgtgctcaaggcgcatatccagccaactgtcagacagtgaatttagtgtgtgggctatggacggtaaattgcatgtgcgcggccacttcaacggcctgaaaacgacgctgctctttgcgttgatgtgggccatcatcatgttgatctggtgggccaccggcggtgaccgcggcacgctgggcgtatatatcgtcatcggtctggtctccacgttcagcacgtactggttctccgacaaactcgccatcgcctcgatgggcgcccgcgcggtcaccgagcaggaagctcccgcactgtaccgcatcgtgcgcgaactcagcgccaaggccggcaagccgatgcctcgcatctacgtcgccccgaccatgagccccaacgcgttcgcaacgggccgcaacgagcgccacgcagccgtatgctgcacgcaaggcatcctcaacatactcaacgagcgcgagattcgcggcgtcctcggccacgagctcatgcacgtgtacaaccacgacatcctcacctccgccatagcctccgcactggcgaccatcatcacgtatctgggatactcgctcatgtatttcggcggcggtcgcagcaacgaccgtgacaactcctccggcgccttcggtctgatcggcgcgctgttgagcgcgattctcgtgccgatcggcgcctctctgatccagatggccatctcccgcacccgcgaattcgacgccgacgaggacggcagccacctgaccggcgaccccgaagcgctcgcctccgccctgaacaagatctcctacggtgctcaggccaatccgatgccgaaaaccgcgggcacgcagtcggtgtcatccatgatgatcgccaacccgttctccgcgcgcggattctcgaagctgttctccacgcacccacctaccgacgagcgcatcagccggctcatgcagatgtcgcaggagatgcgcaattccggcatcggcggcggcagcccgcattacttgtactagcttcgttgcgcaaggctcgcgggcatcgccgtcatgtgatacactgacgacttgtgcacaaggcactgcggatgtagttcatcggtagaacgaaagcttcccaagctttaaaggcgggttcgactcccgtcatccgctccattcgcttcaacgatgaagctgtgaaacccaatcattccaacgattttcaattttgtaggcacttgctcgatcacacgatttttgccgaattgttgtcaccgtgttgtcacgaggtgtgtaaaagaggattcggagagtggttcagactcaaaattttcccgtgtccaatatctctgctgcagtgatcttgctgctgatagatgttgccacgtaatcaagatcggtgtcgaataggtctgcataagtatcccttcttagcttggcttatgacaggatttttctctgaattcagtgttctttctctgaattcagagaaagaatgtataattcagagaaagattcagagattcagagcaggcggtggcgaatggcgcacgagtatggcaaagaaaccctgtccaaggaattcaaaagcgatcgcgataaaggtctgccggattccgaattagtggaggctgttgtcgccttagccaatacggacggcgggtgcgtgtatctgggtgttgaggacgacggcaccgcgaccggtgtccagcgcaagcatcaagatcctgtcgggctgtcagcgatgattgccaataggactgtgcccccgatatcggttcgcgcgcaattggtgggtgatggcgtcaccgtcatccaagtcgatgtacccaagtcacatagtgtggtgtcaactaagtcagggagaatcctgcggcgcatgatgaaagtggacggtacgcccgaaagcgtacctatgtatccgtatgagatcgctacccggctttcggatctgggtaagctcgactactccgcccaaccggttccggggtccacgcgggaggatttcgatccgttggagcgcgaccgcctgcgcaagatcatctccacctaccgatccagcgaccgtaatcttctagagctttcagacgaggatctggaaaaatcattgcgtcttgtcgtatcggcggatggggatatgacgccgaccttgacgggtttgttgctcatcggcagggagaattcgctgcaacgtcttgtcccgacgaacgaggcggctttccaagttctggtcggcaccgacatcaaggtgaacaatacatatcgtggcccgctgctcaagaccatagagcagatagcggagtcgttcgctccttggaatccaggaacggaactgaccgtgggtttgttttcctcggtggtgcccgaattcgacgagagggcgttcagggaagcgttggtcaatgcgttcggccacagggattattcagttcttggccgtgtgcgtgtgctggtggatgacgcgggactgacgattgccaatcccggaggattcgtggagggcatcaacgttcacaatctgcttaccgcggaaccgcatggacgaaacccatgcctcatggatgcgttgaagcgaactgggctagccgagcgaaccggtcgtggaatcgatcgcattttcgagggggccttgaactatggtcggcccttgcctgactattcgagatccaacgggcggggtgtttcggtgctgctgcctcggagcgcgcccgacgaggcgtttgtggaattattagccgaggaacgcgagcgtagcggcaagtcaatgtcgcttgacggtctgcttattctggataagctcaagcgagagagacgttgtggctttgacgcgttgtcagagtccttagatatgagcgatcaacgtctgcgcactgtattggggcagttgacggagtctgggctcgtcgaaagctccggcactaacgctcgtcgtacatacacattgggggcgaaagtgtatcggcgcagcggtaaaacggtggaatatgtcagacagtcaggcatcgacagggtgcgttaccccgaattgatcatgaagctgatgcgcgagcagaagtcggtaagcaaaaacgacgtgatggagctattgcatctcgacgagaaccaggcatattaccaattgcgaaaactggttggtgagggacgcgccaaaaaggtgggtggtggtcgcaatgtacgatatgaggaaatgcaacgagacgacgatggaatatcgggcgaacagttctgattagggattatcccctgaatgcataaagctgggattcagcacagcaaagaggattttcatcgactcgttcgtcggtatgcaggaatcgccatggaattgttccatggcgattatccgttttctccggacgctcatcgtccagaccagtttcgctgattctgctccacgattgaagtgtgggcgatccttttgccctctactgatgccgttggaagggagccggcatgccgatatattcattccccgaaccacgctatatttggggcgcgggctgttcccaatccattgatatggatatgggagtagcaagcgagcatgtgtggccacacatgctcgctccacaggcgtggagcggcttgccggaagacccgggccccatggccggcaaggcatccggaccgctgacgcggcttatggaatgagccattccagttcccgtggggaggtgtttccttatgggctggcgtgacaatcgcaggcgcagcatatgcaagaagatcatgttcgcaccggaggaatgggagcaggcgaggaggatccacgagcgttgggcaaggaacatcccggtatacaggcggtggggtgacttcgcccgtcagacgctcatgcacggcgcgtcgatgaatgtctcggtgacgctggcgaacgatccggaggcgttcaaggccgagctccaccacatcggcgtgaacgtgaaccagacagcccattgcgctggcccgactggtggatcctgctcaccgccaccacgcacccggtctacctgctggcaatagcgccaaagatcagccggttcatcactggcggccagcgatgaatggcaagagcatggaggcatggcggtatctcggcatggcgcaaatgacgaattcttccataacgttcttcaggtccgggccagttgcttatagagcgtatgagcgtctgggtaaatcctgcagggcactccggcgacgttcgcttgacgctccatgatggggtcgtgcttgccatacagcagcagtttgccgggccttatcgcaaaaagcttctcggcgaagagcagatccagttcggattcggtgttcgcgcatcccaatgtgctggtggcgcatatcactccggaaggaacgcagctcaggcatgtgatggtgctgggggaaccgcatctgagattctgcacgattttgacgccgttcaccgccaatgtcgccagatagagctgattaagcagcatgattgcctgctgccattccaggtccatgtccgaagtgacggtgaggtccgagccaacggcacccatataccgcgagtattccgggatgtcgtcgagggccttctccagtcgcgggtatatccgcatgtcactggtgaacagacaaagcacggtatgggaaggattatggacgaatcgcgccttgcgatcccggtacggcaccatgagctccggccattcgtccagatacatctgcggctgaagcatcgggaaaccttgtggattgaactggatgcctttaccgctgagatagtcggcgtagcggtcgatgagctcttcgaatgatgcgatggatcggttcatgccgcccttcccacgttgggaaacttcatgacaaggacgtgcgcccccgggatttcgcatcgcagcaggcacagcacctggcgcaggcgatgctggtgaaactgctgcaccgcctggccttggaaccggggacggcaatcgtcgatcactgcgatttgacggcagccggccagggacgccctgacccgttcccagtccgcctcatcccgaacggcgaatagcaccgagagccagatgccgcgtcgcttgccattgatgtcgaacagacagtagggcgttcctgcttccggcatcaggggatcatagggaaccgtctgcgcgacggcgtcggcgggcctgccgtcccagaaagtgccgatgagatcataggtggatttcatgcttgtccctttgcctagagatcgaagacaatgccggtgcccagctcgatagccttgttggcgaactcgacgagcttgcggtagatcgtttcaagccgtgggttgatcggctccgtgagccgccattcaagccatccgagcatgagcttgcactgctcggcgttcaagtagtccacgtctccagggtcgatgagcgaattgcacagcctgtctatcgggccgatgaagtccttatcgaggagatcctcgtccccctcggttagttcgaatgattccgtctgccccggcttcgcttgaaaggtttcgggaatatagccgtagtagttgagaccttcaaggctgagaacaaggacaagttccatgatcacatttcccttctcttgagaattttgaagtgggtttctttgttgcttccaggcagaccgttgagcttgacgtttttcttcgttcttttgtcgtatatgcgcagatagcccgccaccatgtccgcgtcgattctccaccgggcgttctcgaacacgtacttgacgccccttctgcgcccctgggcaccgggagtgaaccggctgacaatgtcattgagatcgaccggctgcctcttccaactttcgttccacctcgcctcgcggtctttgcttctgtcgtagcggccctgatccaccatggagccggggacgtcgttgccgatgtagctgcgcgagctgtccgaataccgctgcttgctgtccgacatatgccatatgtcctttcctgcggcgccttgccgcatgccatcttgaagatgcgccagcattgtgagaatgcggcgtgcttcacctgtttgtatgagtgggtgggtccagacggtggcacaatgggatgtgcgagatagtccattgtgggccgtctggaccacggtgcgagaacttgccggttcgcgcaccgtttttttttattgcagaatctgtgccgggtcggcctgcttctcgtccctcctttccaagaggagtccgcgtgcgtagagttcgaggatgctggcgtcgagcgcttcgtcatcatggcgatggcgcagccagttcgcatgctggttcaggatgttagaagcgcattccagcgaggtgccgaatcgctgagagatttcctcgatggtcgtgagaccgagttcttcgatgagtacttggggtgcgatagcgtatttcgcccagaaattcgcttcgatttcggcaagctcgctgtctcggagatggcctcgcatggtgtgtcccatttcatgcaatttggtaaaacgaattcttcctgagttttcttggagattgcaggcaatgtatcggctgtcattgccgtttgcgctaatcgtgaatgatatgccacttgggcagctgcagagcgtcatcaagtcatccaaggagacagatgggttgaatgcaatctgatagggtatcgtttgaattccgtgtgcatccagcaactctgatgggtcgatgggcagcctgatgtagccgagttgctggaatgcgtccaccacgctccatttcaactcctgataaaacgacgggtcgtcaatcctatatcccgtgatgtcctccttgttcccttgcagtcaacagagtcatgatgagctcccgcgtctccgcttcgctgagatcgccgccgtgcctggcgcagtacgccttgatcgtgccgaacggcgtatcggcgtttgattcgggcaggcccagcagaaattccgatgtggtgtgcagagcggtggctatgttcgcgagcgtactcgacgtgggctcccgctctcccgcaaggtatttcgagatattcggctgggttgtcccggctcgcgcggcgagctgggactgattgatgccatgctgccgcataagcttgcgcatcctgtcgccaagtgccgccgtcatatgatgtcctttgtctttaagcctgcgaggctccttttcaattgcttcacggcaatcaatataccacgattattccaaaaggaataatcgtggtgcaacaactaatgtgctgcaagtaggaaaacgcaagataagtcgttcccaaattgttgtcaccatgttgtcatacaaggctgcaatcaggtaaataaagccgctaaatcattggtatttagcggcttttcagcatcggtcaagtagggttcgactcccgtcatccgccccaccactttccgctcccgctggcgggagctggctcgcgtcagcgagactgagggtggttttccacctatcagatagctacacgtgccagctccagcagggggctcagttgcccgcgtcccccgtatctcccgcgtcgccggccatcttaatcagctgctcgatggtgacgaactcgtacccctgcttcttgagatcgtcgatgatgccgggaagcgcctcgacgtcctgcgaacggtcgccgccgccgtcgtgcatcagcacgatcgccccgttatgcgcgcccgtcatcacggcatcatgaatcgccttggctccgggacgcttccaatcgagcgtatcgatatcccacagcacgttcatgtcgatcaggtcggacgtctcctgccactgcttcttgccgaacgccccgtatggcgcccttagcactttcgttacatgcccggacgccttcttcatgttcgaaaacccggcgatgatttcagcgcgcaacgcgtcgcggctgagtgtcggcatgtccggatgcgtgttggaatggctcgccacctgatgtccctcctccagcatgcgtttctcggcgtccgggaacgacaggcactcctcgcccacgtcgaagaacgtggccttgacgcccttctccttgaggatgtccaggatcgggccgctgtatttgctcggcccgtcgtcgaacgtcagcgcgatgaccttcttcccctccgggcgcgggttcaacggcacgacgatcgtgtcctgcggctcgacggtgacgcctttgtccacatgcttgccggaacgtttcccgacccagtattcgtgcacgccgtctttcccggcctgcttgagtatctgtatcgagccgcctgcgatgtcgatgctttcgccgtgcggcacggtctcctttctcacggtatggtcttcggtcacatcctcgcctgacgtcaccatcaccatgccatcctgcgggatcgtcgtgctgtcgattgcatcccggcgcacggcagcgccgttgatgctgacgacgatcggtttgccggcatgcttctcgatcatgtcgccggccacgtcgaccagattgcccggatgcgcgtcgaagtcgccattgtcgcgcagcagtcgtcccaacgtcatgtcgacgctgactttcatggaagtgccgtttaccgtgatcggtatctgccgccaatgccggtcccacatccaccagccaccgacactgccaccggccaacgccaatatcaccagaatggcgacgaatgcaatcagccgatgccgtcccctgccgcgccgaccgttatcggggccggctccgtactcgccatattcgttcccgcgcgtcttccccgcccggctcacactgtccccaaacgacagctcttcaatgtactgcggttcttttgtcacgtctttattttacggaggtgaagatgggggaaaggtgaggaacgggccgtggcgtgcggaggcgatggattccgcccggcggctccggccggagtagcggtggtgccaaatgttgcatggtcgcgggataatgcaggtatgacgattgcaactgccgaacgatacgctgaaatgctggacgccgcgcgccgcggcggatatgcctacccggcgatcaatgtgacgagctcccaaacgctgaacgctgcgctgcagggttttgccgatgccgagtcggatggcatcatccaggtttcagtgggcggcgccgcgtatttttccggtcagggcgtgaacgaccgcgtgaccgggtcgttggcgttcgcggcgttcgcgcatgaggtggcgaagcgctacccgcatatcaccgtcgcgttgcacacagaccattgcgccaagcagtatctggacggttgggtgcgtcccctgctggacatggaggccgatgaggtggcgcacggccgcgagccgatgttccagtcccacatgtgggacggttcgacggttccgctggacgaaaacctcgccatcgccgaacagctgctcgacaagtccgtcgccgcgcgcacgatcctggaaatcgaaatcggcgcggtcggcggcgaagaggacggtcatagcgccgaaatcaacgaaaaactgtattccacgccggccgatggcgtgaaggtcgcccagcgtctcggcctgggagagcgcggccggtacatggccgcgttcacgttcggcaacgttcacggcagctacaagcccggcgtggtcaagttgcgcccggaactgttgggcgacatccagcgcgaggcggctcaggctgtggtggacgggcgtatcgcatccgccgccggggccgtcgattttccgaacggcaagccgttcgctctggtgttccacggcggttcgggctctcgcccggaagagatcgccgaggcggtgcggtacggcgtcgtcaagatgaacatcgatacggacacgcagtacgcgttcacccgtgcgatcgccgatcatgtgttctcgaactacgatgccgtgctcaaggtggacggcgaggtcggcgagaagaagctgtacgatccgcgctcctggggccgcgaggccgagagcgcgatggcggcccgcgtcgtggaggcctgcaagcagctcggttccgccggcaaagccctgaagtgacgtcggtcgccgcggtagatgcaaccgcagctgtcgagttacggtcttccgatatgatggctgaatattgaaaaaatgcgtcggagcgggatttcccacgcaagtgcagggagagactgcaggaacttcaacaaggcaaggacggcaagttgcagccgttcgcgcccatgttgatatgggcgttgaaaaaacgaatgcggcggttaccacacccgccccagcgcttaccttcgcagtagagggcatacggtaggctgttcccggcggaattgtgcggatgcggaggtgcagtatgtccggaatcgtgttgatcggcgctcagtggggcgacgaaggcaaaggcaaggctaccgatctgatcggtaccaaagtggactatgtggcccgtttcaacggcggcaacaatgccggccacagcgtgatggtcggcgaccagatgtatgcgttgcacctgctgccttccggcatcatcagcccgaacgtcacccccgtgatcggcaacggcgtcgtcgtggatccggaagtgctgttcgaggagattgacggtcttgaaagccgcggcgtggactgcgcccgcctgctggtgagtgaggctgcacatgtcatcgcgccttaccatcgcacgctcgacaaggtgaccgagcgtttcctcggcaagcataagatcggcaccaccggccgcggtatcggcccggcctacgccgacaagatcaaccgcgtcggcatccgcgtgcacgacctgttcaacgccgagcacctgcatgacaaggtcgaagccagtctgcaccagaagaaccagattctggtcaagctgtacaaccgtcgcgccatcgacgtggaccagaccactgacgagctgctcaagctcggcgaacgcctcaagccgtacgtcgccaacaccggcctgattctgaacaaggctctcgacgagggcaagaccgtgctgttcgaaggcgcccaggccacgatgcttgacgtggatcacggcacttacccgttcgtcacttcctccaacccaaccgccggcggcgcctgcaccggcaccggcgtcggccccaccaagatcacccgcgtggtcggcgtctccaaggcgtacgtgacccgagtcggcgagggcccgttccccaccgagctgttcgacgaatccggcgaatggcttcgccagcagggccacgagttcggcgtgaccaccggccgcccgcgccgctgcggctggttcgatgcggtcgtgaaccgctacgccagccaggtcaacggtctgaccgacctcgtgctcaccaaactcgacgtgctcaccggtctcaaggagattccgatctgcgtcgcctacgacgtggatggcgagcgttacgacgatatgccgacggatcaggccgccttctctgctgccaagccgatttacgagaccatgcccggctggaccgaggacatttcgcaggtccacgagttcgacgagctgcccgccgcctgccaggcgtacgtcaagcgtcttgaagatctgagtaactgccgcatctccgtgatcggcaccggccctcagcgcgaccacatcatttccgtccactcgcttctcgactagtcgccattcggcgttctcgccgacccacggctgccgggacagagtgaatccgcgtactacaagggtttcagatcatgaatcagcctgtaccgttcgtgccctcctcgcatgacgaatccgatggcggcgacgccgccggcgcgggggacatcgaatccgtctctgccgggtccgatgtcgccgacacttccgcgccggactcgactccaagcgaggctcgcgtcctcgccgcggacgagccggcgccatcgacccaagagatcagcgcctccgaaatcgaatacgcggcgcctcggcccaccggactggcagccgcggtagcaccaccttccattccactggccccggccaagcgcgtgcaggcgaaattcaatcccctcgccgatggcatgctgtatttggtggtgttcgtcggcgggttcttcggcacggcgatacgatacgggctctcgctgctcctgccgaatccggccgcgccaagtggcctccttcattcgttccacaccgccacgttcatagcgaacatgctggcgtgcttcatcttcgccgccctgagcacgtacatgtcgcaggcggcgtggattcgcaagcgcatccgccagctggtcagccgcggtgtcggcatgggcatgtgcggcgggttctccacgttgtcggcgatgatgatcgaggatctgaactcgttgcgcgccgagaacatcgtgggattcgtgacctacacgctgctgagcttcatctgcggtttgatcatcgcgtggcttggcaccatgctgggccttgcgctgagccgaaaacgcgaggcgcacgtggtggctcgcgcggtgcgcgagtcgcaggccgccggcgctccgtccggagcagacttggctgttgaaagtcaggccggttcggaaccggctgcgggccgcgtacaagacatgccagtatccgacgaacagcaccttccgtcgttcgaaccggatccgatcaccgcggaaattccgctcaggcctgatcctgaaaccggggaggtgcgctgacatgtttgccctgatctgtatgtgcggcggcttgggcgccgtgacgcggttcgtcctgaacacctcgattcaacggtggtggaaccgcgcgttcccgctgtccacgttcatcatcaacgtgctcgccacgttcttcgccggcgtggccgccgcggcctacttctaccagacggccgaccattcgtcgtacctgctgttcgtcaccggcttcctcggcggtttctctacgttttccacggctatcaacgagatggtgtcgctcgcccgcagcggcaaatacgccgcggccgccgtgtacttcatgatgaccgtgctggtgccggtggtgtgtgtggcgctgggttgggggctgatcgcgctggtgcggtagctcgtctgcgctggagtggctctcaaaactcgcagatacaaaaacgttgttgttggaaaataggggttctgtttttgtatctgcaagttttgagagcgtcgttctgtatacaattaggcgaacagtcatattgtgacggcaaacgatggagtgggggcatggtcgggatgcgtgatgtggccaaaaaggccggggtgtcgttgagtacggtgtcgctggtggtgaatggtgccgggtgcgtgtccgatgacatgcgcgagcgcgtcgccgaagccatgcgtgcgctcaattatgtgccgaacgagctcgcccgcaacctgtatcatgaccgcaccaacaccgtcggcgtcatcgtgcctaccatccgccatccgttcttcgccacgttggcggccggtctgcagcgagagctgtcggagcgggggctgcgtaccatgctgtgctcgacggccgattcgggtactggcgaggccgagtacgtcgacatgctccgccggcatatgatggatggcatcgtgatggcggcgcacaccgagcacgctccggattactggacttcgatcggtcggcccatcgtggggttcgactgttatctcggcgagggcatcccatcggtcggctccgatcacgagcagggcgggcgactgatcgccgacctgttgattcataatggttcccggcatgtggcgatggtaggcggcccgtgcaggcagttccatgatctggcgcagacgccgactggcgaggcgcggcagacggaatcgcccgggaacaccacgttcccgaccgtgcgctattacctgacgctggagcgtgaactgcagcgtgcaggcattcggtgcgagtacatcgaggccggggaagtggcggattttcagggttgtgcgacggccatgcgcgaactgttcgaccgttttaccgacgtggatgccgtggtcagttccgatatcggtgccgcctgctgcgtgcaggaggtgtttcgccgcggcatgtgtgtgccgcaggacgtgcaggtcgtcgcctatgatggcacgtatctgaccgacatggcagggttgcgtctgaccgccgtatgccaggacttcgatgcgcttgccggcacggccgtcgcccgcatgacggatgacatcgaggggcgcccggtcgattccgccggtgacgtaatccctgtttccctgcgcgaggccgacaccactcggcgctgattgccgcgcctccgccagcgagtccagatgcggtacctacgccaaccgcttcggcgacggcaccatcgcctcgctcaccgatgtgctgcgcacccgcttcgccggggtgtacgacggtgtcctcatcctgccgttcttcacgccgttcgacggcgccgacgccggctttgatccgatcgaccacaccaaggtggaccagcgcctgggctcctgggatgacgtggccgaactcagcaagtcccacgacatcatcgtcgacgcgattgtcaaccacatgagctgggaatccgcgcagttccaggacgtgctgaagaacggcgagaaatccgagtactacccgatgttcctgaccatgagctccgtattcccgaacggcgccaccgaagaagacctcgccggcatctgccgcccgcgcggcgaatctcgcaagtcccgcgctcccaaaagtctcacgcgacgcggccggcatatcggccgtgccgcgtcgtcgtgtaatatgcgaacgttacgatagttgtatacccgtaacgagagcgcacaagagaagagaagtaaaccgatatcatgaccgatgatcagcagcaaccgaacgaattccccgctccgaagccgttgccgggcagcgtgtacattcgccccggcatcgatgatcggcctgattacgacaaggtgctcagccccgaagacaagtccgcggtcgcccgcttggccgtgcatcagccgcggcgcaaggtcgaggcgtccgtgacgcaagccgagacccaggttgcgcagatgacttcggagggatctcccgcggcggccgcggcctccgtcgacacggcggtcccggacatgggctcggcgtacgtggacatgcgcgacccggtggtcagcgccgacggccagcgcccgaaccccggtcaggtgacccgcctgtcgtggggcttcgcggtgggcgcgaccatgtcgatcgtgccatgggccgcattgaacctgctcgcgctgcctgcggtcatagcgaaagtcagctggcagcgggtctccagcgcggttgcctcccgcgcggcgttctccggtggcggccaggaactctccgagagcctggtcagtcgcattggcacggtcggcgacggcggggtggcgtcggcatgggccattgatctggccgtggttgttgtcgtgggcgtcgtcgtgtcgctgattgccgaggccgtcgtctccgcgctgtccgatcgcacgcgcgtggccgctggccggcgcacgccgtggatcatcgcgggaggcgtcgtctccgcggtgatgacgctggcgctgggactgtgctcgaacgtggtgggcatcgcgttgctgtggggtctggtgcaggtcggttatgtgatgctgaccgtgccgatggcggctgcgttcagcgagcgagtgcccgacaagttccgtccgcgcatcgtgcgcgcgcgtggcatcggccagatggtcggccaggcgctgggcgtgtggatcggcgtcgcctgcgtcgtgttcggcgggctgtatacgccgttcgccgcggccgccgcggtgttcctgctggccggcatcgtgccggtgctggtgtggccgaaggaaccgtcgagcgaggagcagccgcatacggcgatgagtgcgcacatgctgatggagcggttccgcgcgccgcggcacgccgtcgaattctggaaggcgttcgcttcgcgctccttggtgtcggctggtgtcggactgacgaccatgttcctgtggttcatcgcatcggcgctgatcttccgggattggttcacgcaaggcaactcctctccgatcgcggtaccggtgtgctcgttgatcgcctcgatggccttggcgacgctcgtcggttccgtgggggccgcgttcatcgccggtccggtgggtgagtacattgaggatccgcggtatctgtcggtcatttcctgcgtgctgtacacggtggcgttggctttgcccatgaccatgccgagcgccgtcagcatggtgctgttcgccctgatcggagggttcgcgttcggcctgatcgatacgttcggccagttgcttgcgatgggcgcgttgccggatgcgcgttcggccggccatgatttggcgttcttcaacctgtcgaattccgtcggtctggcgctcgccgcgataatcggcgcggtcggtgtggctgtcaccggcggtttctcggtgctgttcccggcggccatcgtctgtgtgctcgcgtccgcggtcgtcacgatttcgatgaagcgctagcaatccggccggattggccgctgttgcgcctcgtttgggattgaggcatcatcctatccgcgattagtcccatccgttgctgctgaaatgggactttcgcgggatggggcgtcgatgtgtctgtctgtaatgcaggcggaacgcagacaggttgtgccgacgccgccgatgttgttatgccgcggccgtccacatagtgaacctttgatggctgtcgtggaatcccgcgcctatgttgtcagacagtcgagcgcgaaagagctcgaaagacacgttcgataccgaaaggaggttcgccgcgatgactggatatgctgctgataacgccgctagcgcaaccaccgttaacgttgttctgctgtctgcacgaattattattccgtcttcgctggcggactgattcggcatcactgcttggaaccccgccaacgaaggcagggctcagcgagcaactaatcgtatagccctgcacgagtcgcggggctttttttgatgcgtcccataaggtcaccggatcagcaaagcggcaaacgagagagaacagaataaaaaatcgcgggctcgtccgcgtgcagtaacaggagctaacaatgacagcagtcacactgacagctgacggcaccacttcggtgggtggaaaagcaaaggcgatggtccgtgactcggtcaagaccgtgatcgccgcctcgatggtcggaaccgccatcgaattctacgacttctacgcctacggcaccgccgcagcgaactacttcccgcacatcttcttctccgcgaaggacaaccccaccgtcgcgctgctgatgagcctgctgaccttcgccatcgcgttcatcgctcgtccgctgggatccctgatcttcggccacttcggtgaccgcatgggccgcaagaccacgctggtcgtctcgctgatgactatgggcgtcggcacgttcctcatcggctgcctgccgacctacagtcaggttggtgtcggcgcggtcgcggtactgtgtctgctgcgtttcatccaaggcatcggccttggcggcgaatggtccggtgctgcgctggtcgccaccgagaacgcgcccgaagacaagcgtgcactgtacggctccttcccggagctcggcgccccgatcggcttcttcctgtcgaacggcacctacttcgtgctggagtcgttcaatgacaccgatgcgatgtgtgcctggggttggcgtgtgccgttcctgctgtccgccgtgctggtgatcatcggcctcgtcgtgcgagtccacatggaggagaccccgatcttccgcatggcccaggagcagaagaaagtcgtcaagtccccgctgaccgaggtgttccgcaagtcctggaagcaggtgctgcaggcgacgttcctcgtggccgtgacctacacgctgttctacacgctcgccacctggtcgctcgcatggggcaccaagaccaagcgtgaaggcggcggcggcctcggcttcaccaaccaggagtacctgctcatgctgatgatctccatctgcgtgttcgcgctgttcatcgtgctttcctgcctgtatgccgaccggatcggccgtcgtcgcgtgctgatgttctcgtcctgcgcgctggtcgtgttcgccgtgctgttcccgttcctgctggacagcagtctggtcggtcagaagaacttcgctgccaccatggtgttcctgtgcctcggcttcgccctgatgggcatcgccttcggcccgatcggcgccttcctgcccgagctgttcgacgcgaacgtgcgttactccggctccggcatcggctacaacctcgccgccatcgtcggcgctgctttcgtgccgaccatcgccacgtggctgtcgaagaacttcggcgtgcattcggtgggtctgtatcttgccgtgatggccgtctgctgcctgattgcgttggcgacctgcaaggagaccaaggacgtcgactttacgaagtgacggcgatggtcgggtaccgcccggccgcgtttgaactcccaaaaaacaacaacaatacacaaaaacaatcattcaatatttggacgtgggcaaccacgtcgcctccagtggtactagaaatgagccacaggaggggatgactttggcgcgggacacaatcccgcgtggaagccgtctgcaaccaagagggccgtcgaaagcgagcgcgttcggcggcaagacatccaattaaaggagtgcctattatggcagcaactatctggtatgagaaggacgccgatctgtccgtgttcgatggcaagaaggtcgccatcctcggttatggctcccagggccacgcgcatgcgctgaacctgcgcgactccggcgttgacgtggtcgtcggcctgcgcccgacctccaagtccgtcgagttcgccaaggagcagggccttgaggtcaagccggtcggcgaggccgtcgccgaggccgacgtggtcatgatcctgctgcccgatcagtaccaggccgccgtgtacaagaaggacgtcgagccgaacctgaagccgggcgctgccctggccttcgctcacggcttcaacatccactacggctacatcaagccttccgaggatcacccggtgttcatggtcgctccgaagggcccgggccacatcgtgcgtcgtgagtacgccgccggccgtggcgtcccggtcgtcgtggccgtcgagcaggacccggacggcaagacttggccgctgtgcctggcttacgccaaggctctgggcgccctgcgcgccggcgccatcaagacgaccttcaccgaggagaccgagaccgatctgttcggcgagcaggacgtcctcatgggcggcatcaaccacctgtgcgacctcggcttcgacgtgctgaccgaggccggctaccagccggagattgcctacttcgaggtgttccacgagctgaagatgctggtcgacctggccaacgagggtggtctgaacaaggctcgttggtcctgctccgacaccgcccagtacggcgactacacctccaccgtcatcaccgacgagaccaagaagcgcatgcagtaccagctcaagcgcatccaggacggctctttcgccaaggagttcatggatgaccaggctgccggcgccccgaagttcaaggaactgcaggagaagttctcccacccgcaccttgagaccgtcggcccgaagctgcgcgccatgttctcctggaacaacggcccggccaaggaccaggacgaagccgagtccttcaacggcaagatcgctcgtacccaggttcagtgatcgcctccgctccggctcccgctggcgggagctgccagtcggtcgcagactgactgagagcggtgcataacaaggccgccgttcccgttcattcgggagcggcggccttctgcgttgccggtgatgcggccggtaacgaagccgacattgccgcgtcctgcgccgcgtcacccgctccccacctgaactgttcatactccaatagtgagatggctcacgttgtggacggtgagggggctgtggcggcgttaccggtaggatagtcctcagttctaaggacaaaatccttaacgcttggatcgaccgggcccatgcccgaccccaaacgcgcggaatgcaggctcctgcataatgcgcaaccacaaacgacaccgtgtgccggcaagagtgccggtacgcaagtaaaggagtgccaaacatggctgcacaaatctggtatgacaacgacggtgacctctccgtgctcgaaggcaagaaggtcgcgatcatcggttacggctcgcagggccacgcgcatgcgctgaacctgcgcgattcgggtgttgacgtggtcgtcggcctgcgcccgacctccaagtcggtcgccttcgccaaggagcagggccttgaagtcaagtccgtgccggaagccgccgccgaggccgacgtaatcatgatcctggcccccgaccagtaccagcgcacgatctgggccaacgacatcgagcccaacatcaagccgggcgcggccgtcgccttcgctcacggcttcaacatccactacggctacatcaagccttccgaggatcacccggtgttcatggtcgcgccgaagggcccgggccacatcgtgcgtcgtgagtacgccgccggccgtggcgtcccggtcgtcgtggccgtggagcaggatccggacggcaagacttggccgctgtccctggcttacgccaaggctctgggcgctctgcgtgcaggcgccatcaagacgaccttcaccgaggagaccgagaccgatctgttcggcgagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcgccatcaagacgaccttcaccgaggagaccgagaccgatctgttcggcgagcagaatgtgctcatgggtggcgtgaacaagctcgtcgagatgggcttcgaagtcctcaccgacgccggttaccagcctgaaatcgcctacttcgaggtctgccacgagctgaagatgctcgtcgacctcatgaacgaaggcggtctgaacaaggcccgctggtcctgctccgacaccgcccagtacggcgactacaccaacacctgcatcgacgagcacgtgcgtgagcgcatgcagtaccacctcaagcgcatccaggacggctccttcgccaaggagttcatcgacgaccaggacgccggcgctccgaagttcaaggcgctgcaggaggagtactccaacgtgcgcatcgagaccgtcggcccgaagctgcgcgccatgttctcttggaacaaggacgccgtgaaggacgccgacgaggccaactccttcaccggcaagatcgcccgcgcccaggtgcagtgatttctgaagctgtgaggccgtaagaccgtagagctgtaaagccaggccttaccgcatgactcaggtcgttgtcttcgttgttcatcgccgaagacaacgacctttcgtttatctggtcctattaatgtgttcgtaagcaatgtgcttacgaacacattacgagtatcaagggttgctatcacgccaaattgcgtcactgtgtgcgccctcgcacacagtgacgcctgtgtaaaccctttatttttcaacggttctgcagattgcgtcactgagagaggtcgcgcacagtgacgcaatccgcgcacagtgacggtcgataaccatggttgtgtcgcacgattcgcatgtttcgtatgatcacgtgcgagttgcaggatccgacgctggtggcatcagcgccgaggctcgttcgctgtcgtcttccgcgatgcccgactcatacgcggcgccctttgcggcgttctctggcgcggtacctacgttgccgctgacgggccgtctcagcacgatcatctgccagcagtgcccggaatttcgggtgtggtctattccggcaggtggtgtcaagggctttcgccaccctttgcgcgaatcgtcgccgcccctgcgaggtcaatatatcatcggcaaagacgacgatgactgtatatcccatcgcccgcaaagcctgcctcttgcgttcatcccatcggtattgtcgtttgtcgcggcgatgcgcgtctccatcgtattcgatgatgacccgttgtttggggtatgcgatatcgactgtcgcctcgtgagccaactccggaatgagtatcttccagtgtttgaccggctgcggcaatccatgtcgcaacatcacgagagtgcagcggcattccatggtggagtcagtcacggcatcgaggaaaacgagggcatcaatgcatttccttctgcccgggaacgcgtctgctccatcaaggaaccgcgagatattggcgaccgtcatggagcctgatgacgcgcgcagtatggcatccgccagaacgattacctcgatttgcgtgagatacggcgccagcagtgcccatgtcatcagcgggtgcgtgtagacgatggtgatgttgtcgtgagtccatgtgaggtgggcgatgcccgtcaacgatggcgggcatttcaggtaggacgtatctttccgtccggatctcttggttggctccccaacgtacagtacttggaacttcacggcttcaaatcttgaacatagcggtgtctctatgcctgccagacgtaatgcggtcataccggtatagaccggtggcgaggtgttgatggtttttcgtgagtgttccatgcaatgcaggaacgtcgtggattgcagctggcgcagtgagcgcgcaagatagttgttcgcgactgttgcgctggagctgacaggggtgtgctgattcgtattcatggattgaatgtaagcatgataatctgcagtgcgccaccggccgcctcaaatctgtggataagtgtataactcatcggttatccacagtgatgtagcgaatgtggatatgtaactggcggagatgctgcgtgtggtgctgctctgcggatggaggaacgcgtcactgtgtgcggggtgcgtcactctgtgcgccctcgcacacagtgacgcccatgtaaatcccttatttttcaacggttctgcgagttgcgccactgagagagggcgcacacggtgacgcaacccgcacacagtgacggtattgcgggcttccgccgtgcacgggtacgggtatcggatcatgtgactgatccgatacccgtacccaacgcctcagagcgcctgcgggcgcaggacgagatcgaaatcgaactccgcgtcgtcgaggcggtatttctcgtgcagcttgggaccgcagctgttggacccgacgccggactgcatgtaatccacgcacaccaccgtcgaatccgccggcttcagctcgctgttgtgggccttggcggtcagctcctcctgggtgtaaggcagcgcctggaagtcgaaggcgtggtcaccggcacggagcaccagcagctcggcgtcatcgctggcgacgctcgcccaatcgcagtcgtgatggttgccgttctcctgcggcttgatatacggctcgaacagcgattcgggagtgccggagaacacgccatgatagctggaccggcgcttgtcgatgtagctttcgttcgggccgagaccgcaatatgcgatctgccgcatcggcttcggcacgaacaggcgcaggccgaaacgcggcaggaacgggaaatcggtgtcgcgcatcacatgcatgcgcagcgccaccgaaccgtcgggcgcgatggtccagtcggcgtcgatgtcggcgatgcgctgcacaatcggcgccaccagcgccatcgtcgcatggatcgtcacctggccgtcgaccaccaccgagccgtcctcggacgtcgctatggcgctcacgtcgccggcgtcgacgttgccgtcgtcgaggatcgcatcgtctccaaacgaggcgaccggcgcatcctcatcgtccgcacgcagttcaatcgactcgggcttggcgatgacgtcatcctcatcgaccagtacaccgacctcgtacgcgcgcgcctgagcgcggtcatactgggcgcgaatccaatcggccttgatgtactggtcgttgtcggtgggagcgcgccacacgttcagctccatcggcctgttaagcagcgaccggttcgcgaacgacatcgacgagaacaggccggtacggcggtcgagcacataccggaacgtcgagccttccacggtgatcgaggcatcggtctgcatgacggtcagcgggtctgccagcacgtcgtcgtagccggcatccgcggcatcgttcgccccatcgtcggcgccttctacgctatcggtgccgtcatcggcaacgtcgtcgacatcgtcatccgagccgatgccatcggcgatatcggccagcgcggcgacgaccgtctgattgcgcggatccgcggtcggcacggcgacctcgtcgaagccgagctcgaagccgatcggcagtgtctcggtgtccgtcgcctgatagtacttcaccagcatcgtcacgttcccggcctcgggtatggcatcaaggatctcagccggtacgtcgacgaccgcgtcaccatgcggcgcgatcgatggcatcgacggcgtgtaattgccgggatgctcctcccggaacgccgcgcccgccgcagggtcgctctcccacgcagcccatacggtctccacgccatccaccagcagctcgaacgtcatgaacaccgcgtcggcggcatccaggaagtccaggtaattgtgcagcgtcaccgtgcccgcggccgcgtcgaaaccggtcacgcgcaccggccgatacacgttcttgaactccagcagcccggtatgcggcgtgcggtccgggtacaccaagccgtccatgcagaaattgccgaaatgcgggtactcgcccgaatcgccgccgtacgcgtactcgcgctcgccggccgcgttcgtgccacggtcgatcgcatggtcgcaccactcccagatgaagccgccgaccaggccgtcataacgctggatgcgcgtgaaataatcctccagatcgcccgggccgttgcccatcgcatggcagaattcgcacaacacgtacggcttgacgccgttgtcgccgtcatcgccgttgctgccgtcgcgcagcccgtccggcgtgcgcggcccctcctcggagaagtactggtcgatctcctcgacggacgggtacatgcggctgtgtacgtcaagatagctgtaatcgcactcctgtccctcatccacataccgggcgctctcatagtgcgtcaggcggctcgggtcgaaggtctgcgtccacagcagcgccgcctcgaacgtacagccgtacgcacactcgttgcccatcgaccagaagatgatgctcgcatggttcttgtcgcgctccacgctgcgctgcgcgcggtcaacggtcggcgcgatccacgcggggttgtcggcgataggccggttccagcgcttgttgacagccgcgtcgctctcgtccggatgcacgccgcgcatcgcgccgtggctctcgttgtcagcctcggccaccacgtagaagccgagacggtcgtacaggtcgtagaagtgcggcgcgttcgggtaatggctggtgcggatcgcgttgacgttgtgctccttcatcagcgtgaggtcgcgcatgagctgctcctcgctgatgaccgggccggtcaccgggtcgctgtcgtgccggttgacgccgtggagcttgatcggcttgccgttgaccttgaccacattgccatccacgctgacctcgcggatgccgacgagcgcggtgatgacctcattcgcggtggtgtacacgatggtgtacaggtacggcgtctcggcggtccacagatgcgggtcgtcgaccgccagggatgcgtgcgcggtcggggcgaacgcgctgtctccggtgaatccggtgccgttcgcgccgccggcgagcgtgccggtcaccgacgcgatgcgcagtgcggcctgtgcgtccgtggagtcatcgtcgatggcggccacgtcgtcggtcgactcgatgacgccttcttcttcgtcgtccgcggcggtgtcgtcgctgccagtgccggtcgcgtcgtcggcttcgctcgcgtcgggctgtgtccgaaccgtcacgtcgtcctcgtccccggccatcggatcatcgatcggctccgaggccgtctctgccaccagctcgccatcctcatcgaacagctgcaccttgaccggcacatccgcatcgtcgaagaacgcgaaatccacgtcgaccgtcgcgtgatcgaccggcgacgcatcatattcgtcatcgctgatgccggcctcaaccagcgcggaatcgacattgcgccaaatcgacgtatgcacgaacatgtcacgaatcgcatactcgggacggtccagcagatacacgtcacggaagatgccgctcatgcggaacttgtcctgatcctcctgatagctgccgtcgcaccacttcagcaccagcacggccagcgtgttcacgccgtcctccagcacgtcggtcacatcgaactcgctggtcgaatgcgacacctgcgaatacccgacgaactcgccgttcacccacgcatagaacgccgaatccacgccctcgaaattcaggtacgtgcagggtgcgtcaggatcggacgtatgcatgaaatcgcacaggtacacgccgcacgggttgtcctgcggcacgaacggcgggtcgaacgggaacggatagtcgaaattcgtgtactggtggcggtcgaaaccatggttctgccacacgctcggcaccggcgtcgtcgtgaagccgtccgccgccagcgcacccgtggcggcagtgcgcggatcggcgttctccggtgcgtcatccccgccgaaatccacgtcatagaacacggggcggccggcggcgcgcagtcgggagacctcggcgtccaagtcgtagatgctcgcataatacttgaaatcccagtcgccgttcagcagcatgaaacggtcggaattcacgcgattctcgccgaccgtgtccatcggcgtggacgcgggcacgtaatacgcgcggttcggctgcgtgccgacatgtagatggccgagactctcgtagtaccggggaatgaacatgatggagccctccttggttgtgcatgtgccagtgcgatgacactgcacaccattatcagcgtcagcatggtcgagaagtaaggcctttgcctggcttccggcgatattcgcgggtcctgggaaggtggtctcgcgctaaaccaaggaaaatggcggctcacaaggtttgtggggacttcgttgtgacttgtgttcggcgtgtcggattatggtgggctggctctgtgcgctcgtgagccgttccggctctgttcgcgcgtgcggcggccatggctccatccgcgggatgtgcgcgactaagggcggacggtcttgcacgtctgcgtgacctggtatgcggtcagcagaatcgcaagccacaccacaccggcgatgacggcgacgcgatagctggacgagaagcacatgagcaccacgacgaatgccaggaatgcgagcactacatacggcatcacgcgggcgaacggcagcttgaaatggatgcgtcccagagcctcgtctccggtgagcccggccagctcgccgggcccgtctccggccgccacacggcgacggaaatgaatctcggtgaccatgatcatcgaccagttgataacgccagcaatcgtggcgatcgacatcagataattgaacgcgaaatcgggccacaggaacacgaccaccacggccagcgcggtgatggccgcggaagcgagcaccccgacaaccggtacgccgtggaagttgagcttgccgaggatttcgggcgcgttgccctgcctggccagcgagtacaacatgcgggagttggcgtacaggccggagttgtacacgctcatcaccgcggtcagacacacgaagttgaggatgccggcggccgcgtgcacacccaccgagtcgaagatctgcacgaacgggctggtcgtgccgtcgatcgtgttccacggcaccacggccatgatcacgccgagtgcgccgatgtaaaacaccaggatgcgccagatgatgccattcgtcgcgcggggaatggttctgcgtggatcttcggtctcgccggccgtgatgccgatgagctcggtgccgccgaaactgaacatcaccacgaccaacgccatcaacagtccggtccattggccgtcggcactttgctgcagcaggccgtgggggagtacgccgccatcgagcgcgaaccagttcgagaagctcgccttgacgccggaatccgttggcagtccggcaatcagtaccgcgagcccgctgacgatcatcgctatcaccgcgacgatcttgatgatcgcgaaccagaattcgaactcgccgaacttgctcacccccagcaggttcatcgccgcaatcacgacgagaaacaccgcggccgacacccattgcggaatcgcgggaaaccagtagttgacgaacgagccgaccacgctcagctccaccatcgacaccagaatgtaattgaaccagtagttccagccgctcacgaagccggcgcgcttcgaccagtagcgggtcgcgtagtagctgaacgcaccggccctcgggtcttcgaccgacatctcgcccagcgcccgcacgatcatgaagatagccaacccgcccacaagataggcaagcaggattgacgggcctgccaacgcgatcgactcgctggagccatagaagagtccggtgccgatcgcccctcccagcgcgatcagctggacatgccggttcttcaacgatttgcgcaacgccgccggtgccggcgtgttgccggtgccggggcgggaggccgtcgccgtgctgtcgtgcatggtgttcttgctcatcggttcctctccatcgttgccgcacgccggcgactgctcgcggcattggccgtctgcccgtcgttgacccgctcgcgcccgtcttcgacattgccgtcatcgccggtggggccgggccgtgatgccgtgatcgccgcacccgccacaacgcaggccgatatcggcacgaccgccattctatgccatccgctgacgagtcgacgtcaccgtgcgccgttttgtctcccgcatcggctcatcggggtgcgtcatgccgcggtgggcaccacggtcacggtctgagccttcctcatcgtcgcggcgtcgacttttcgtggctatctgcgtttcaagggggtgatttcgtgttcgccgaacatctatctgagtttcagggggttgccaaaacatgatacccggagtattgagcaccaattgccattggaatcatgcggtcttgagggtgtttatactcggctaccaacccctcgaaacgcagatagatgttccggaagagcgccatcaaccccttgagatgcagatagcccaattttgccgcaacatgtctgcgattgagcgcctagcatcacgtttgcataatcgtgatttactaaatcgcgattatgcaaacgatctgtgccggtgcgaagaatatgtcatgccccgtcgattccttgtgaccagcatctccgattcgtctagtgccgctgcggcactctggccgtatgatttcgggtgggtcgaggccggaatcgtctgcctcaccgggcgccgggcatgcccatggtgaagatgatgtgggcgacggtttctggtggggcggcgaggtcggtggcgagccagtactgcagcagtccgatgctgccggatacggcgaaccgcatgcgcatctgcgcttcggccgggtcgctggaggcgggctgcatctgttcggcgacggaacggcggctgtagatcaggccgagcagctgttgctggaaatccaggtcggcggtagggctcatcagcacctgcagatggttgcggttgtcggcgatatagcggcagatgtgctcgatgacgtgctcgacgccggccgcgtcaggctgcatgagcagctggtcgagcgcggtcgtgacccatgccatcgtttcgtcctcgatgtcgtgtagcagctcctcgatgctgtcgtagtgcgcgtagaacgtggagcggttgacgtccgcctgctcgcacagcgccttgatggtgatgctgccgagcggccgttcgcgcatcaggtcgatgagcgcgtcctgcatcgccttccgcgtgtaacgggtgcggcggctttcggtcagttccttggccatggctggtccttgcctcgtatgatctcgcgccggcggattcctgcccgacattcggcaatccgactgttggttgcgaaaccgacatagtgttgttttacttgagtataacatctgttgcgtgtgcggggaggtgcatgatggcgtatatcgagttcgaccgcgtggtcaaggaatacccgtccgggcgcaccacgatccgcgcactggacgaggccagtttcaccgccgaccgaggcgaactgacggtgatcctcgggcagtcgggcgcgggcaagaccacggcgctgaacatccttggcggcatggacaccgccacctccgggcgcgtggtcgtcggcggccgcgacatcaccggactgcgcaaacgcgacctcatagcctaccggcggatggacatcggattcgtcttccagttctacaatctcgtgccgaatctgaccgcattggagaacgtcgaactcgcgtcgcagatctgccccgaccatttcgacccggccgacaccctgcacaaggtcggcctgggcgaccggctgagcaatttcccggcgcaactgtccggcggcgaacagcagcgcgtgtccattgcgcgcgcaatcgccaagaagccgaagctgctgctgtgcgacgagccgaccggcgcgctcgactatgagaccggcaaggaggtcctgcaactgctgcaggacatctgccgtgacgagaacatgacggtgctcatcatcacccacaactccgcgctcgctccgatggcgcacaaggtcgtccgcttccgctccggcaaggtggtgggcgaggatgtgaatcccgcgccgacaccgatcgccgacatcgaatggtaggtgctgtgatgggacggcatgcgcataggaacaaaggtcggaaggcggacggtgattctgccgggtggtcgcccgcgtccgatgtgcccaccgaggtgattcccggaatctacgacttggcggccgacaccgatacgggcggcaggccgtctcgtgggcgctcgctgtcgggggcgttcgtcaaggatacgatgcgctcgtggctgcacgggtggaaacggtttctgtccatcgccgtgatttcgctgcttggagtggcggtgatgaccggcatctacgccggttgtcgtgacacgttccgcgccgcgaaccggttctacgacgcgcaacggttgcacgatatccaggtgctgtcgacctacggcctgaccgatgatgacgttgcggccctgaagcaggtccgcggagtcgatgtcgtgcagccggaacgcagccagagcgtcgaagccgacgtcaagggcaccgacaaaaccgtcaccatcaacgagatcggcgtgaacggcctcgaccagccgtacctacaggacggccgcattccgagcaaggctggcgaggtcgcggtcaccaaaaagttcctcgccgacagtggcatggcagtcggcgactcgctgaccgtcaccccggttgacaccggcactgcgacatcgaccgtttcggatacggactccgccgatagcggcgcgaacggcacggaaccggcggacgagcaagccgatgcatcgcaatcggcgccgagcttcccgaccgaactgaccatcaccggcacggtgatagaccccaaggacctgagcaatccggacggatacagcggcgccaaggcattccgcaactcgctcgcgtccgactacacgttcttcgcgccgagcgacggcgtgacaggagacatctacaccgctatcagcctgaccgtgagcggctcgaccgacgaggacgcgttcggcgacgactatgacacgctggtccgcgatgtcgccgaccgcatcgaagccacggtgcagaccaagcggcagaacgaacgccggcagactctcgtggacgccgcgcagaagaagctcgaccaggcgaagaccgacgcctaccggcagctcgacgacgcgcagatgcagatcaccgagcagacggaggagctgaaaacccggcgcgagcaggcgaaaaccaccaagcagagcctcgaagaccagctcacacagcttgaagaccaatcggagcagctgcaggacggcaaagaccaggtcaacgtgggactgctccaagcccgccaaggccaatcgcagctgcagcagggcatcgccaccgcgcagacgatgaacgacctggccgtgcagggcgcgcgggccgcagagcaggccgcggacgcggcagaccaggcggtcgccggcgcgcaaggtctgcccgagacggtactcgaaccattgcgcaaggcagcgaaagccgcgcacgacctcgccacacaggcacggtccaaagccgatgaatccgcggcacggctcacgcaactgcaatcccagctgagccaggtcaacgccaccatagcccaacttgaagcgcaatcggccaccttgcagcggcaaaccgagcagctgcgcggcggtcgccagcagatccgcgacggactcaagcagatagccgccggcgaagagcagatggacaccggcgaacggcagctcaaggacgcgcaagaccggcttgacgccaagcgcaaggatgccgacagtcagttcgccaagcagcagcaacgcgtcgacgacatcgccgcagcccgctggtacgtgcagacgcgctcgtcaatcggcggcttcagctcgctcaaatccgacatcagctcaatcgaatcaatcggctacgctttcccggtcgtattcctgattgttgcggtgctgatgagcctgaccgcgatgacccgcatggtcgaggaggaacgcggtctgattggcacctacaccgggctcggttacgggaacgcggccatcgcgatgcgatacgtgctgttcgccgcgctcgcctgcctaatcggcggcggactgggactgatggtcggcttcctcggcattccgtcgttcctgctgctggtgatcgagggactgtacacggtgcccggcatacagctcgaatacgattggctgtacgggtcgacaggcatcgcgctgttcgtcgtcggcgtggtcgtcgcaacggtcgtcgcctgcgccggggctctgcggcaaagcccggcgcaactcatgcagccgaaagcgccgaaggccggcgcgcgcatcttgctcgaacgcatccgcccgctgtggcggcggctcagcttcctcaacaaggtcaccgcgcgcaacatattccgcttcaaaagccgcctgttgatgaccgtcggcggggtggcgggctgcacggcgctgattgtgtgcggcttcgccatcaacgacaccgtcgccacgctcggacccaagcagtacgaggacatctaccattacgacctgctcgtcgtcagcggcgacgacagcgtcgatgcgatgcgcgctcggctcgacaaggacgggcgcgtggaacgttcgctcgatctgcggctcgacagcggcgagatggacgcgggcgacgcaggcgagacgattcagctcatgatcgtgccggatgattcagcaggggcgctcggagacatgattacgctgcggtccgcgagcggtgggcatggcaagctgcagcttgggggcgatggcataatcgtcgcgcaatccgcggcgaactcgctcggcgtcaaggccggcgacaccgtcacgctacgcgacggcagtatgcgtcacggcgaagtgaaggtctccgcggtgacgcgaaacctcatcggctcgaacgtgtatgtcagcgaaagtctgtacaagaaaacattcggcgtgtcggcggcggtgacgcacaacgccgtgatcgccacactgaacggaaccgccgaccagaacatcgcgtacgcggatcggctcgcacgcgatccgtcggtcgtgagcgccaccagcaccgacgatctcgagcgcagcttctcgttcgacctgatgagcgccgtcgtggcgctcatcatcgcgctcgcgggcgggctggcgctcgtcgtgctgttcacgctggcgaacacgaacgtgtctgagcgcgtgcgggaaatggccacgctgaaggtactgggcttctacgaccgcgaggtgcaccggtatgtcaacaaggagatgctgatactggccggcatgggcatcgtcgtcggtctgccgctcgggcgcgcggtcggcgggctgcttacggcggcgctcaacatgcccgcgttgtatttcgaggtgagcgtgcactggtatagctatgtgatcgccgccgcggcgacgatggcgttcgcgctgctcgtgcagctgctcaccaatccggtgctcgaccgcatcgatccggtcagctcgctcaagtccgtggagtgagccgcccgccaccgccctacttgtggtatggctcgccggcgttgattttgtaggcgcggtacagctgctccagtaggatcacgcgcatcagctgatgcgggaacgtcatcttcgagaagctgagcctgtagtcggcgcggcgcaggatcgcgtcgtccaggccgattgagccgccgatgatgagctgtatgtggctttcgccgtgcaatccgagctggttgatgtgcgcggcgagcccttcggaggagagcatcgtgccgtcgatcgccagcgcgatcacataggcgtcggggcggatgtgcttggcgatgcgcccgccttccttggcacgaatctgccgttccacgccttcgctggcatgttcgggggtcttctcgtcggcgacctcgatgatgtcgagcttgcagtagcggccgagccgtttgctgtattcggcgatggcgtcgcgcagatactgctctttgaccctgccgacgcaaatgacgctaatacgcattatcctgctttctatctgcccggaggattacggaagatacgccgtcgtactactccgagagtcacggcacgacgataccgcgactctcagagtccctcggtgggggattggctgacgctccgccagtcaatcccccaccgtcggcattggttgatgtgtgcggatacggccgttcaaagccgaaggcgtatttcgtacgtcgagcgctgaggaaaggccgtatacgctccatcaatcaatgacgccgtagaggcggtcgccggcgtcgccaagccccggcacaatgtacgccttttcgttgagtttttcatcgacggcgcagacgacgaccttgaaggcgatggaggggtcgatgtggtcttggacgtattggatgccttcgggggcggcgatgatgttgatggcggtgacgtctttggcgccgcgctcggcgaggtagtgggtggcggtgacgagggtgccgccggtggcgagcatggggtcgatgaggaagcactgacggccggtgaggtcttcggggagacggttggcgtaagtgatctgctgggtggggtgctcttcgtcgcgcttcatgccgaggaagccgacttcggcggtggggatcattttggtcatgccgtcgagcatgccgagtccggcgcgaaggacgggaacgatgatgggggcggggctggcgatgtgcttgccgaccatgggggcgacgggggtttcgatgggcttgtcgacgatgtcgaggttgcgggtcgcctcgtaggcttcgagcatgacgagttcggtgacgagctcgcggaaagtggcggatgaggtgtttttgtcgcgcaggacggtgagcttgtgttccaccagcgggtggtcgagtacgtgaagttccatgagtaccagcgtacccggttatctcacattctggatggacatagcgtgttgcttatgtgacgtagcggtcaagatgtgcagtgaggtcggactgcaggagccgaaggcggtttcgacggcgacgacatcaccaaggccgcgccgaaccagcgcgtccgcaaaggcatggcgttcgtgccgcaggggcagcagtcgttcggcacgatgaccgtcgacgagaacctgcatgtggtcgccgaccggtacgggtccgaggcgaaaacgcggtacgacgaggccgtgacgatgttcccggtgctcaaggaattcgccgtcgaacgggcggatcgctactatgtgctggcctccgggcgcttcatcgccaccggcgaaggcggtcctgcacaggttgaggccaccaaagaggccatgcgcgtataatcgcgctctcaaaactcgcagatacaaggctcttttcgagcgtcaatcgttatacctgcgagttctgagagcgcctattgcagagccttcatcaaagaagccacatgaccctttgcccggacgttgtaacgggcgatttctatcgtgccggctgcgcctgtaacaggcacgctgatgacgaatgtcgagcggatcacgcctatgtgcgtgcgcccgtagagcttcttttcgccgtacgcgccgtaaagccgatgcacggtcaggtctgcgtccgacagcagcgggaacgacaggtggtcccgctcgcggaaacgctgcagcttgtcgattgggtccttggagacgcccagcacagtgaaaccgagtgcggtgagccgggcaatgttgtcgcggaagtcgcatgcctcggtggtgcagcccggcgtcatcgcggccggatagaagtacagcaccacgcgcttgccctgcgccagcagccgcgacagcgtgacggaggtttcaccgccgtccgggttgaccgcaggcagggtgaaatcaggagcgggctggccgggggtgagtcgcgtgggaagggcgggctggctggattgtccgggctgcggtgattggtcgcttgcgtgattttctgtcatgatgcgtgctcctttacctcgatgcccatgtgtgccaccactatcgccgtcgtggtggacagtcgcgcgaccgcgtatagtcgaatcatgcaatggctgcacaggataggcgaggcgattgattcgctggttgcatggtggcggcgctcgctgatcgggcgggtgattgaccggtatgtgtcgcggcgcgggccgctgctggcgaacgggttggcatatgggctactgttcgcgttcttcgccggcgtatggatcgtggtcagcgcgctcggactggtggtgaccgggagcgaggagatgcagaaggcgctgctcgcgatgctgcgcacggtgattccgagcgtttccgattcgctgttttccgcgtcgatgctgagtggaatctcgcatacgctgacatggaccggtctggtgacgctggcggtgttctggtggacggtcaccggttggatgaattccctgcgcaatgcagtgacgaccatgttcgacgattgcacgcaggagctgaacgtggttaaggcgcgattgcgcgatacggtcgctgcgatcatggtggcggtactgttcatattgtcgaccgcggcgggcgtcgtctctggcggcctgatgagactggtgttgcgggcgcttggcatcgccgatgattcgctgccgggcgcgctgttgctggaatcgaccggtttcgctaccggcgtgttgctgaatttcgcgttgttcatgctgctgctgcgcgtggtcgcgcacatacgcgcgggcaaattcacgctggtgggggcggcgcttggggctctggcggtcgcggtgatgcagctgctgggcgctcgtctgttgacgggtgcgtcgcgcaacccgatgctggcgccgttcgcagctatcatcggcgtgctcatctggttcaacttggtggcgcaggtgattatgatctgcgcggcgttcatcgccgagtgccggcggggggggggcggggagagccggagctagctacatccgctgtcagccgacagggtaactggcaccaagcattgccggatacgatatcgtatgagacggctgcgagcttcatcgcaggtcgcaaggtgcatgtctttcatgagatgtgccgtagagcatatgacgagaggagagttcccatggcgattgatgtatatggtgcaacatggtgcggcgactgccaccgtgccaagaacgcgctcgaccggttcggcgccgcttacacgtggcacgacatcgagcaggaggagggcgcggccgaccgtgccgttgagatcagcggccaaaaacacatcccggtcgtgctctatggcgacgggtcgttccaggtcgagccgtccgtcgtggacatccagaacaagctcaacgagcttggcctgctcgggtgagcggtgagtggctgcggcggtggcgaggtgcggtatcggctgtccgccattgaacacgatgcatcaattcgcgccttatggtcggcgcttttgcaaagtgaggacagcatcgttgcttgatttgaccagattctattcgtaggcagaattcgaattttggtagttgaatggttccgggagtgctgggacagtgaatgattcgacgatctcggggatgcggctgtgggaggcccggaagatccatcgtttcagcttggccccggcttgtccggtgggctggtgcgggagcgtcccgaggagttccttgagttgccatgaccggtagggctggcccctgggatccgtgtcctgccgttcggtgagatcctccgggttcttgggcacggcgtatctgacgccgcgcatcgcctcggtcgccgtcttgtcgttgccgcgccgggcctggttccgcacccgtttcctgacctggtcgggcgcgtcgctcatccgggagacgatgtggaacgagtccgggacgcgcccggcgttcggcaggcgctccttcacgctggcgtcgatccacttggcgccgtcgccggtgactgccttgatggaggcgcgctgctcgtcggtcggctgtcggaagaacaggccgggcacctccttgccgtatccgtcgtgcgcccagacgacccgtctgcgcttgtggtcgacgaccacggtgatgtacgtgtgccccccttcctgcagctggtctcgtccacgcctatcgcggtgggaccgtcgaacatgcacggcatcgaggattccaagcgggcggcgaccctgcgcgcgatatggccggccgtcctccacgcgatgcgtgggaatccgcccacggtcttctggctggcgaccgccgccggccacgcgcactccatctcgaaaccactggtgagccggctgtccggctccgccacggcacttgggcggccaccacgccatgctccgcgcacgccacgcgcggcgccaggcccatgagctcgaccccatagcagccgaagtcctggtggcgccatcgccgttcgccgccacccctcccatataacaggcccgtccgctataaaccgcaagatgaggtccacagcggacgggcctgttcgttcatatggtcggcggtcatggacatgccccatgcctactccggcaacgaggccggaaccggcggtaccgccacgacacggcaactcgaccggtatagggacggtccataacaagttcatacggttcatcgcacattgaacatcagttgaacgacgaatgatatttgatgcgcgcaccatgaacagtgcctgaatcagccatcgtctccgaaaagcggcggatagccttgtaaaggccatgatgcgtaggcgcattgcaacggcacattcgcatcgtcgttgaaataggagagtgctagggagagcctggtcatgcatataggaaagatacgcaatatcatcaaaccagcggtggcgtgcatagcgcttgccgtgttcgccgcgccgggtacggtagtctccgccgcggcgcttgaacgtgaaggtgccccattggatgtggtggccgattggaaattccagcaggcgcattccaccggttccatcgacggtggtgacctggtcatcaaggatatgtcgggcaacggcaacgatctgcacatgcagacctacgggaaaaatgattacaagctcagcgactatgtcaactggtcgtcgaattcgatgaacggtgacggtggtggaagcctgaagctcaacggcgacagcgatctggcgcataagaaggatcatcccgagcagcgagatcccaagggcgcggatttcatcaccgcgagcggcgctcccatcaacaaagagcaatttgccaacggatacaccatggagttcgtgtactaccttcccgatgacttcaacgccggtaccgattcgtggatggggcttgcggccaggcaatccacaaacagcaacatggatgaacacgagatggggtcgatgagcctgtcgatctccaattgcaaggaaacccagttcaaggccgccaacaaggacaatgagtcgaccatgaacaccgatgatcccaacaacggcgtcaccagctggggcgtcaccatggatcacggtggcgtttggtatcacatcgccgtcgtatccgatggcacgaacgtggtgacatacaccaacggtgccaaagcattccgcaatatcaacaagaacggcaatggcctgtatgccgatccgaccgatggtcgcttccgcatcggctcgtcgtattacaacgacactttcgacaccagccaatacaacaaggacgactttgacaagttcctgcgtggcaacctgcaggaggtgagattctcccgcggtgcgctggcacagggcaactggatcgtgcccaacccgaccgagtatctcaaggattacggtaccaacgatcgtttcgtgctggacaaccccagcgtacatacgatggctttcttgccggacacgcagaatgccatccgttgggtgcccacggtgatggaccgagccatcgaccagttcgattcggaagattccagtcttaatctgaccaacatcgtgtccctcggtgacgtggtggataactgggacagtgacgcgcaatggcaggcatcgtccaaggcgttcgggcgtatgcagaaagtgggcgtccccttcctggagcagccgggcaatcatgattacaatggaggcaggcatggctacggagtgcccagcttgcgcaaggcggacaattacctgaaacacttcggacccgactccgatttcggcaagtatcagaaagaacacggttttgcatactcgcccgatggcctgtcctcataccatctggtagacaacggctcctacaagtatctggtgatgaacatcgacatgggcgcggtggtcagcaactcgtcctcggcaagcaatgacgatatgcgatggttcgagcaggtgctcaaagaccacccgaacaacccgactgtggtggtgagccacgatatcttcaagtgctccgattcacgtccgaatgaaatctccctcgatgacgattccggatacaacggtgaagccggtgacgatgaaggtgccggctcgaaaatctggaacatcgtgaaacggtacaaccaggtattcatgatgtactccggtcacaatcacggatccggacaaatgaccctgaccaatgacgccggcaatccggtgctggggctgttgtccgactatcagttcgcgtataacggcggcaatgcgttcttccagtacgtcggcatggatgaagcgaacaacaagatcaccatgcgtacgtattcgccatactcggcatcgctgcccgcggccgagcgttcgttcttcgatgtcaactccctgaccggtgtcggcaacacctatgacggatcgttcgatttcgccaaacgattcgccggttacgaacattcctccggttatgacacgcagcagtcggtgatctccttggtgcgcggcatcggtgcgttgaatggtcagacgccggcgagcgaagtacggcaactatatactgctctggccgcattgccggataatgtgaaagcgcaattcggtgatccgtcggatagtggctctctggcaggcagactcgccgccgcatacaatgccgcgttccccaagccggaacagcccgacaccaagcccggtgccggcaatcagactggaagccaaggtgggcatcagggtggacagtccggaagccaacaagggcagaagggcgatggccatggcaaggggcagacgaatgccggcccggaggcaatggcctccactggtgccgatgtggccccgatcgtcgttatcgcgatgatgacgatcttgttggccggcgtgcttgtgctcgtgaagcgtaagcatcacctttcgcactaaccgattaccggtgtgcaacctgtcgacgagcgagcagccaatagctgggcctgatatagaacccgcggtactggttgctcgctcgtcgaatcaaggaaaaccgaagcacgcttcgcgccaatgccgaagacgccgatggcttgccgtgtcgccacctgcgcattggcgtcatgattgtcgtgatcgtggcctacgtgatgttcggcccgtttcgcggcgacatcgttctggtctttggcgcgtcggcgatcttctacgtttccggtacgttcgcgtttccggtacgttcatcatgatgacggtcatcctttccctgaccggtcccatcgagcacggtcaggaagagcggcaagccatcgaggtcggaaccggcggtgtgtcacctgtcggccaggagcctccatcaactagtatcagctagtatccgatatgaagccgtggcctcattgccaatcgccaagggaggaaaccgtgcgcgcgcgacgtgactttgcatggccgaaactgctgaccgcggacggacgcggcatcgccttcggcggcgactacaatcccgaccaatggccggaggacgtctgggacgacgacatccgcctgatgacccaggccggtgtcaacaccgtggcccttgccatcttcagctgggaccgcctccaacccaccgaagaccattgggattttggctggctcgatcgcatcatcgacaagctcggcaaggctggcatcgcggttgatttggcatccgcgacggcgaccgcacccctgtggctctacgaaaaccatcccgaagtccttccgcgagacaagtacggtcatccggtcaacgccggctcccgccagtcctggagcccgaccagcccggtgttcaaggaatacgcgctaaccctatgccgcaaactcgccgaacgctacggcgccaacccatatgtgacggcatggcatatgggaaacgagtatgggtggaacaatcgcgacgactactccgacaatgcgctcgaagccttccgcgcatggtgccgccgcaagtacggcaccatcgacgcacttaaccaggcgtggggcaccacgttctggggacaggagatgaccggtttcggcgaagtgctcatcccgcggttcatgggtgccgattccatggtcaaccccggccagaagcttgattttgaacggttcggcaatgacatgctgctcgacttctacaaagccgaacgtgacgcgatcgccgaaatctgccccgacagacccttcaccacgaacttcatgatctccaccgaccagtgctgtatggactacgccgcgtgggcggaggaagtggacttcgtatcgaacgaccactacttccacgaaggcgaatcccatctcgacgagctggcctgctccgacgcgctcgtggattcgctggcgctcggcaaaccgtggtacgtcatggaacattccacctcagcggtgcagtggaaaccgctgaacacccgcaaatgtaaaggggagacggtgcgcgactccctggcccacgtggccatgggcgcagacgccatcaacttcttccagtggcgcgcatccgcgttcggcgccgaagcgttccattccgctatggtcccgcacgccggcgaggacacgaaactgttccgtcaggtgtgcgaattgggcgcgacgttgcgggcgctcgccgacgccggtgttcaaggcagcggattggcggcatcggacacggcgatcctcttcagcgccgaatcggagtgggccacccgatccgagacattgccgagcatgaaactcagccattggcatgatgtgcgtgactggtaccgtgcgttcctgaacgctggtgcacgcgccgacatcgtgccgctcgcctacgactggagttcctataagaccatcgtgctgccgaccgtactgatactgagcgacgccgatacgcggcggttggccggtttcgtacaggccggaggccgtgtggtggtcgattacgcgaccggtctgctcgacgagcgcttccacacgtggctcggcgggtatcccggtgcgggcgatgggctgttgcgctcgatgctgggcgttcgtggtgaggaattcaacattctcggtgctggggcggaaggcgagccgaacgagattcggctgacgggcaccagggattcatccacgatggacggtgccgtgacccgcctgtggcagaacgacgtgaccgtcgccggaccgcatgtgcaggtgcttgccacatatgccggcgaagaagcggatgagtgggagcttgatggcacggccgcgctcacccgcaacgcatacggcgcgggggaggcgtatttcctcggctgtgatctgggcgtgagcgacctgacgcgattcgtgagcggctggcttgccgtgcagccgcaatcctcccgtcagccgcaggtcaacagtcagtcgcaatccagccgtcagccgcaagtcgtcggcgcgacccctgatgttctgcacaccgtgcgtcaatccgacgacgccatattcgacttctacctgacacgtggcagatcggatgtcgaactgcgtggcatcgccggggagccgatcgtcctgttccgggcggaacggggcagtgacggcggtgcgtatacggtgcatcgcaatggcgttctcgtggtgaaacgcccgaacccgtcgctgtagtcaattgcggcgaaacaagggaatgggggcgcggatggttttgggaaacggtccgcgcccccctacagagattccggtggcgactggctgtttccggctctatttcaacgtttttggactgccgcttaagtgcctggccgcttaagtcgccgctccttcggcgtgccgcgacgggccgaaacggatagttggtgtagcagggcagcctgaggttgtgtcttgctggtttgggaaaatgatggggaaggaatttggccgatactctggtgcagcgaggagtgggccggggagggggtcctccccggtgttgttatgcggcgttggcgaggaagatgtgcttgtggtgatactcgatgaactcatgcgaaggttggctgattgccggcaatgagatctcatgtccatcgaagtcatagagccatctgtcgttgatgtcggagtgccgcaccttgtcatggttgaccatgatgcggtagtcgtcatcgatggagatgaggccttggtcgaaggcccgatcatggaaggcgttgagcaacagcccattcgatgcggcggttttctcgttgggcgtcgatgccttccaaggtttgatgtgactggcgatcagtagtttgggaatctgcatgccggttatgcagcatgtgccgtggtagttctgcaatagtgaattgcggaaataggattggttgacccgttgaagtatggttgccggtcgctcctctccggtgggcgcgtgttcggcgatgaacagggctgttgctgtttcgagcggcgaacaatggatggtacgccagaaagtgtgcccatgtatccgtatgagattgccacccgtctttcggatctgggcagacttgactattccgctcagccggtgatggagtccacccgggatgatctcgatccattggagcgtgaccgcctgcgcaaaatcatcgcttcctatcaatccagtgaccggaatcttttggagctttcggatgcggacttggagaaatcgctgcgccttgttgtgtcggtcaatggtgagctgacgccgactttggcagggttgctgcttatcggcaacgaagaagcgctgcagaggcttgtgccgacgaatgaggcggcttttcaggttcttgtgggtaccgacatcaaggtgaatcagacctaccgtggcccgttgctcaaaaccatagaacagatagccgagtcgttcaagccctggaatccaggcacggagctgaccgtgggtctgttttcttcggtggttcccgaatttgacgaaagggctttccgagaggctttggtcaacgcattcggccacagggactattcgcttcttggtcgtgtgcgggtattggtggatgatgccggcttaaccattgctaatcccggtggattcgtggaaggtatcaacgtccataacttgcttactgcggagccgcgtggccgcaatccatgcctgatggatgcgttgaagagaaccggtctcgccgaacgtacggggcgcggcatcgaccgtatattcgagggtgctttgaactatggccgtcctctgcctgattattcgaggtccaacaggcgtggagtgtcggtgctgttgcctcgtagtgtgcccgacaaggcgtttgtggaactgctggccgaggaacgtgagcgcagcggcaagtccatgtctctcgatggtctgcttattttggacaagctcaagagtgaacgtcgttgtggctttgatgtgttgtcgggctctctggacatgagtgaccagcgtctgcgcaccgtactggggcagctgacggaggcggggcttgttgaaagcgctggcgttggagctcgccgcacgtatatgttgggtgcgaaagtgtatcggcgcagcggtagggcgatggaatacgttcgccaatcagacatcgatagggtgcggtatcccgaactgatcatcgagttaatgcatgaacagaaatcagtgagcaaaaacgatgtgatggaattgctgcatcttgaggagaatcaggcgtactaccaattgcgaaaactagtccttgaaggacgcgctaagaaggtcggcagtggacgcaacgtgcggtatgcggcagtacgttgaatgagatacgcagatcattcttgaacggttttctctgaattccgagatttatctctgaattcagagaaagaatatcggaattcagagaaaactagtgtgcgatgtggctattccgcttcaggaattatgtacgattcgaacgtggcctgtatctgcgatgccgtcagccgctttatcggtatgctccctatgcggggcttgatgtggttcccgtagctgttcccatagcgcgtccttgtgctgtcggcgatgttccagatagttcacgtcatgctcccttgcgtgatgattcacatgattcgcgtcttcatggtagcgtctcccgccggcgcatgagtgactggtcacgctgtcagtggaatctccccgacggatatcccgcctatgcgggatatccacgccggcgtacggagattcgcatgttcgggcgtacgatggacccggtttttgcaggatgcggccaacgccttggatgggcatgggcctgcaaccatcgtgagccgccacgggcgttcggcgatcgccgggcggcggatcgagaaggatcgggcgatcggggccgcccaccatccgaaaccatcgtcggcgtcgcttcagcggggcatgccgacggttcgcgttttccggcaaagggtcggccggcgctttcctcattgaagttcgacgggtcatggtcccgccgtgagggttggaccggtaatcgggtgatgccgaacgtcccgacgggacggcggccgtgtcatcaaagcgaccgcacgaactctccgcccggaagcggacggcgctgattttggatgacccatcggccgtggcattcccgggcccggaacatgccatggggtttgcggaccccgggcgacgccgcatggccttcccgttcccgcgccacgggcggcggcatggttcatggcgccgacggtgggtccgtccgcacgcggagcgcttccatgcctcgctgacggatggtggcgatccccccccccgcggagaggagtattgtttcatttgtagataacattgttacacagtaggagaacattgatatgcaatctgaacgttcgttgattcccacccccatgccggtccggagacacgcacggtccgggaacagggggctggccctcaccgccctgtgtctggcggtgctgctggtcgtgatggacaacaccatcgtcaacgtcgcgattcccacgatgagcgacgcgttgaacgcctcgtccacggacctgcagtgggtggtggacgcctacacgctgtccttcgcggcgctgctcctgcccgccggcaaactcagcgaccgatggggaagaagacggatgctgctcgtcggattggcgggattcgccgtggtctccgcagctacggccttctcctgggccctgtggcagctggtgacgctgcgcgtggtgttgggggtctgcgccgcgctgatctatccggcgacgctgtcgtcaatcatcgtcatcttcgaaggctccaggtaccgtagcctggccgttggcctgtgggcggcgacatcaggggtcggcatcgccctgggcccgatcatcggcggcgtcctgctggagcactatgcgtggaattccattttctgggtgtgctccgtcatcggcgtggtggcgctggcctgcatcgcggtggcggtgcccgaggtacgggcgtaccgttccgagaggttcgatttccccggcaccgtgttatcggtggccggcgtgggcctgctggtgtgggcgatcatcgaacgcccgacttacggctggctctcctggcaggtcataggcggcatctgcgcggccctgatcatacttgcggtgttcgcggcggtcgaggggcatacgcacgccccgctcatcgatgtcggcctgttccgaagggccacgttcacgagcagcacctgcgcgatctgcgtcgcgttcttctgcctgttcggcttcatcttcatcaccacccaatggttccaggcattgcgtggatacaccgcattgcagacggcggtcgcgacgctgcccttcgcggtggtcatggcggcggtcgccccgttcgccacgcaattggcgaaacgtttcggataccggtcggtcgtctcgacgggactgctgttcctgtcggcgagcatgttcgtggtcacgcgtgtcgacgcccattgcagctactggttcgtggtcgtacccaccatggccctgatggcggccggcatcgccctgatccaagggcccgccacggacgccctgatgagcaccgttccggaaagctcgaccggcgccgcatcggctgtcaacgacacgatccgtgagatcggcggcacgctgggcgtcgccgtcatggggtccgcgatctcctccgtctaccccgacgagctctcggactcgttgtccggactgcagatcccgtcttccatcgcgaaagccgcggaggattcggtgatggccgcgaaatcgatccttccgcacctgccggcaggcatccgacagaccgtggagcagtccgtctcgaccagtttcatgagcgccacgcatgcggcatgctggatcgcctgcgccctcgcattggcgtttgcgctgctctgctggatcacacttcccaaacacgattcaggcaatctcccccaatagaaaggaacatccatcatgaaagacgacggacggatcccacggatcaaggacacggatatgacggaccgtctcctgacggccggcgcgatagcggaggacacacgcaaccccatcggtgacatcgcggcatgcttccccggtcacggcagccagagcgtcggcatgttccacggctgcctgtccggcttccccgaagcccggcaggtggattggcaacggtgtgttggacggtttcttaggggacgagtccttgttgtgtgaattcgttggggctccggtatccgagggtggagtggagtctttggttgtcggaccaccacacatagtcgtcggggtcggagcgtagttgttccaggctggtgtagtggttccggtatatgggctccttcttcaggagcctgtcggtggattcgaccacggcgttgccgaacccgccgccccggtccgtgcggaacacctccacctcggtcagggggaagccgagcgtggcgaacgcggccatgaccaggccggcggcgcggcccgtgtcggcgccgtggccggcgatgcccctgttcgccaggccgatgagcaggcacacgtacgcccactcgccgccgacgcgcacgtacgtcaggtcaccggccaggtgggcgcgcggcccgtagccgtcgaactcgcggtcgaggatgttcgcgagcccggcctcgtcggcccgcgtcctgtgcggttcggacgttctgcgcgcgtacgcgcccgccatgccccgccgtttcatgatgttgacgatgcgccttccggaggcggtgacgcccctccgctccagcgcggccttgatcttcccggcgccgcagcgctcatggccgtcgcgccggaccgcgcgcacgtcgccggcgatcgggtccacccgcccggcttcgggatgttcgatcatccagtagcaggcggagcggggaacgcccggcatcctgcactgcgccgatatcggacagcgggaggcgtcggcccgtatcactgctaccttcgtgcgaataccggcgccgcctgttctgaaacgtccacctccatctccaactgtccgttgcgcttgcgcagctcgaccggctcgttccgctcaggggtgcggttgtcggcggctttcgcggagccgctgtcgcggatgccctggacccaacggtgcagcgtggaacgcgagatgtcgtactcgtccttgatctcgcgcgccggcttgccgttctcgtaaagccgcacgatccgccgcttgaacgactcctcgtagtggcggggatgcctcgggtcggccatcgtcggcctccaacctcatgtcaatcgacccccatcgaactgtctaacacattgtagccaatccatgcgggagctccgcattctgaaggacgccctgcggcaccaccggtagccgacgggcatgcctgacgtgcgtgcgggacgatgccacggtgccgccgtcccacacgccgacggcatcatatgcgcgatgccccggcatggcacgcggcgggaggacggcacgcccgcgccggccagcgttccccgacatgtcttggctcggtggcaatctcaatgcggtgggactagccatcacacccatcgaggcgcggtccaagagcgtggctggaccttcgaccccacccatcatgggacggtgcagggacctatgggccggatggcgtttttcatccgtaacggcgggatgatgcggagaagcatatgaggactattcggaaaacgacaaaaagccagcggacgcccaccaccgagatcaggggcctcatactcgacgcctcgaaacgaatcatcgaagaggacggctatgacgccttcaccatccggcttctctcggaaaaggcggatgtgtcccccgcgagcatctaccggcatatcggcgacaagcaggccgtcatcgacgctctcatcgacgacagtttccagacgttacgggagaagctcctgcgcgtcaccaccgaggatcccctgcaaagactctacgatgcgggagtcgtataccgcgggcacgccaaggcgtcgcccggcatctacgccctgttgtggcgatggcatgcgggcgaggcttcggaggcatgcctcgccgccatgaccgagctggtgcgctacgggcaggccgcgggaaagatccggagggatgacccgcacctcatcgcatggtccatatggtccgccgtgcacggattcgtccaattcgagacacgacccgaacatgatacgcccgtcgacgatgacgatgcggcctattcctttctgctccggctgctcattcgaggggtccgcacccctcagacggtctccgagggaacggcgaccatcgcggataccagccgatcgtagaatcgccattggccgcgcaacgccacatcccgtctcacagcggcgaacgttccatccgccttcaggctcacggataccttacggaagtccccgtcccgtccaatgcggacaacgccttcgaggcggcctccttcgcgcagaaggccgccctacgttccaccgaggagaccatacgcaatgatgcgagctcttcggaagagaacacgaaccgcatgatcccgtcggacaatccgtccgaatcgtccacgtccactcccacggcacggattctttccgccgacgccacggcggcgacgcacagcgacgggcaatgcgacagcgatcccacgatgccggacggccagagcggttcaccatccgaacctttgagtatgggcccgtcatggccgatacgtcgtaaggcctcgtgggccaaaagacgcgtctccgtgaattcccttcttcgtttggccgtggcgttcccgaccaaggcccgctcaccgtcgaacaatcgcacgcggcgcgtccccttccccgagatcagcacctcgcagccggaggcgagcagcggcccgaacaggcgagcccgtcgcatcatgaggtctgcgcacatcatggagactctatataccgaaacccacaaacccagcaacggcaaggctttctaccaattcccagaatgagtgtaccactctgttcgccgctcaaagcccgccagaaggaaatttgcgcttttccataccttcacgccgacaagaggtgtcacgattacctatatctcccatactttctatgttttcttgtgtaggaaaatgtaaaagtgtaaacaccgtcggaatcgacggagacgttctcatatgacacgccgatcgatcatcgaatgtcatgagtggctcccttcagacatagagtggtacaccgatttggcctaccggatgcaccacgtaacgtgccaccgatatcgtcgggccgaacaccctctgaagacactacaaggaaactattccgacagtccaagccgttcggaatcgttgaaaggaaactgttttcggcaaaagaaaagggctttcgaatttcttcgaaagccctgctagcggaggatacgagattcgaactcgtgaggctgttacaccaacacgctttccaagcgtgcgccatagaccactaggcgaatcctccattacgctgtttgccgcggccttttggcctcaacagacaactcgaagagaataccacagactcgcggacaagcaaaaccgtcgcgtgttgtgcgtgtgtcgcgcttggcggctcgcgcgtccgggatccctccggcgctccgatgcccgaattcagtaattgttcgagccggcaccctcgaagcgcacgttgaagccgcgctcgtagtgcaggaacatgtcggcgccgtagcggtccgcgtcgcggtgggtgaacagcatgcggatggcaaatgcggtctgcgcgtcgtgcggcatggcgcggaacgccttgtgggcgttccatcccgtctcggtgatcgcctagtcgggcacacctaccagcttgtcggcgtgcagtccggcaagaacctgtccgccacggcttccggcgattccgcactgtccatcgccgacacgcccgagaccctgaccgacaccaagaagcaggcctggaagttcacccagatcgaccagtccgacaccgagcgccccggcctcaaggcctacgtcatcaccaatacggactgcaaggtgctcgtcgccaaggacggcaccaacgccttcagcgatgagtcggtggaagacgccaagtccgaccccgcggcccggtggattttcgacacgtccgacggtgccacctaccagctgctcaacgcatccgcgaagcagaacatcaacgtcgacgcgttcgacccgaaggccggtgcggccgcttccgatgaggaggacggcgatctgaccgacaagatcctggtcgaaggttcggtgaacaccgagaaggccggtgaatacacgctgacgtattcggtgaccgactccgaaggtgcgtcgtacacggtcaagcgtgtcgtgaccgtcagggagaagtccgagccgatcgaaccgagcaagccgatcgaaccgaccgaactgacgaagccgactgagccgacgaaacccggcgacacggtgaagccgaacaagccggatgccggcaacaagcagcccggcctgtcgaagaccggcgcctctgtgagcggcgtgttcggcgcgttcgcggcactgctcgcggtcggtgtcggcgcggcgcttgccgcccgccgtcggcgcgagccccggcgctgaatcagcggatcggcatatgatgccggtcggtcacctattcggtggccggccgactttttgttgactgccggggcctcacgcgggaggtgaagtccacccatcccgccaaagtcccatctgagtgtcttcggatgggactttcgccggaacaagtcgaaaggaaccggggccgggactcatgggctggcgcattgccagtcggccctgtgttcgtgtcgcgtgggatgatggtggcatggtgacatcgaacgttgtggagtttgcggggaaagcgcgcatgccgcgcctcggcatgggaacgatggcgctctctatcgagggacgcccggaccgggcgacggccatcggcacgatccatgccgcgcttgacgccggagtgcgttatctcgacaccgcatggtcgtattatctgccaagcgaaccggggcctgacggtacaggcgtgccgcgtgatttcgggtacggcgagatgctggttcatgcggcgctcgccagctggagcggtccgcgcgatgaggttctggtcgccacgaagactggttatcgccgaacgctggaagtgacgaaccgcgacgcggaagatcctcagcaatccccgggcgacggcgcgagcgcatccgcatccgagcgacagcacctgcaggcggccggcagccggtacgggtggatggccgactcgcgcccggagacgatgattcgtgacgcgaaggagtccgctctccgcctcggcgtcgacgcgctcgatttgttgtattcgcatggccctgaccccgcggttccgtatgaggatacggtcggcgcgctgaaaaccttgctggatgagggcgtgattcggttcgccggcatctcgcgcgtggacaatgcgcagattgacacagcccgtgggattctcggcgaccgtctgattgcggtgcagaaccagttctcgccatcgcatcccgaccccgagcatacgatgggtcactgtgccgatctcggtcttgattttgtgtgctggtcgccgctcggcgggttcctagacgcattcgacagtcatgcgtatgatccgttccgcacggccgcagcggcccgcggcgtctcgtaccagcgtgtggtgctcgcgtgggagctgaccagatatgaccgtctgttcaccattcccagtgcccgcaacccgcatgaggtccgggactcgttcgccgcagtcaatctcacgctcgcccctgaggagctgtctttactgccgtgaatcaacgctatgagtcaccgtcataaatacggaacaggctcgtcgtcaaacgagcctgagatacatgctggtggttccgggaatcggttgaaaaccgaaatgcgcatagaacgcgcgtgctttatcgtcgtaaggttccacaatgagcgcacgtgaccctagtgcgccgctggcggatcgtgctcgcagtaccgaatatgcactcagcgtgtagaatcccgccggttcacctgacgcagtgaatgacacgtacgcgacggccgtcccatgctgggccgatgacggtgcgtgttgtgcggcccacttgtcgatgaacggtactccacaagagaactttccccattctctcttccgggccgagcttgcgcggacgttgggaatgatggatcatgcccactgcggatccctttccatgagtttttcggctgctggcggaaccggctgatccaatgcctgtatgaaatcttggaatgcctgtgattccagatgcaggacggttgcttcttctatatccttacgggctgattccaggagatggcgagcggtccattgcgtgagcgtgctgccggtcagctcggcggcacgctcgatgagctgccgttgcgcatccgtcagtcgaatgtcaagccgggacgttttctgtttcgataccgtttgcttcgttagtgtcgccatagaattgttgtacggaaaaatgcgtacagatcaagtttagtagcgggggagcaaagcgcggacatataatcacatactgtaaattgtttacggtgtgagataatattacagatgtttgcacgatgtatatgccgctggaatgtattggcggtactccgcggagcgcggtagtgcggcaatggtcgaatcggaaggcggtgcgaaatgggttttgagcgggaggcgctcagcgaactgtacgccagcgtgtggggcaaccgttccaagatgcagaaggagttcgcgcgcggcgcgcatggcgagccattcattctgcacgagctcgcactgcgcggcaccatgacgccgtcgcagcttgccagttcgctgaaggccagctccggccgcatctccacagtgcttgccgctctggagaaaaaagggttgatcacccgagacatcgacccggacgaccgccgcatcatccgcgtgaaccttacggatgctgggcgagagcggtccaagtgcgacttggaggagatgcgttcggcaatctgttggatcttctcgcagatgggggagcggcgcacgcgcgagttcgttgatctgctgtcggagttctcgacatacatggccatctgccatcccggcgctccgcgcccgacccccgatgaggtgcgggcagcgttcgccgagcgtgacaggcgtgtcgccgatcacatgcggaccgagcgcgcgaaggccggcgaggagtagcttcttccgccggctgcggatgacgtgggggggcgtgcgtgccgtgtctctcgtgcgcagtcagcgcaaagcgcgccattcacagcgaatacacagaataatgcgtaatatcttacactgtaagtaatctaacaacagaaactaattcgggcatcggatatcgatgccgcggcaaataacgtaaccaatcaccaacaaaacacaaggggaaagccaatgcttcgcatcctgaaatacctctccaaagcggagatcggtcagatgctcatcgccctggtgaccatcgtcgggcaggtcttcttcgacctcaaactgcccgattacatgtcagacatcaccacgctcgtcgagacgccgggcagcgcgatgagcgacatctggatcgccggcggcaagatgctgctcatctccctcggctccgtcgcctgtgccatcgtcaccggctacatctccgcacgcgtcggctcgtcattcacccagcgcctgcgctcgctcgaattccgcaaggtcgaatcctatggccccgccgaaatgagcaaattctccaccgcgagcctcatcacccgctccaccaacgacatcacgcagatccagatgttcatcaccatcggcctgcagctcatcgtcaagtcgccgatcatggccgtatgggccatatgcaagatcgccggcgaaggtttcgaatggactctcgccaccggcatcgccgtcgtcatcctgctcgtcgccgtcgtcatcatgatggccatggtcatgcccaagttcaaggccatgcagaagctcaccgacaacatcaacctcgtggcccgcgaaaacctcaccggcctgcgcgtcgtgcgcgcctacaacgccgaggactatcaggaggccaagttcaccaaggccaacaaggacctcaccgacacgcagctgttcaccaaccgcgtcatggcgttcatgatgccgctgatgaacaccgtcctgaacggcctgatgctcgccgtctactggatcggcgcctatctgatcgacgccgccggcctgacggacaagctcaacgtgttctccaacatggtcgtcttctccaactactccgtgcaggtcatcatgagcttcctgctgatgagcatggtattcgtgctctggccgcgcgccgacgtgtccgcgcagcgcgtgctcgaagtgctcgacaccgatccgatcgtcaaaaccggcaccaagaccgccgccgacgtggcgcgtctgggcggcgggaaaaccggcaccgtcgagttccgcaacgtgagcttcacctaccccggctcacgcgaggcgacgctcgaaggcatcgacttcaccgccgaaaagggccagaccgtcgcgttcatcggctccaccggctccggcaagtccagcctcatcaacctcgtgccgcgcttctatgacgtgtcggccgggcaggtgctcgtcgacggtgtggacgtgcgcgaatacgatctgaaagcccttcgcgacaagatcggatacgtgccgcagcagtccgtgctgttcaagggcacggtcgcatccaacgtgagctacggcgacgacgtgaacggggcaagctccgcggacgtcgaaatggccgacacctccactccggccggccgcaaacgcgaagccgaactcatcgccgcgggcaagagagcggaaggcgccgcaatgccggctgaacagatgaaccgggtcaaggcggcggccggcgtcgctcaggccaccgagttcgtcgagcgcatggacggcacatacaccgccccgatcgcacaaggcgggtccaacgtctccggcggccagaagcagcgcctgtcaatcgcgcgcgccgtctaccgccaccccgaaatcctgatcttcgacgactcgttctccgcgctcgacttcaagaccgaccgcgaagttcgcgacgcactcgccaaagaagccaagggatccaccaagctcatcgtcgcccagcgcatcggcacgatcatgaacgccgaccgcatcatcgtgctcgatgatggcaaggtcgtcggccaaggcacccatcaggaactgctcgacgcctgcgatgtctaccgtcagatcgccgaatcccagctcagtcagtcggaactgaccgcgtgagatcaatacggacttttaaggagtaacaaatgccaggaccaagaggaccaatgggcggcggccgcacggtcgaaaagcctgccaatttcggcaacgtgatgggcaagctcgtccactactgccgcaactacctgcccgtcatcatcattgcgctcgtgctgggcgcggtcggcacgatatgccagatcatcggaccggacaaactcaaggacatgaccaacgagatcgtcaagggactgccggccatcgtgaacggcaagccggtgatgaactcggtcgatttcaacgccgtcggccgcatcgcctggctgctcgtcgcactgtacgtcggctacgcggtgctcagctacgtgcaaagctggatgatggcgaacgtcacccagcgcaccgcccagcgcctgcgcgaatcgatctcggtcaaaatcaacaagctgccgctcaaatacttcgacaaggtcagctacggcgacgtactctcccgcatcaccaacgacgtcgacgccatcggccagacgctcggccagtccctcggctcgctcatcacctcggcgacgctgttcgttggcgcgctcgtcatgatgttctacaacaacgtcatcatgaccctgtgcgcgatcggcgcgagcatactgggactcatcatcatgatggtcatcatgaaatcctcgcagaaatacttcgcccgccagcagatggcgctcggcgacgtcaacggccacatcgaggagatgtacgccggtcacctcatcgtcaaggcgtacaacggcgaggccgactcaatccgccgcttcgagaagtacaacgccgacctgtacgaatccggctggaaatcgcagttcctgtcaggcctgatgatgccgctgatgaacttcgtcggcaacttcggctacgtgatcgtgtgcgtggtcggtgcggcgctcgccatggacggacagatcgaattcggcgtgatcgtcgcgttcatgatgtacatccgcctgttcacccagccgttgagccagttcgcgcaggcgttccagaacctgcagcgatgcgcggccgccgccgagcgcgtgttcggcttcctcgaagagccggagatggatgcggaaccgaccaaggccgaactcggcgtggctgatgccgctgcgagcacggcacggacggacagcggcaagctggcgcatcgcggcactcgcgcgaatgccaccgccggtatgacggcttcgcagcgttcgcagctgctcggctacgatgcggccggcaacccccggaccgtgcgcggcgacgtcgaattcagtcacgtgcgattcggctatgagcccggcaagccgatcatccacgacttctcggcaagcgtctccgccggccagaaagtcgccatcgtcggtccgaccggcgccggcaaaaccaccatggtcaacctgctgatgcgcttctacgagatctccggcggctccatctccatcgacggcatcgacaccacttccgtgccgcgctggaacgtacacgaccagttctccatggtcctgcaggatacatgggtgttccgtggcaccgtgcgcgaaaacatcgcctactccaagcccggcgtcaccgacgagcagatcgtctccgcatgcaaggccgtcggactcgaccacttcgtgcgctctctgccgcagggctacgacaccgtgctcgacgacaacacctcgctctcccaaggacagcgccagctgctcaccatcgcccgcgccatggtgcaggacgctccgatcctcatccttgacgaagccacctcctccgtcgacacccgcaccgaagaactcatccaaaaggccatggatgcgttgaccgtggggcgcacgagcttcgtcatcgcgcaccgcctctccaccatccgcgacgccgacatgattctcgtcatgaaccacggcgacgtgatcgagcgcggtacccacgaggaactgctcgcggcgggagggttttacgccgacctctacaacagccaattcacactcaccgattgatggagcgcccgttgcgctcgctggattgatgaggctgacagcccggtgaacttacgcatggcagtgcgccgtgcgtgggctcgccgggctgtttgctatgtaggcgagtgatgggcggagaatttcctatatatggtgcgcgacgggttcggggactgtggttcgagtccctatgtgcgcacggtcgtcgttccggcgcgcacatagcgacgcaaacgggagaaggattgttgagagcggatgcgctggtgcggcagatggccggtgtgctgccatagaacatgattgtgacgagagcagaggggcgtccggcgcgtatcaccctctcggtctgccacacaatgcgtttttcgatggtttttgggctggtgtggtacgcgggcatcggaggagtcgttttgggccgttgaaaaatggcggttttgcggtgcatgttgtaccacaccacgtgatgtgagggttcacatttcattgtgaggcagactggctggccacacaatgcgattttgatgtgattttgcgctggtgtggtacgcgaccggctgcgctgacgacttggccgaccgatggcgcggatggtgtgctcccgctgtcaggagctgccgagcgtagcgaggctgggggcggtcttgccggcggccctgcaccctgtgataataatgccaagaatgttacgtaattctgggaacggcggtatccagggactttctgagaactgtgattccaattgaagacacaagtcgccgacggacttgattcttttagtaaacaatgtatatattagcatgagccggcaaagctgctggctgccctataggagaaagaaccaaatatgaaacatagagcgatgtcatcgcgtctgatgccactggtggcatcctgcgcgacggtcggcatgctgctggccggactacctgcgtcggccgtcgcggtcggcacgacgagagcggcagcgtccgacgcctcgtcctccaccacagcaaccatcaccccctccgccgataccacgttgcagacatggacgagcgagaagaattcctcaatggcgtccaagccgtacatcggcacactgcaaggggcctcgcaaggcgtgttcggcgagaagttcgagtccacggatgccgcggacaccaccgatctgaagaccggtctgctgacgttcgacctgagcgcctacgaccatgcccccgattccgcaacgttcgagatgacgtacctcggctaccgcggcaacccgacggccaccgacaccgacaccatcaaggtgacccccgtcgacaccaccgtgtgcaccaataacgccacagactgcggcgcgaatgtcgcgaccggcgcgaccaagccgaagttcagcatcaacgactcctcattcgtcgccgagtccaagccgttcgagtacggtacgacggtttacacgggcgacgccatcaccgtggttcccgccaataccaagaaggtcaccgtagatgtgaccgaaatcgtgcgccagcagttcgccgaaggcaagaaggtcatcaccctggccgtgggcgagaccaagaagaccgaggttcgtttcgccagttccgaaggcacgacgtccctgaacggcgcgaccgcagacatggctccgaagctgaccgtttccgtgtccaccaaggacgatctcaagccctccgccgacaccacgttgcaggcatgggccagcgagaagaacgagaagaagaacactgcggcctatgtcggcgcgctgcagccggaaggcgattacggcgacttcggtgagaagttcaagtccaccgacgtccacgatgtcacagacgccaagatgggtctgatgacgttcgacctgtccgattacaccgcggcgcccgagcactccatcctcaccttgacgtatctgggctacgccggtgcagacaagaccgccacggccaccgataaggtcaaggtggtcgctgttgacacgtcgcggtgcaccggcaccgctccctgcgacaccaacaatgccacgtgggcgaaccgcccggacttcgaggtgaccgataccacgaagaccgcgacgtcccatgcgttcgcttatggatctaagaagtattccgatggcatgaccgtcgaatcgggcaacgccaagaaggttctgctcgacgtgaccgacgtcatcaaggcagagttcgccaagttcggcaccgacgccaccgagaagaagatcacgctggccctgggcgagctcaacaagtccgacatgcgtttcggcagcaaggaagtcacctcgctgaccggcgccaccgaggccatgcagccgaccttgtccgtcaccaagaagccgaaggcatacacgctgagcatcgaaggcccgaccaaggtcaagtaccagaagggcgaggcgttcgacaaggccggactcgtggtcaaggccaccagcacggctgacggcacggtcaagacgctgaccgaaggcaacggtgaggataactacaccatcgacaccagcgctttcgatagtgccagcatcggcgtataccctattaccgtgaagtacaacaaggaccccgaaatcgccgcttcgttcaacgcctacgtcatcgccagtgtcgaggacggcggagacggcgacaccagcaaagacgactggctgtggtacaagcagcccgcgtcgcagactgacgccaccgccaccgccggcggcaattacggcaaccccgacaacaaccgttggcagcagaccaccttgccgttcggcaacggcaagatcggcggcaccgtctggggcgaggtcagccgtgaacgtgtcaccttcaacgaggagacgctgtggaccggcggccccggatcctcgaccagctacaacggcggcaacaacgagaccaagggtcagaacggcgccacgctgcgcgcgctcaacaagcagctcgcgaacggcgccgagacggtcaatcccggcaacctgaccggcggcgagaacgcggccgagcagggcaactacctgaactggggcgacatctacctcgactacgggttcaacgacacgaccgtcaccgaataccgccgcgacctgaacctgagcaagggcaaggccgacgtcacgttcaagcatgacggcgtcacctacacgcgcgaatacttcgcgtcgaaccccgacaatgtcatggtcgcccgcctcacggccagcaaagccggcaagctgaacttcaacgtcagcatgccgaccaacacgaactactccaagaccggcgaaaccacgacggtcaagggtgacacgctcaccgtcaagggcgctctcggcaacaacggcctgctgtacaactcgcagatcaaggtcgtcctcgacaacggtgagggcacgctctccgaaggcgccgacggcgcttcgctgaaggtctccgacgcgaaggcggtcacgctgtacatcgccgccgcgacggactacaagcagaagtatccgtcctaccgcaccggcgaaaccgccgccgaggtgaacacccgcgtcgccaaggtcgtgcaggacgccgccaacaagggctacaccgccgtcaagaaagcgcacatcgccgatcattccgccatctacgaccgcgtgaagatcgatttgggccagtccggccacagctccgacggcgccgtcgccaccgacgcgctgctcaaggcgtaccagagaggctccgcaaccaccgcgcagaagcgcgagctggagacgctggtgtacaagtacggccgctacttgaccatcggctcctcccgtgagaacagccagctgcccagcaacctgcagggcatctggtcggtcaccgcgggcgacaacgcccacggcaacacgccttggggctccgacttccacatgaacgtgaacctccagatgaactactggccgacctattcggccaacatgggagagctcgccgagccgctcatcgagtatgtggagggtctggtcaagcccggccgtgtgaccgccaaggtctacgcgggcgcggagacgacgaaccccgagaccacgccgatcggcgagggcgagggctacatggcccacaccgagaacaccgcctacggctggaccgcacccggtcaatcgttctcgtggggttggagcccggccgccgtgccgtggatcctgcagaacgtgtacgaggcgtacgagtactccggcgaccctgccctgcttgatcgcgtgtacgcgctgctcaaggaggaatcgcacttctacgtcaactacatgctgcacaaggccggctccagctccggtgaccgcctgaccaccggcgtcgcgtactcgcccgaacagggcccgctgggcaccgacggcaacacgtatgagagctcgctcgtgtggcagatgctcaacgacgccatcgaggcggccaaggccaagggagatccggacggtctggtcggcgataccaccgactgctcggccaacaactgggccaagggcgacaacggcaacttcaccgatgcgaacgccaaccgttcctggagctgcgccaagagcctgctcaagccgatcgaggtcggcgactccggccagatcaaggaatggtacttcgaaggtgcgctcggcaagaagaaggatggatccgccatcagcggctaccaggcggacaaccagcaccgtcacatgtcccacctgctcggactgttccccggtgatttgatcaccatcgacaactccgagtacatggaggcggccaagacctcgctgaggtaccgctgcttcaagggcaacgtgctgcagtccaacaccggctgggccattggacagcgcatcaattcgtgggctcgcaccggcgacggcaacaccacgtaccagctggtcgagctgcagctcaagaacgcgatgtatgcaaacctgttcgattaccatgcgccgttccagatcgacggcaacttcggcaacacctccggtgtcgacgaaatgctgctgcagtccaactccaccttcaccgacaccgccggcaagaagtacgtgaactacacgaacatcctgcccgccctgcccgatgcctgggcgggcggctcggtgagcggcctcgtggcccgcggcaacttcaccgtcggcacgacctggaagaacggcaaggccaccgaagtcaagctgacctccaacaagggcaagcaggcggccgtcaagatcaccgccggcggcgcccagaactacgaggtcaagaacggtgacaccgccgtgaacgccaaggtcgtgaccaacgcggacggcgcctcgctgctcgtgttcgataccactgcaggcaccacgtacacgatcacgaagaaggcgagcgccaacgtgcccgtcaccggcgtgaccgtgaccggcgccaacaccgccaccgcaggcgacaccgtcactcttacggctaccgtcgccccggccaatgcgaccgacaagtccgtcacctggtcgacctccgacgccgccgtagctacggtcaacgccaacggcgtggtgaccacgaagaaggccggcaaggtgaccatcaccgccacgtcgaacggcgacaagacgaagttcggttccatcgagatcaccgtctccgccgcgaccgtgcccgtcaccagcgtcaccgttgccggcgacgccgcgatgaccgtcgatggagagcagaccctgacggcgaccgtcgccccggccgatgcgaccgacaagacggtcacgtggaagtcctccgacgccactgtggcgacggttgacgccaacggcaaggtcgtcgcgaagaaggccggcgaagtgacgatcaccgccacggccggtggcatgtccggcacgctgaagatcacggtgagcgacaaggccccgaccgtcatcccggtccagtccgtgaccgtgacaggcaagcaggagctcgtcgaaggcgcctccacgaccctgacggcaaccgtcgccccggctgacgcgaccgacaagacggtcacgtggaagtcgagcgacgagtccgtcgccacggtcgacaaggacggcgtcgtgaccgccaagaaggccggcacggtgaccatcaccgccacggccggtggcgtgtccggcacgctccacatcaccgtgacggccaagcccgtcgagaccgtccccgtcaccagcgtggaggtcaccgtcgaggccggcaccaccgtctccgtcggcaagacactccaggctaccgcgaccgtcaagcccggcaacgccaccaacaagaaggtgacgtggaagtcgagcgacgaatccatcgcgacggtcgacgccaacggcgtcatcaccgcgaagaaggccggcaaggtcgtcatcacggccacctcgaccgacggcacggacaagtccggcagcgtcgagatcaccgtcgtggatgagaccaagccgacgcccgaccacaagtccgtcaaggccgataccggcgacgtgaccgccggcaagaccggtacggtcaccgagccgaaggacgtggcgggctggaagagccgctccatcatcaagcaaggcaagctcggcaaggccgaaatcgccgacggcacgctcgtgtatgcggccggcgacaagaccggtgacgacagcttcgtcgtgcagtacacgatggccgacggcacggtcatcgacgtgacctacagcgtcacggtcaaggccgccgaaaccggcaagaacgacggcgacggcaagggcgacggtgtcgcgaagaccggcgccgccgtcggcgcgctcgccggcctcggcctgatgctgctcgccgtcggagtgagcgtggtgatgattcgccgcaagcgctccgcctgatccccagtcagaccggccagtcgtgaccggtcggcctgactgactctttttccaccgtcccccgtcggataaaccccggcgggggacggtggcttgttgcggccggtctgccgtcgcgtgcggtgtggcctgcagacgggtgccgcacgtcacgctcatgcgcgatactggagacatgaagatttccgctgacttcacggtgatgcccgacgacttcgccaaagccgccgcgcccgaataccgcaccgacggcgtgcccgtcatctccttcccgttctatatcgacgagatcgatcccgccgcccggtacctgcactgggcgttcaccgaccccgactccatcccggtctgcggattcgaatggattcactggacggtcgccaatctgcccatcgacgcgctgatgtacgacttcaacgattcccatgcactgcagattccgccggacttctcccggcagctgccctccatgattcccgagaccgtgcagggccgcacgtcggccgcgagcaagctggtcggcagcacgaatccgcaggtgacgatgcgctacaacgggccccagccgcccgacaaggaccacgactattcgctgcacgtgtggggcaccgcgaagccgttgccgggtctgaaccaaggattctggctcaacgagctgttccacgcgctgcgtgacgtcgaccacgtcaccgatcagggtgtgatgttcatcaccggaaaagcctgagggctgatgccgtatactcccgtacggagtcatacactcatgtgacaggaggcgcgccgcagatgcgcgccgcaacgtgcacgcgacagcgtgtgcacagcaagaaaggacagtaccgaatactatggcatgcaccacgattctggtcggcaaggacgccagctatgacggttcgaccatcatcgcccgcaacgaggattccgccaacggcgaattcaacccgaagcggttcatcgtcgtcaagcccgatgaacagccgcgcaaataccgcagcgtcatcagccacctgaccattgacctgcccgacgatccgctgcagtacaccgcagtgccgaacgccgacctgaaggaaggcatctggggcgaggccggcgtcaacgaggcgaacgtggccatgagcgccaccgaaacgctgaccaccaacgagcgcgtgctcggtgccgacccgtttgtggaataccgggcggcacgcggacgggaaggtgactcggattacgagccggccgtgcccggcggcatcggcgaggaggacttcctgaccatcgtgctgccgtacgtcaccaccgcgcgtgagggcgtgcagcggcttggcgaccttcttaaggaatacggcacctatgagatgaacggtgtcgcgttctcggacgccgacgagatttggtggctggaaaccgtcggtggccatcactggatcgccaagcgcgtgcccgacgaagcgtatgtgacgatgccgaaccagctcggcatcgacgaattcgacctcgatgacgccctcggcgagcaggagaaccacatgtgctccgaggatctggtcgaattcatcgagcgcaatcaccttgatctgtccgtcgaatcgacgtcaccgttcaacccgcgtgatgccttcggctcgcactccgactctgatcacgtgtacaacacgccgcgcgcatgggtcatgcagcggttcctcaacccgtacgacgagatgtgggacggccccgaggccgaccaccgcccggacagcgacgacatcccgtgggcccgtcagcccgagcgcaaggtgacgatcgaggacgtaaagtacgtgctcagctcgcactatcagggcacgccgttcgacccgtacggccacctcggcgacgagcacacacgccacatgtaccgcccgatcggcatcaaccgccagagccagctggccgtcatgcagattcgcccgtaccgtccgcagtcggaccgcgcgatccagtggatcgcctacggctccaacccgttcaacacgctggtgccgttctacccgaacgtcaacgaaacgccgaagtatctggaagacacgaccacgcgcgtgacttccgagaacttctactgggagaaccgcatcatcgccgcgctgtgcgacgcggcgttcgcggagacctccaacgccatcgagcgctatcaggagaagaccggcgcgatgggccaccgtttgatcgccgccaccgacgagcaggtcgcgcgtctgggcggtgccgacgaggccgcggccgccttggccgacgcggagttggaggcggcgaacgcggacggcgacgtcgagccgatggatcccgaggacatcatcgacgcgacccgtaacgacgaggtgcgcgacatcctcgccgccgccaaccagaccatggccgaccagctcaagaccgagaccgaccagctgctcgacaccgtgctctacaccgtgagcatgaagatgaagaacggtttcaaccgctccgacaactgatgcgctgagaggctcccggccaagcgttttcggccgccagccgcttcgacggtaagcaagcgtcatacatctacagaaaggttcacctactgatgactactatcgaggagttcaccagccagtacgggctggtcaagaagatcgacgccttcgggtttatgaagtacctgcacgacaatcccgacgcgccgcgcaagcacggcaaggtcgtgctcgtcaccgccgatacgccgctcaaggcgtcgcgcggcgagggcaagaccacgacgacgatcgcgctgatcgatgcgctgcgggctcgcggcatcgacgcgaccgccgtgctgcgccagccgagcatgggcatcaccgccgccggttccaaaggcggtgcctcgggcggcggcaaggcttcgctgacccaccccgagctcatcgactggggcctgtgcggtgagatggccgccatcgccgccgcgcagaacctgctcgtctccttcgccgagaaggctgtggacgagggacgtatcgacacgatcctcgtgccgcgcgtctccgaagtgccgtcccgctcgctgcgttccatcaccgtggacgcgggcaagaacaacgtcgccgagaaggtcgtgctcaccccgacgtccgagctgatgcagatcgtcgtgctgtcccgttcgatggatgagatcggcgagcgcgtggccgcgatgatcgccggcacgaaggacggcgaaccagtcaagttcggcgacttcatcgacctgtggcgcatcaccgatatgctcgccgatgcggtcaagccggcgctcaccgagacggtgaacggctcgccggtgtatgtgcatggcggcccgttcgccaacgtgtcgatcggcatcccgacgctggtctccgtggagatggcgtgcgccctgcacgatgtggtcatcgtcgaggccggttacggcaccgacgccggagcgcagaagtggctcgacatcgcctgccgcgagtatggcgcgcagtggccgtccgcggcggtcgtcgtgacccgcgcctcgacgtggcgtgatgacccggagctggcgtggcgctacccgttccacgtggaccgcttggagaagctcgacattccggcgttcccgctggtgaacctgtgggacggcgaggacgatcagattcccgaactgcgcgagaccgcggcccgtctggagctgcgcgaccccatcatcggcaacctgtatcgcgacggcggcgagggtctgagcgaccagatcgacgcattcgtcgatgtgctgtccaacacgtcgatgccgtccaagcatgacagccacaagggcatggccctgctggagaacgtgaagtgggtggccgagaacgcctacggcgtgccggccagccgtgtgctgctcaaggacggtttcctggattccctgggtgctgcggatgatctgtgcaaggccgccggcatgtcgctggacgatctggcgctggtcgccgtcaagtccccggccacgatgaccgacaacgaccgcgctccggaagacgagcgtacggtcaccctgaagaaggtcgaagtgcacgcaggcgccgggctggttcacgtgaacctcaccacgtccctgaccaccccgatgcccaagatcgtctgattgcggcagaggcgtaccgccggggtgccggggcacgcgtgctgtgagagtgtgcggcggcgtggcatgcggaatcatgccgcactcgcgctgaccgcacaccgtgactgcatcatcacaacccctttcggattgtcggccgatcatacgggccgactggccgcaaggggctctttcatttatatatcggcaacctgtgtgccgcagaaaaggcgtcactgtgtgagggttacgtcactgtgtgcgtcctcacactccgtgacgcacccccgcaacccttgcaaaataagggttttgcgatttacgtcactgtgtgagggctcgcagcgtgacggtggtcgcacacagtgacgccatgcgcgacaatatagcggcggataccatcacacctgagctcagaagttaccgccgttccagccccagtcggtggtggcggtgtagcggatgtaggtgcggtcctcggggatgccgagctcgctgttgagcgcggccatgatcgacttggtcagcttctcccacgcagaaccgggcacggaacggccgaacacattgacctcgacgtatgcggccggggcatcgtcgctgccgccgaagtagatcggcatatcatcctcgaatgggcacatcagccagccctcggacttgccggggacggccgtgatcgccttgccgtaggcggccttcagcgcctcgcgctgctcgggagtggtcttgacggatacgtgagtgtggataacgggcatgattcctccttgattgggttcgttccctatcctaatcggttccgcggcgggcgcgggctgtgcggccatgtgtgaaatcagtggcggttcaggaaaaccgcggtgtgaagtcagtgatatgtattagacaatcaatgtgaggaaattgattgaacagctgatgaagttcggtattgtcggtgtggtcgcgttcatcatcgactggggtctgatgaacattctgctgatgacgcatatgcataacgtgctggccacgtcaatctcgttcttcgtctcgctgatattcaattacctggcgagcatgaaattcgtgttcaagcaccggccggacatggcgcgctggatggagatcgcgattttcttcgtggcggcgcttatcggctggttcatgaacgaggcgatcgtgtggaccagcacgtcgtggatgccgcatgattccatgtattccatgcacacgaagtacgtgctgtggacgaatgtcggcaagctggtagccacggtagtggtgatgatctggaacttcgtgatccgcaagtggctgcttgacgatacgcataccaatgcgatgaaccgtttgaggaagtccgagaaccgtttgagtcaggaagagctcgaagcgaagtgggagaacagcttctcgcatcggcttggcctgtggtcgctcgcgcatacgccggagggctggccgaagtagcgcggtatgcgctctcaaaactcgcagatagagtgtgttttccttcaaaaatgccttgtatccgcgagttttgagagcggcatccggcgtatcacacgctgacttcggtcagagtcggggtttcggtgctggatttgatctgccggaagccgacgaaggcgatggcaagcgaggtgatcgccagcacggtcgccatcaggaagcctccatgcgagcccatgtgatcgatgaagacacccgcgatggctgagccggctgacgagccgatcgagttcatcgcgcccatccacgccacgccttcggtgaatcgcgtgggaggcaccagatgcagcatcagctgattgccgttgatccacgtgggtgcctggcagacgccgatcagcaggtagatgatcatgatcacccacagatgcttggcgaacatgaacgtgcccacgccgaaattcaccacgatgaggcagaagtagaagcgcttccacagcgggatgatccagttcttcgcgccgtacaccagtgcgccgcatagcgagctgaacgagaagcatgcgaacacgaaaccggtgtattgcttcatgttcgcttcggtggcgaacgcgatgatcgagatgttcgacgccgactggaatgcgccaagactgaaccaggtcacgcacacggcgatcaggcccggcccccagatcgactccttcttgccggcgcgggaatcggcgatggctcggtcgacggcggcctgcacggcctgctcatcgtcgccgcgggcctcggcctctcggcgggcgcggtcggcggcgtccctctcgcgcatcctctgcgccttggcggcctcacgcttgcggtactcctcgcgggtcagaccggcctctcgggccagctgggtctgtgatttcggctcggtcgtcagctcggtcaggaacatcagcgcgccgatgacgacgcacacgccggtgaacgagaacgccagcaggccagaaatcaccgccagcgtagaagccagcggattgccgatgatccacatgcattcatcgaacacaccggacagtgagagcgcgcggtcggtgcgctcccggtctcccttgagcatggtcgtccagcgggcgcggctcatcgcgccccacggcggaatcgcggcgaggaacggcgtcaggcagtacagcacccataccggggcgcggttggtgatgctggtggtcagggcgatggcggcgacgatccagaccaggatcgtcggaatcgacacctgccgctggccgaacttgtcgaccagcttgccgagcagcgggctggagaccgccagcgcgatcgcctggatggcggtgagcacgccggccagcgagtagttgccgtagtaatgctgtacggagatggtgatggtcatgccgaccatggggaacggcatgcaggcgatcaccgagccgatggagaaccttgcggtgtgcggcatacgcagcagttccgcgtatccgccgaataccttatgggcgacttccttgattgcagccgcgacattggcgttattggacatgacagcatctcctttccgctcccgattggatgtcccccgtcggcgtggcgttgccggcggagccctcatcgtattgatgtgttgtcctgttggtcgcgcaaaggatgctttgcatgtttgcgtcacggcaactttaatcgcgcgtcggggcgcgacacgcggtgttgatatcacgaacgcatcaattttcataacgttcataaacgacggtgatatatcggtgtatcagatggggtgacgagccggagtcgggcgggtggagtcaggacggtacgggtggggctgggccgtgccggggcggggcgatgttcgtcgggcaaacgccgccgcggacgcggcatcgccggccggccggcgaatgtgggacaatgaaagacagacatcacgagtcccgcaggaaggccgcatatgccgacaaccaccatacatttcatccgccatggcaaggtatacaatcccgaccatctgttgtacgagcggctgcccggattccacctgtccgaccgcggcatgcgcatggcgcaggcgacgggcgcatacatcgcagccgaccccaagctcaacacggtcgccgcggtgtattcgtcccctctggaacgcacctgcgaaaccgccggtgccattctcgacgcactcaacccggtacgcgccgggcgtggggaggagccgctggaactcatcaccgacccgcgtgtgatcgaagcgggcaacgagtttcgcggcaagcgcatcggacatggcaagggcgcgctgtggcgcgacggcaactggaagctcgtgctcaacctgtggaagccgagctggggcgagtcgtaccggcacatcgccgaacgcgtgggcgcgttcgcgaacgagaagatccgcgagtatgccggacggcaaatcatcgtcgtcagccacgagtcaccgatctggagctaccggcacctgctggagaccggccaccccgagcattggatgttcctacgcaagaccgcgctcgcgtcgatcacctcgatcacctacgacagcgatacgggcaaggtgatgtccatcacatatgccgaccctgcggcgcaagtcgagtgagtgcggcgtgcgccggccgtacaatacacagagaggacggctgcgggctcgcccgcgaaaaggtgcgcatgcggcgcgggccgggactgacggcggccgcgtagcggtcacttgtgacgacgccgcgtaacggcaggcggcgagtggccggcggtgctgtgacgcggtggcccgcggtgccggcgaccggcacctggcacccggcacggcggaaggttccgcgcgtcggcggacaatgaaagcgaaggagcgatatggcattccaacttgacgcgacggcgatcgcccatgtgtcgatgaatcccgcggtacgcgatgcggcggccgtcggcgccggactgatcgaactgtggccgctgaccgacgccaagcagatggacaatgacacgaaatacggtgagaacctgcaggtgcggatgacccgcatggccgcacgggtcatgaccggcgacgacgtgacggtccccgatgcggagttcgtgtatgagggtgcggatgagattcccggtcgtccgcagcgaatcgtcgatgcgttgctcgccgcgaatgacgcttacgacgagatgggcgactactccgaaaccggcgacacgaggctgatcatgagaggcgccggccagttgggcgtcgattgggatgatgacaccgtgcacgccatcgccgaagcgttggaggcaatcgaacaggccatcggcgtgggcgatggtgccgccggtggtgccgccgccggtgccgccgcgcctgcgaatgctgcgcccagtgccgatgtcgaagccatcgcgcagcgattcgccacggtgacggtggcggccgacgggttgctgcgcctgatcgatctgcgcaagccgtcgcgcgcggtgccggtgatgttctatgtcaacgaactgtgcgagcgcctgtcggtgccgcggctgtgcttcaaggccgagcagctgtcgtcgctgatgaccgcccgatcgctgactaacgacgacgaggccgccctagccgaaacggtgaaattgtttactatggtcgcggcgagtgagtggaaacgtcaccatgacgacgtgctgtgggatgccgccgaggcgaagcggctcgcgaaagaggaggacgagcgccgcaacaaggaggcgctcgccgccaagttcgcgcacgtgagcgacgatccgtccaagccacccgtggagctgtgacggctgccgcctgacgtctgatgggacggggcggagacctgaaatatatgcgattcaccgctgactgctcggaatcgtgctgacctgcttgcggcgcgcccgctgaatgtggcgtacttcttccagaacctgaggaacgccttgccgaacgagcacccgtagtagggtttgtccggcggcggctcgcctgtgccgaactgagggggggggcggcgtaaggactgttgccgccgtacgccggcgcggccgtatattgctgctgtggtgcggcgccggctctattcgccgtcgtcgttgaacgcgatggtgtcgtccgggccgaggagcaggcgttccgcgagactgatgatggtcagcagcagtgcggtcagtgcgaccaccatgatcgttgcggagaagatcagcggggtgcggaacgagttgaaagcggcctgcagccagatgcccaggccgttcattgcgcccagatattccgccgtcaccgcggtgccgaacacataggcggcgctgatgcgcaggccgccgaacacctggcgggcggcgacgcgcagcttcacatgccacagcgcccatgcgcgggtggcgccgcaggtgagcgccacgtcctcgtagaactgcggtacggcgagcatgccgcggcacgtctgcacggcgacggggaacacgccgaatacggcgacgatcacgattttgccgagcggctcgaacccgaaccagatcatgaacagcggggcgatggtgatgagcgggatggtctgcgcggcggcgagcagcggatagataccgcgatacagggttttggacacgtacaggccgatgccgatgagcaccccggccaccgctgcgatgagaaagccggtgattgcctcgtatgtggtgatggcggtcgcctcccacaggtcgggccaagtcttgatgatcgatgcggcgatctggctgggggaggcgagcacgcgttgggagatgtggcccgcatccacggcgatctcccatacgatgagcagcccgccgaccgtgaccgccggcggcgcgacgcgtgcgaacagggatttcagtgtgcgcatggcgtgatcttcggacaatgtgaaaccttagggatgggattgatggggactggcgggttgacgggctgacggagggagatgggccgggtaggagggagaagggccccggaatcgttacgagagtcggaaaactcccctccgtcccgtctcgtgacggaccgaaggggagcggaggttggcccggccggctgtgacgaacctgtgctcgcggattcgctgaactgtagatagattggctgtggccggactggctgcagccggatcagcccacgtactcgttggtcgcgaggtccttggcctgcggcgcggacgcgggatcgttgccgtcctggtccttgtaggtgccggccttgtactggaactccaggtacggctgcgcgtcatcgaagttcgtggtgccgggcagcgacttcggatcgtcggtcgtccagtagttgttcttggcgatctcctccatcgaggtgcgggtcagcttggagtcgagctgcgcctccttggcctgttcgaccaggatgtcggcggccttgtccgggttggcgagcgcgtagtcgtagcccttcttggtggcggcgatgaacttcttcagcgcatccgcgttggcggagtccttgagccaggagcccttgacggcgaatcccagctggtcggggttgccgggcacgccccagtcggaggcgacgaagcagttgagcttcgggccgttcagctcgctttccacgccttcccaggtcacgtagaagccgccgaaatcacccttgccgctggtcagcgtctcgaaggtgttggtgccggccgtcgcggtcttgatgtcgccggtgccgccagcgtacttgatcatctggcggacgaccgcggtctgctcggcggagccgaagctgacgaaggtcttgccggaaaggtccttgggcgtcttgatgtcggtgcgggacgccagcgcgcaccaacgggcgaccggcttctgcgtcaggtcgaacacgaacttcaggtcagcgccctgcgagttgaacgcggcgacgttgctcagcgtggtgaagcccacgttggccacgccgttctcgacgctggtttcagctccggcctgggcggtcggcaggatcttcacattgacgccggcatccttgtaatagccgagcttctgagccacgtacagaccgatgtggttcgtgttcggcgtccagtcgagcatgaacgacacggtcggcgtggatccggagttcttggaatcggtgttgctcgcggaattggtgtttccgcaggcgctgagcgtcaggccgagcgcgacggccccaaccatcgccacgatcttgctgaagcccttgactgtcttcatcttctgtctccttgccttctgcgcacatcgtgcgcctgccggctgacacacgccgggcgggaaggtgaggagcccgcgcgacatgaatcagacccgtcgcatcgcagcgcgacacatatcgccttgcaatgcgtttacttctctgatgtctggcacggctgctgccaccaaccgcgcgaacgttctccagtatagcggtatgcgggggatcgtggtatgtctcgacgggcggcttcgcgcaggagtcggtgtgacggcgcggcatcgggccgccatggcatgtctcccgccggtggacatgtgtttgccggattgccggggcattgctgttttctgctgttctcggggcggaccgtttccccgccgggttcatgggctacgatgctagtggctcgtgaaatggcttgtgagatcaaggaggatgccgatgatgaaggccgtgttcttcgacttggacgggacgctgatcgattccgatccgtattgggtgcgctctcaggagaccttggtgcgctcctgtggcggggaatggagcgacgcgctcgccgatgcgctgcagggggcggccttccccgagaccgtgcgtctgctgcgcggtgcgggggtcgattgggatggcgatgcaatcgtgcggcacctgtccgatgaggtgctgtgcatggaaaaggagcgtctgccgtggattgagggcgttcgcgatgtgctgtccggtctggcggcggcgcacgttccggccgtgctggtgaccggctccccgcgcgagatcgtcgagaatgtgatggcgcaggcgcctaagggcgcgttcgtcggctatgtgtgcggcaacgacgatgtgacgccgaagcccgatccggcgccgtattggcgtgcggcgtcgatggtcgggctgccggccgatgcgtcgggtgctggtcagtgtctggttttcgaggattccaagcccgggttgacggcggctcgggcgtcgggcgcgacggtggtcgcggtcaccggtcatgctcgtgtggatatgagcgacagtgggctgtgcgatgaggcaatcgttgactatcgcgggctgaccatcgccgatttggccggctggatgtgatgtgccagccagattgtcgtggcgttgcaacggtttcatgggttgttccctcatattcgcacgtgtttgggcttcgcgtgactcggtcggataacaggaacttcatccttcggcgcgaaagcggcatctgcgtttcgagggggtgatttcgtctcgcccaaacatctatctacgtttcgaggggttgctgtctgccagtatacgaagtatgaggggcggaatatcgccatcaatatagggaggattgacgaaaagcaaccccttgaaatgcagatagatgtctgcgagggctgcgatcaaccccttgaaaccgagaaagtggtgttgcggactcttttcgtgtggtggcgcttgattatgttgtggcttggctgcgacatattgcgagtgcactgtcgatgatgagtgaatggcggtggggatgccattcgatgatatgaagctcgtcaagcgtggaatctccagtgtacgagcacgaatccgctcgtttgcgtccctaagtgcgcgccgaaacgacgaccgtgcgcacatagggacgcaaacaggggcatttgcgtccttatgttcgcgcgcttgtcgtttcggcgcgcacttaaggacgcaactcggggagtgacgggagtgtaggcacgtatgtgggccttgcggcgcagcaaagatatggggcagtcccaaagaaaccgggtgaaggtagcggtgtgaatgagcgcggcatgtacgaacacggggtaggtgggcaatgcgcaatcagcaggaacggtggtgcgtctcgggcgggaatggtcggaaggatccagcgcgctgacaagtaggaggggcgggcttgcgaggcgaaccagcatggaaggagttggcgcaccgcattgactggcgggagcgagcggcggaacgaaaggggtgtaaacaaggcaacggggagtgccgcgtgtgaccgtttacatacatgagtgtagggattgtgtgacgactcgctgtgcgcgctaacacgatttgcgttttgccagtggttgcgatatatgagtatcaacgataatttcggttgcggtgatggaatcgaaacaagcaattggagctgtataagtagtaatacaaggggacaatcatgaataacgatcagaacaaggtcatggaccagcgcgagatccgcgaggacgagtcgcaggattgggcgacgctgttcgccggtctcgccgcctgagcgcgccgaaatatcctgaccgaggcgcacttgccggattgacgatacatcgccgtacatggaatccgacagtcacccatcggcaggacgacgcagcaaccttcatgcgcaacgccgtcgaagccgccatcaaagccggcgcttcgaccgccataccagcagccgttccttctgccatcgacggcgcgaccgtgagaccgattgaccaaaagtgagtgaaccggctcacgtcccgttgacgcggcacaatggaacgtatgactgaagctgaacattcaaaagacaccaaaccagaacttccggctcatgttcgcgtgcgcttctgcccatcgccgaccggcacgccgcatgtcggcatgatccgtacggcgttgttcaactgggccgaagcccgcgccaccggcggcaagctgatcttccgaatcgaagacaccgacgccgtgcgcgactccgaggaaagctacaaccagattctcgaatccctgcgctggctgggcatcgactgggacgagggcatcgacgtgggcggcccccacggcccgtaccgccagtccgagcgcggcgacatctacaaggatgtggccgcaaagctgctcgaagccggctacgcctatgagtccttctccactccggacgagatcaaggagcgcaacctcgccgccggccgcccggccgaattcggctacgacggttacgaccgcgacctcaccgaggagcagaaggccgccttccgcgccgagggccgcaagcccgcgctgcgcatccgcatgcccgacgaggacatcgccttcgacgacctcatccgcggcaccatcgaattcaaggccggttccgtgccggactatgtcatcgtgcgcccgaacggcgatccgctgtacacgctcaccaacccggttgacgacgcgatgatggacgtcaacgtcgtgctgcgcggcgaggacctgctcagctccaccccgcgtcagatcgtgctgtaccgctacctgatggagctcggcatcgccaagcagatgccgctgttcggtcacatgccgtacgtgatgggccagggcaacaagaagctctccaagcgcgacccggagtccaacctgttcaaccaccgcgacaacggtttcatccgcgagggtctgctcaactacttggctctgctcggctggtccatcgcccccgaccgtgacgtgttctccatggacgagatgatcgccaagttcgacgtgcgcgacgtgaaggccaacccggcccgcttcgacatcgacaaggccatctccatcaacgccgagcacatccgcatgcttgagccgcaggacttcctcaaccgttccgtgccgtacctgcaccgcgacggtgtggtctcggccgacaattgggatgcgctgaccgaccgcgagaaggtcgtcctgaccgcctccgctccgctgatccagccgcgcgtgcgcctgctgggcgaggtcgccggcatggtcggctccctgctgtccaccgaggagtacctggagcctgcggacgatgccaggaagcagctcaaggactccgccgccgacgtgctcgatgccgccgtcgccgcgcttgagggcgtggacgaggccgattggaagaccgacaacctgcacgagaccctgaacaaggcactcgtggaggatggcgggtacaagccgcgtctcgccttcggcccggttcgcgtggccatatccggccgtcgcgtctccccgccgctgttcgagtcgatggagatcgtcggcaagccgctcaccatcgctcgactgaagggcctgcgcgagcacctgtgatgtaacgcagcgcttgtgcgcatgcggaatccggcgggcggctgtcgcaagacgccgcccgccgtctgctatctgcggagtttgcgcctccgctggcgggctgagccgtgaagcgaacggaggtgtcgttcgtaatcgaaggcgagccgacatacgagtagacaatactgcccccgcaggggtgtcacgaagcgactgggggagtctccgccgatcaggcgggcagaactcctccgctgatttaccgccccaaataacgctccgccgtaacatacctcccgttcttacccgtgaagttttctgttcctcgatacacgacgattctgcgatcgaccggcacgcccagttcttccccgacggtggcgagatgcctgaagaaatctggtcgcggagtcattctcgatttgatttctatgagggtggggctacggcgctgcgtagcgtctacgaggtcgatttcgctctggttggtatcgcggtagaagtacagctcgccgtctttgttcttgttgaggtatcgcttcacggtttgcgaaatgatgagattctcgaacacatcaccgcgcttggggtcgttcagcagctcttccgcagaatgaatcccgagaagatagttgagcaggccattgtcgtggaaatagatgtcgttcggcgttgacgcgtcatagaggtgaggatagccgccgcggaacatgaattcgtccgcggtgaggtcgggttccggctgaatcgcctcctcatgcgagaggggcggcagttgaagcatgcccatgcgccccgccagagattggcccaatgcgcttctccaggaggaagttttgcgagccggacagcacgtattgccccatgccgcctcgttcgtcggccgcgacctggatctgcgagaacagtcccggagcatgttgcgcctcgtcgatgatgagtttcgcgccatgtgatcgaatgaacccgaccgggtcatcgatggcgctgatgcgggtggtttcgtcttcaagattgacgtattcgtaatcgagcagcatgtttttgatgagcgtggatttgccgctttgacgtggtcctgtcactgagacgaccgggaaccatgacagcatcggggtgagctcttgcgcgacggtccgtggtatcatcattgtctcatttgcaatttcatcaatacagtgtctgataattcatcaataggattcatgcaaattcatcagtaggattcgtgataatctgtcagtgcatgtcttatatcgttgcaatataaggttttttgacagtctttgtggctcagttgacgatggtagtgcggtaatggcgcattcgtgagaatctcgaccatgtcatgcgacccgcggctcaattgacgtgagccgtttcgccatcctcgatgatggtcggtggagatgcagcctaacgtatctgcatcgtgccgtctcgttcgatgttaccgcataacgcttttgttgactggattggttgggatatttttggagtctatcggatttcgtcggtggtcaagagcccgtcccaaaaccgttggaaatcctcgcgacacgccgtgagttgcagtgggctggatattgccgtatagttttcatctgttgcgcggcacgccgcacagcggataactcaagcccccatcgtctagcggtctaggactacgccctctcacggcgccaacaccggttcaaatccggttgggggtacgaaggtgctataatcccaatcggttacagcatctagccaaattgggatgtggtgtaattggcaacacagctgattctggttcagccattcttggttcgagtccaggcatcccagcgaatgaagctctcgcggaagcgagggcttttttgtttcccggcgcattcagccggcggattcgtggcctataggccggatccgtccaaaatacgggttgaaatcgccgaaatctactattccccgtgtgaaatcgccgtttttgaaccttaaaacggcgatttcacacggggaattgccaagaacggcgatttcaacccgtaattcagtgtcccggcccgctcaagacacgccatggtgctgtcaggcacggtcaaggtggtatgtactacgctgtgagttatgacggatttcaaccagattgcagcgccggcatccgctagcggccccgatgacgagcgcccggtgtccatctcggcgcgtctgggacgtctccagttccaccgttccggcaagttccgcgtgttgcagctggcggacatacaggatggtccgaaggtctccaaagacaccatccggctgatcgaggcgtcgctggacgccgcgcgccccgacgtcgtcatattcaccggcaaccagatcgccggatacgacgacgcgtactgcgacacgttccgcaagcggcagtgggagccggcgcggcgcggcaagatcgagcgcacgcgggccaaggtgcgtgccggcatcagtgcgttcctgcagccgctgatcgaccgcggcataccattcgccgtcacctacggcaaccatgatgcgcagtgcgggctgagcccggccgagctggacgcgctgtaccgtgagttcccggggtgcatcaacccgccgtgcaatatggacgattccgccgcgaatcccggcttcctggtgcgttcggtgccgtcatccggtttgccggatcagccagtggccgcatgcgagcccggcacgttcgcaatacctgtcctggatcaggatcgccaacgtgccgtgctgggtctggtggtgctcaattccggcgattacgcacgggagggcggctatggccggccgagcgacgccgcgctgcgtttcgtgcacgacgtgccgcggtggctcggcgtccgctccctggtgttccagcatatgccgttgccgcagttttatgacgtgctgaaggccatgccggcgaacgccgataacgccatacaggggtatcgcaagtacgatgcgcagtattacgtgctcgatgatgaccggacgctcccgggcggctatctgggcgaaggcgtgagctgtcctgacgaggattgcggcgagttcgccgcactgcgcgacacggacggatatataggagtggttgtgggccatgaccatcgcaatggtttcgtcggctcgctcaacgggatgatgctggtggcgacgccgacctgcggattcggctcgtacggaccggccgcggcgaatcgtgcggcaagactgttcgagttcgacatccgccacccgtacagcccgcggacgcagctgctgacattcggcgagctggtcggaaaaccgagctccaacaaggcgtacacctatgcggtcgaagggcagtcgaacgccgccgatggcgtcaatctgctgaggaaacccggcctgctcgccggggtcgccgccgcattgaagaagatctgagcaaaaagggacgcccccgctgacgggctgagtcgtcaggcattgtctgatgccaaggagcgccccccccgccagcgggggcgctccactgatccgctgcgctcgacagcctgctgggctctgcacccgtccgttgtcggcgctgtcagcgaacggagctggccttgagcagggcgtcggtcaggtatttgccggcggccatgaccagcggggcgtaacggcgcccgggcgagttgcccatacggccggacgggccggaaatggaaatcgcggcgatgacctgaccggaggcgttgcggatcggcgcggagatggagcagacgccctcttcgcgctcgttcaccgattcggaccaaccgcgcttgcgcacggcggcgagcttcgcggcggtgaacttggcgtgcctcagcccctgatgcagccgctcggaatcctcccaggcgagcagaatctgcgcggccgacccggcctccatcgacagcatcgcgcccacgggaatcgaatcgcgcaggccgctggcgcgttccaccgctgcgatgcacacgcgctgatcgccctgacggcggtagatttgcgcggattcgccggtccggtcaagcagtgtctgcagaatcggccccgccgcggtcagcagacgatcctcgcccgctgcggcggcaagctcggcgaaacgcgagccaagcacgaatcgtccgtgctgatcgcgcagcacgaaacggtggcgctccaacgcgatcgccagacggtgggcggtcggtcgcgccaggccggtggccgacaccagctgtccgagagtcgcgggaccggattccagcgcgtccaaaatcttcacggttttgtcgagtacaccgacgccggaatggatctctccgctgatggtgtactcgatggcgtccgctgtcatggtgctggtcacggtgccgtcgtcatgcatctcgtcgtcggcacgctgtcgttcatcggccatgcttgtggccagtggttgcgtcagagaagtcataatgaagcattatgccatctcacataatgaaatgcaaaagtaacgtagacgcttttctgttaatggcaggccggtaatatcgcgatattttcgacaagaaccgcaaaaaacaagaataattcaagcatcgccatgttttcgccgttttatggccatgtatttatctcatatatcggcctagggaagttctcaacgtgcccttgcccatacgcttattaccacataaaaagcgtgagggcaataccttgcgcgaggaaatttgaggaggtcccgaatgggaaccacattggccgagaaagtctgggccgaccatctggtgcggcaggggagcgacggcgcacccgatttgctgtacatcgacctgatgctcatgcatgaagtaacgagcccgcaggcgtttgagggtctacgtctggccgggcgcaagccgcgtcacgtcgatcagctgatcgccacagaggatcacaacacgccgacggtcgacatcgaccgcccgaacccggacaagacatccgccctgcagctgagcacgctggaaaagaactgcaaggagttcggcgtgcggctgcacccgctgggcgacgccgatcagggcatcgtccacgcgttcgccccgattctgggcctgacccagccgggcatgaccatcgtgtgcggcgactcccacacgtccacgcacggcgcgttcggcgcgctcgcgttcggcatcggcacctccgaggtcgagcacgtgatggcgacgcagacgctgagcctcaagccgttcaagacgatggcgatcaacgtgaacggcaagctgccggcggacgccaccgccaaggacattattctggcgatcatcgcgaagatcggcaccggcggcggtcagggctacgtcatcgaataccgcggcgaggcgatccgcaacctcacgatggacgaacgcatgaccgtgtgcaacatgtccatcgaggcgggcgcccgcgccggcatgatcgcgccggacgagaccacgttcgaatacctcaagggccgtccgcacgcgcccgaaggcgagctgtgggatcaggccgtcgcctactggaagacgctcaagaccgatgacgacgccgtgttcgacaaggtcgtggacatcgacgcgaccaagctcggccccttcgtgacgtggggaaccaaccccggccagggcctgccaatcaccgcgaacgtgccggagcccgacaagatcgccgacgccaccaagcgcgccgccgccgagcgggcgctgacctacatgggactcaagcccggcatgccgatcaaggacatcgccgtggacaccgtgtttatcggctcgtgcaccaacggccgtatcgacgacctgcgccaggccgcctcgatcatgaagggacaccacaaggccgagaacatccaccgcgtgctcgtcgtgcccgcgtcctcgcgcgtgcgcctgcaagcggagaaggaaggactcgacaaggtgttcgaggacttcggcgccgaatggcgcaacgccggctgctcgatgtgcctgggcatgaacccggacaagctggtgccgggtgagcgctccatctccacatcgaaccgcaacttcgaaggacgccagggcaagggctcgcgcacgcatctcgcgtcgcccgccgttgccgccgcgaccgccattcgcggcacgatctcgtcgcccgccgacctgtaaatactgcacactggctcccgctggcagcagctgtcagtcgaagactgactgagggtggggcggagtgtcgcgcactggcgccacccccccccagtcagcaaagccgacagcccccgccagcgggggcaagaattgaaagcctgatatccatggaaaaactcaccacattgaccggcgtgggcgtgccgctgcgccgctccaacgtcgacaccgaccagatcatccccgcggtgttcctgaagcgcgtgaccaagtccggtttcgatgacgcgctgttctacgcctggcgccgcgacccgaatttcgtgctgaaccagccggaatatgccggcaaggggcagattctcgtggccggccccgaattcggcatcggctcatcgcgcgagcacgcggtgtgggcgctgcacgattacggtttccgcgtggtgatcgcgccgagcttcgccgacattttctacggcaacaccgccaagaacggcgtgctggcggccatcatgccgcaggagtccgtcgaactcctgtggaagctgctggacgaggagcccggtcgtcagatgaccgtagaccttgagcagcgcaccgtcacctgcggcgacgtgacgttgccgttcgaggtcggcgattacgtgcgctggcgcctgatgaacggctacgacgacatcgacctgacgttgcagcatgaggacgacatcgccgcctacgagaagatgcgcgccgagaagttcccgttcaagcccaagaccatccccgccaagcattgggccgaggaacccatccagtccgcccgcgagcccgaagagagcgactgggcgggcccgctgagcgaccgcggcatcatctgaccgatcgggccagcctcagccagcgatgcctttgcgccggtgttggttgagcggagtgaaacctgttaatgtcgtatccgtatatcgaccgggatgttggccggtcatgatggcatgcacgggcgtgattgtcgcccgctgcaacggaaggggcattgatggattggcatgcgtccgtgtatggttcccgctccggcggcggccagtaccgcgacttctccgacggtgatgccgacgatgacggcgtcacgtacggcgctcgcggctcgtacgccgacatggcagacgacactgccggtgccgcggtgctgccgccctccgtcgacgacgccgaactgcgccggctcggcggcaacgccgtgtattttcgtgcgaaggacgtgctgaaatccgggcgtatgcacgacatggccgtatcgttcaacgtgccggattcgccacgtacctcgggcaccatgctgacgggtgcgcgggccaacgtacgcctgacagcgctggtcaaaggcgccgaccggtacgcggacgattaccgcgtctccgccgcgatcgacaccgacgcgggcaaggtcggccagtcatcgtgcacatgccccgcatacggccggttccggggcgtgtgcaagcatgtcatcgcgctggtcatggcgtacaacgaacatccggatgacttcgccgcggccgacgatggtaacggctccacgaacggtatcggtcgcggagccgcaggcttggttccctggcaacctgccgtgcgcacgacccgcgcgcttgacctgttcatgcggcagcaggacgacgagcgcacccgcagatcgcagagccggcagctcgacctgttgaaggaaatcggcggactggctgattccggaggtgtcgccggcgcagcccagacggcgcggttcatgcccatcgccagcgtgtcgctgcggctctccttgagtttctcgctgaacagctgcgtggcgaaattccgcatcgaagtgccgtcgcgcggcatctcctatgtggtcaaggacatcgcctcgctgctgcaatccgtgaaaaaccgcgagttcgtcgcatacggcaagaagctcgcgttcgtgcactcgcgcgacgcctttgacgagcgctcgcggaacctgctcgacgtgctctcccgcgcgcaggacatccgcgccgtcatcaacaacgacaacagcgcatactcctactattaccggcgtcagtcggatgacgcgacgctgacgttgtcggacggtgaggtcgccgaactgctcgatacgtacgtcggcaccgaagacacggtggaatacacggctccggcacggttctacgcgccgacgatgcgcgtatcagtcgtggacggcaatcccgatctcggccttgcggtggaacgcggcgacgatcccgaggcctcgaacggcagtacggcggcggccggttacgtgatacggcatgcgcagcgcgtggaacgattcattgaaggacagcgctcgcattacgtgatcgcgcggccgttttcccaagccgaatcgggcgcgggcgtggggtcgggcggtcgggcgctgctgagcgtcgatcgtgcgacgatataccggtgcgatgccgattttgcgcagaaacgggcactgctgagcctgctgtgcggcgaaaacgatcgcgaggcgatgtatctgagcgaaagtgatgtggatcgtttcgtgcgcacggtactgccgcaactggtctcccgccaggagaacgaggtcgggcggtcggtcgacgccattggcgcatccgccggtccgaacgcggaggacggttccgccgcgtcatcggtctttgaccggctcgtgccgccagctgggcgtgaaaccggagttccggcgcacggcggcttgatcatcgacgtgccgcccgagctgctggcgaaaatgcgcgtgccctgcaggctcgcgttttacctcgaccgcgaccgcgccggggtgacatgcgacgcgcaggctcattatggcgacaagcattaccacgtgttcgacggtgtcggcgtcgacgcgtccatgcgcgacaaggagatggagcgactcgcagtcgaggcgatgctccactatttcccgcgcccgtccggtgccgtggccgccatccccgagtccgacgacgaggcgatataccgtctgctgaccgaaggattggcggtgttgcgcggtttgggcgacgtgatggcgacgcccgcgttcgacggactgaccgccatgccgcgcccgacgatctccataggcctttcggtgaaatccgggctcgtggagatatcgccgatcgccgacgaaatcgacccggacgacgtgccgggcctgctggcgagctaccgtcggcgccgcagattccaccgactgcgcaacggctccttcgtcgacatgcgcaacgtggatatgtccgacgtcgatgagatcgcggatgacctgggactgcgggccgccgatctggaatccggctcgatcacggtgcccgcctatgaggcgtactatctggaccatcaggtcgacgacgacgcgaaggacgcaagcttcaccgcatacctggacggcctgcgcgtgatcgatccgtccacgtaccgcgttcccgctgcgctggcctccgtgctgaggccgtatcaggtcgaggggttccgctggctcaatgccgtgtgtgacaagggattcgggggtatcctcgccgacgagatgggtttgggcaagagcgtgcagctgctgtcgctgctgcttgcgcggcataaggagtcccgggccgagcaccgtccgaatctgattgtctgcccggcctcgctggtgtacaactgggtagccgaggtggcgaagcacactcccgagctgcgcgtggaggccatcgccggcaccaaaccggaacgtcgcgcgatgcttgacggcgtgcgcgccgcacagcaggacaccggtgtgtctccgacgcgggaatccgcaaggccggcatcggccgcggccgcgtccgacgacgttcccgacgtgctcgtcacctcgtatgacctgctgcggcgcgacatcgacgactatgcgggacttgagttctactgcatgacgctcgatgaggcacagtacatcaagaacgccgctaccaaggtgtcgaaagccgtgcgctccgtcaccgcagtgcatcgtttcgccctgaccggcactccgatcgagaatcggctgagcgagctgtggagcatcttcgatttcctgatgcccggcatgctcggctcgtacgcgcatttccgcgaacggttcgagatgccggtgctgagcggcgacgagaccgcacagaagaaactgcaatcgttcgtggggccgttcattctgcgccgtcttaagtcgcaggtgctcaaggatctgcccgacaagatcgagaacgtcatcacagtgcagctgcagggggagcagcgcaagctgtatgcggcactggagcagcagctgcgctcggtcatcctgagccagcgtccggccgatttcaacaccggcaaaatccagattctggcgcagctgacccgactgcggcaagtatgctgcgacccgcggctgatatacgagaacgccgacgggcatgccagtgccttgagcgcaggggtgcaatccgccgcgaaagacccacagcagtccgtgaaacagcctgtgaaacagtcgaaggcgcgcaagaccgtaagctccgcgaaactggacgccatcatcgaactggtggactcctgccgtgatgccggccgcaagatgctgatcttctcgcagttcaccagctacctcgacctgatcgcgcaacggttgcgggccgacggcgtggaatacgacatgatcaccggagcgacgccgaagaaacgccgtctggagctggtggaccggttcaacgccgacgcgacgccggtgttcctgatctcgctcaaggcgggaaacacgggcctgaacctgaccggcgcatgcgtggtcgtgcacgccgatccgtggtggaacgcggccgcgcaggatcaggccaccgatcgcgcccaccgcataggccagacacaggacgtcaacgtgtatcagatcgtggcgaaggacacgatcgaggagcgcatcctcaacctccagcgcagcaagacagacctcgcgcaacggttcgtggattccgcgtcctccgccaccggacggtcgatggccgcgctcaccaaggacgacctgctcgccctgctgggctgaaggtttttccccacgcaacagtcaattcgtcgcgataccatcggtgcttggatgttcgtaaaggaaaggacgtgatgagcgtgcgtaagaagctgatgagcgtggtcgccgcggtggcgacggccgctgccatgggcgcgaccggtgtcgctgccaatgccgctgatgttgttgccgtgccgcaggaggggctgtccgacacgggtgcgtcgatcgccatcgtcgtggtgcttgtcgtggtgctggccgcgattggcgtgggcgtcaccgtggcccggaagcgtcagagcgctacgggcgcacacgtgcagggcgagggcgagggcgccgacgagagcggactggtggccgatggtgctgatacggctgatacgcagaccgtgcagttcgatgatgccgctccggccgcggatgactctgacgccggttcgggggaatcccgcgactccgagtgattccggaataaccgcaatgtgcaaaaggccctcttcggagggccttttgcgttgacatggtgttttgccggtgtccccccccccagtcggccttacggccggtggtgccgtccgtaggcgaaggcgagccggccggcgagcgaataaggtcgcgcccgcaggacgggcgtccttgactgcagggcccgaagggctgtcgcgaagcgactgggggtggtcccacatcgtgagtgtgattcgaggtctacgatccgacgctatctgcatttcgaggggttgattcgacggtcgcgaaacatctatctacgtttcgagggggtgccgaaacgcgatacctggagtattgagcgctaatcgccattggaaccatgccgttctggaggcgttcatacttggctaccaaccccctgaaacgcagatagatgtcccatgggactcgaatcaaccccttgaaagcgagatatcgccaatcaaggcttcaaaatgtcgcccacaggcatatcgggcccacatgagatgtcgacactgacgttgatgggcgatacacggcgtactgttgaaccatgagcatgaacgatcggcaacaggaccatgggcaacctgatgatgagatggaaccggaaggccagcggcagccggctgctggagacggaaaccccgaaaaactccagatgcctgctggtgacgccccgcagcaagttgagcagccgatgcaatggacggccggcgaaacgccgcagcctttgccgtatttacggcctgtgaatccgccgcaatccgtgaaccggcctcagccggtcggccgctcgcagccgccggtggcgggacaatgggcaccggcttctgagccacgtccaatgcctccgattccgtcaggaacaggtcagccggggatgcgccagccgatccagtcgtatccgccatatccgtcacagctgtaccctccataccctccgtatcctccatattcctcggcgcaacgacccgtcgcgccgcccatccctgtcgcccagcccgtcccgatcgacccggtcaaggcccgccgccgctggctgcgaggcaccgtcacccgccacgcgggcctgatattcgcctaccagggcgtgttcatgggcgtgaacgtactggcctcgttcgtcatcggcatcatactgggcctgagcggagccgcggggcgaggaacgctgacggccgagtcgctcagcgccgccctcgtgcagctgaccggcgtgatcatgctgctcacggtgctcggcggcatgggcttcatactgccgatgcgccgcaggatgatattccgtcgcgacttctggctcggcgagcccggccatgcgcgtatgaaaccatcgtggctgctgacgttcatcatcctggtcatggcgatccagacggcgatcgtcctgatccagctcggcttctcgatgttcggcactacgttgcaatcgcccacatccgacaacatcagcgaggcctcgaccaacatttggatgtggctgtatgtcggccttgccgcgccggtcgccgaggagctggtgttccgtggcgtgctgatgcgcggcctgaagccgctcggccggaatttcgccatcgtgaccagcgcgctgatgttcggcctgttccatgacgatgtggtgcagggcctgttcgcgttcggctgcggtttgctgttcgggttcgtggcgatggagtattcgctggtgtggtcgattgtgctgcacgtgttcaacaacgccgtgctcggaggcgtgctgccgtggctggcgggcctgttcggcgacgcgggggacacggcgtatacgctgggacttttgggtgtttcgatcatcggcctgatcgtcgtgctggtgaaatacggcgggggattgcgcgcctatcggcgggtgaaccgcagtgcgccgggaacgtattgggggtggacgtcgcctgcgttcctaattttcgtgatcgtgaatgtggcgatcacgatactgtcgttcgtcaccgcgatgatgggcgtctgaccagcctggcagacggcctggcgaatgctcccggtgttgcgggtctgccgctgtttttacagtggatatatcgtcgtgtttgtggcgccggcagcggtccggcgtcggttgagtgtctggagagccatgagtgatttcgagccgttttacaacgttgacttaagttatgaggataattatgcgcgcggcccgttcggcgagttcgccgcggcgctgcgcggtgatgtgccggccggcgaggccgcttcgccggcgaagtcgtcgttctttggcatccccgttgacctgccgttcggcattccggccgggccgctgctcaacgagcggttcaccacggccgcgttccgcatggggttcgacatcgccacgtacaagaccgtgcgctcgcgcgcgtgggggtgcaatccgttcccgaacgtgttggccgtgcacccgaccagtgccgacggctcactgacgccgggcagcgccgaactggatgagggcgtgcttgcggacacggactatcgcctgccgatttccatttcgaattcgttcggtgtgccgtcccgcgacccggatgagtggcagccggacatgcgccgggccatcgcggcggccggcccggggcaggtgctgctaccgagcttccagggatcgcgtgtggagggcatgagcggcgacgactatatcgcggatcatgtcgcaaccgcacgattggtgtgcgagaccggcgccgacctcatggagatgaacacgagctgcccgaacgagggtcataatcgcctgctgtgccatgacccgcatctggtcggccgcatcaccgaggccgtcaagggcgaaatcggcgaccggcctctgatcgtcaagctggcgtatatcccgccgaccgaggtcgagggtggctgggggccggatcgccgcgtgattgacgatgccgctctggagcttatggtgcgccagaccgccgcccgcggcacggtgcaggcgttcagcacgatcaatacgatttcggcccggctcgtcgacgcgaacggcgggcaggcgctgcccggcaaggggcgcgaccgcagcggtgtgtgcggcagcgcgattcgcggggcaggccttgacatggtgtcgcgtcttgcggcgattcgcgagcggctggggcttgactatgcgatcatcggcgtgggcggtgtcgtggcgccagaggattaccgggcgtaccgcgcggccggcgccgatgcggtgatgagcgctaccggcgcgatgtgggatgccgagctggcccgcaagatcaaggcggatgactgatccgctgtatcagcgaatcgttctcaatagcgtttgtgcgagtactcctcacatttgcgaacaaaacgaacatcggcttactcgttggaatatcggccatatgcatacaatcatgttcgttttgccgacgacgggactcgcacgtttcttattgagaaccattcgctgcgacatggtaatcggcttccggcgcatttcacgtgcccgccacatgccgtatggcaaactaatggatgtgatgtccggggtggcccggcgaatgaataggagtgttgaggatggcggaatcggagaacgatgtcctgcatgtggtcggcggcaaaccgctgaacggcacgatcaaggtgcgtggcgcgaagaacttcgtgagcaaggcgatggtcgcggcgctgctcgcccccggcaaatcggtgctgaagaacgtgcccgagattcgcgatgtgcatgtggtgtccgatctgctgcgcctgcatggcgtggatgtggaggtggatggcaccaacggcatcgtcaacatcgacgcgacgcatgtgcagctcgccgatgtggcggatgtcgacacgctgtccggctcttcgcgcattccgatcctgttctccggcccgctggtgcatcgtctcggcgaggcgttcatcccggcgctgggaggttgcgcgatcggcggccgtccgattgatttccatctggaaacgctgcgcaagctgggtgccacggtcgacaaggagcacaaggacggcattcacatcaccgctccgaacggcctgcacggcgcgaagatccatctgccgtacccgtccgtgggcgcgaccgagcagacgctgctggccgccgtgctcgccgaaggcaagaccgagctgtcgggtgccgcaatcgagcccgagatcatggatctggtggccgtgctgcagaagatgggcgcgatcatttcggtggatgtggatcgcacgttccgcatcgagggcgtcaaggagctcaatggcttcacgcacacgtcgctgaccgaccgcatcgaggccgccagctgggcgtcggcggcgctcgccacgcgcggcgacattttcgtcaagggtgctacgcagccggagatgatgacgttcctcaacgtgttccgcaaggtcggcggcaagttcgaggtgaccgacaggggcatccgtttctggcatccgggcggcgacctcaagcccgtggccatcgagacggatgtgcaccccggtttcatgaccgactggcagcagccgctggtcgtggcgctcacccaggcgaatggcctgtcgattgtgcacgagaccgtgtatgagaaccgattcggcttcaccaagccgcttgtgcagatgggtgcgacgattcagctgtatcgcgagtgcctcggctcgctgccgtgccgtttccagcagcgcaactacaagcattccgctgtgattttcggaccgaccccgttgaccggccgcgatatcgacgtgccggatctgcgtggcggtttcagccatctgattgcggcgcttgccgcgtccggcccgtccaatgtgcatggcatttcgctgattgaccgcggctacgcggatttccgcggcaagctcgccgcgctcggtgccgatttcgagtaacggtacagagagcctgtagggccccgatttccgctgaaggaatcggggccttctctgtgactgattatggtcgatgaaaaggatgcaccgccgtcgtcagtcgtcgaagtgcgcgaacagcgacgcggacagcaacgccatagcgatgagcactgcgcctgacgcgatgaatatcgcggcggcggggagatgatcgaacgcccagccgtacgccatctgcccgagcggctgcatgcacatggccagcgcagacagcagcgccatcactttaccgagcatcgcatcgggcgtgcgcatttggattgcgggcacggcgatgatattcgcgcatgagcagatgacatcgccgatgcaggcgaaggccacgagcgccatcagccgcgtccagttgccgccagacagcatgcaggccacgccttgggggatgacggtcagtccgagcaatgtcaggatcttcgtcatatggccaattttcagccgtccggccatcatcgtcacgatgagcatgcccatcagggccgcgacgctgatcagtccgtcggcaatgccgtagacggtcgcgtcgaacccccattgcgtgcggatgacgaacgcgtatccgacggcgccatagccgagtacgacgaagttcagcgctgaggcgagcaggaccattttcagcaggttcggtttttcccgggtcaggaaccgcagagcggccttgagatcgtcgagtggcgtcggcatcttctcgtcgcgttcgggcataccaagccggatgaagcattcgatggccgccgcgccggcgaatgccgccacggagacggccatcatcggccggatgccgaagaacgagtacgcggcgcctccgaggaagctgggtatcagtgcgctgacctgctgcacctgactgactatcgcggcgctggtgttcagcgtcgcatccccgtattggcgcagcatctgcggcagcgcggattcgacggtcggcgtctcgaagataccgagcagcgatagcgccacctgcattacgcccacggcgatgatgctgaatccggcggcggagaaccagacgagcgcgagcgcgaccgtcacggcggatgccgcgtcgaggatgaccatgagcgtgcggcggttcatccggtcggccaacacgccgccgaacggggcgccgaggatcatcggcacgaacgatatggcgaggatggatgcgaatgcggtggctgagccggtctcgtccagcacccacatcgacatggcgaagcgcagcatcatgttgccgaacagcgagatgccttgcccggcgacgagcaggatgaaattgcgggagcgcagcggatgcgcggcctttggctgcgcttgcggttgcggttcgggggaagtgttgggttgctctgtttcgtgctgtgccgcgggaagctgtgtttcggagggttgtgccggtgtggtgggcatggtgggttcctttgctgctggtggcgagttggtctcggtgttttgcgttggtggatttggcgtgagtttgatggatggtacggcaatgtattggggcggacgattttgacgccggagttggtggttcatcggcaatcattcataccgactgacggtatgtaaatcggtgctggagcaggggcgaaacattcgtgccgcgtcctgccccggagtcagcgtcgtctagtgtgcgtcgcttaccggactggtgccgcctccgtcttgttgctcggcggcgctgccgctgccgtcgccggcgaaggccatcatgccgtccgtggcgagatcgatgagatgctggtcgaagaccggcgcgtgcagcgcgtcgagcatggtggcgaggcattgcagacgataccgcagctgcgtgcgcgtggcggggaagaagcatggcatcagccaatagttgcatagcagggccagcagctgcgccacttcgcgcgggtattcggtggggatggagccgtccagctggccttcctcgatcaatggctcgaagtttttcggcagctcggttgaccagaatcgcatgttggcggtgaatgtggcgggatcgtcgaagaacggcacggtggccttgacgagcgccaggtgcgcggcgtctcccagcgagttggcgaacagcgagcggagcttttccatcgcgttcatgtcgtcgcgtttcgcgatctcgtcgcacagggcctggctggcgtgccagtcgtcggtgttcagtcgttcgaggatggcctctttggacttgaagtggtggtagatcgcgcctctcgacaggtctcccagcttatcgatgatgtcctggatggaggtcttgtcgtagcctttctcggcgaacagctttttcgcggcggcgaggatgcggcgttccgtcacctcggggtgcgggttgcgtgccatggttcctcctttcgatatgtcatcagtatacataccgacagtcggtatgtatactgcgtgtcatgattgcggccgtctgtagggccttttcggggtggcggcatcgcgcaaaatgggcaaaaccgtattggatatcggttatatgctatgttggtcaatgttgggcgttggcgcttgaccgaacgaaagaaggcacatatgacagatcccaatgccggtttccccactggaaacaactcttatggagccccgcagcccgctcagccggcttcggacgcaaacgcggcctatcagcagccgcagtacaccgcacccgtgccgcctgcccagcccgtgccgcctgcccagcccgtgccgcctgcaggggcaccctatcaggcgccggcaacccccgattacgcggcgaacatccagaactccgtcgccggtttcgcccagaacctgggtggcaagaacgtgaccgtcggaggccagtcattcgacttcatttccatcatcacctacgtggccggcgtgctggcgatcatcgcctgcatcgtgccgttcgtgtcggcgtttggatacagcgccagcctgttccaaggcggggacggatggattgtcctcgttgcggttcttgccatcgcggcgctcacgttcttcaagaagcacctccccgcaatgatcatttccgccttggtgctggtactcagcatctttgagatggtgtattccaagatcaagatcaacagtagcttggacgagttcggcagcaactatggcagtctgggaagtctcgcgtccggctacgcgaagaatgcggtggctttcggtattggtgcatacttgctcatcatcgcggcgctgggcctgattgtcggcaccgtgcttgcgttcggcaatcagaagaaggccgcgaaggtcgcggtgccgggtgtttccgcccagccgcagtatgtgccgacggcattccccggtgctccggtcccggcacctgccgcccctgtgtccgatgccggcgttcctcaggctcccactgcaccgcaggccccgaccgcaccggtcgcctcgactgcgtatgagcagccggcgcctgccgctccggtttaccagcagcccgattcggacgcttcctacccggggcagaccccgcaggcctgatttctaggtcttccgcgttccgcgcctgatcggcgtgaagcgtgaccaatgagccgctgtgcacatgcatagcggctcttcacatatgcgacggatccgagcccaatgaccctgccgataatccgggaaatatgaacggccgcacgcacccgcgatgccgcgatattgtccgctctcataggcataatagaaaagttgtgtctggaggatacgtgtatgcgaatccgctagcacagcacagcaatatacgttgcgggaggaatccgccgcgggcgaccgccgcgggtgccgacatcaccgcttcatagaaagaagaaccatacaatggctcccaagaagaaagtctcggcgctgatcaagctccagatccaggctggcaaggccaatcctgccccgccgctgggtccggctctgggttcgcatggcgtgaacatcatggacttctgcaagcagtacaatgcgcagacgcaggacaagatgggtcaggtcatccctgttgagatcaccgtttacgaggatcgctccttcaccttcattctgaagaccccgcctgcagcggctctgctgctcaaggccgccggtatccagaagggcaccgaaaacccgctgacccacaaggtcggctccgtcaccaaggcgcagctgcgcgagatcgccgagatcaagatggctgatctgtccgcccgcgacgtcgaggctggcatgaagatcatcgcgggcaccgctcgctcgatgggcatcacggttatcgactgagaggagaaggacacatggttaagcgttccaagaagtaccgcgaagcggctgagaaggtcgatcgcaacaacctttacaccgccaacgaggctatcgctctgctcaagtccatgccggcctacaacttcgaccagaccgtcgaagccgtgtaccgtctgagcgtggatccgcgcaaggccgaccagctggttcgtggcaccgtcaacctgcctcacggcactggtaagaccgccaaggtcgccgtgttcgcccgtggcccgaaggccaccgaggctgtcgaggccggcgccgacatcgtcggtgacgacgacctgatcgagaaggtccagaacggcttcctcgacttcgacgccgtcgtggccaccccggacatgatgggcaaggtcggtcgtctgggccgcgtgctcggcccccgtggcctgatgccgaacccgaagaccggcaccgtgaccatggacgtcaccaaggccgtcaaggacatcaagggcggcaagatcgagttccgcgtggacaagaacggcaacctgagcttcctcatcggcaagctctccttcgacgagaccgctctggacgagaacttcaaggccgttgccgacgaagtcaagcgtctgaagccggccaccgtcaagggccgttacatcacgaaggtgaccatcacctccacgatgaaccccggcgtcccggtcgatccggtggctctcgcctgatcaacgccaatcggctcaaccttcataggggcttcccgcacgcgcgggaagcccctatgtcgtatttcgattccctactagactccccagtttcgctgcgcttgacagccagcgggggcaaagtaaaccgcccgccgctggcgggggctgtcagtctttgactgactgggggtggttcttgccgccgcatatacaaaagccgcccggcacacacatgcgccgggcggctttcagctactgtcgcggtcgcctgtcagtaggcggccagaatatcgaccacgaagatcagcgtggagttcgcggggatggagccctgggcggtgtcgccgtaacccaagttcggcggaatcaccattagcacctgcgagccgatcgtctggccgaccatggcctgctgccagccctcaatcacctgatggttgccgccgctgtacgtgtcggcctcaagcgtggtgttcttgtcccatgacgagtcgaactgggtgccgtccaacagccatccggtgtacttcaccttgacggtgttgttgttcgtgacctttttgcccttgcccttgatcagcgcctgcgagaccagcttgctgcttcccttgtacccgttcatgttgatggacggcttgccgttcttcgctcgcgtgaccttcggcagatcggacgggatgtcggtgacttcgtcgcctgtggccttggtgagatccttcgacttggaaacgtaggtcagcgccatgatgtacgacgtgccgttggagttggagtcattgacgccgtacgcgatcgtcgtgttgagcttgcggcccttcagcagctcatagtaggcgtcgctcaccgtgcccttttccagcaccagggagcaatcgggtgtgttcttctcccagctgctcgcaagctcggtgccatccttgacgctgatggcgatgccctgcgagcacagacggtcgccatcagcgatagtggcgccgttgccttcctgcagcacggcatagctgttgttgtcgacggtcttcggtgccttgaaggagaccttcggtttctcgcccagcgtacccgtggcggtgatgccggcgatcttcttcatgttcttcaatgcgctggagtcggaggactgcgaggagtcgtcgccggatttctttgacgacgagccggaatcgccggagccgcacgcggcgagtgtgacgcacaggccgaccgtgcacacggccgcgagtacgcgcttgaacgtggatgtctgtgtcaacttacgcatggtcaccacactagcggaaaaccctgatttttctttggaaacgtctttttcgccggggctttatgccctgcattgtagaatgggtgagttatgaagaaacagacatcaaaagagcgcaagcgtgacgagcgaaagtccaagtcggccgcccgtccgacgcgccatgcccgcatcatgcggggcgtggtgacgcccatccttggtcttctggctgtggcatgcattggtctgggcattatgaacgccacatattggaagcccagctctcagatcgcggccagtgccgcggtgaaggggacgcaatatatcgttaccgatcccggcgtgctgccgctggtggacaatcaggtgacggtttccgccgatgccggttcgtccgacagggaagtatgccttgctctggggtcgaacaaagatgtgatcggttggctcgccgggcagccatatgtgcgcgtcaccggcttgaacgaatggacgacgctcgcgacgacgaaggtctccgcgcaggggtctgcggccgatgcgggcgatgacgcagtggcgttcaaggactccgatatgtggacttccgtgacgtgcgggacgggcaccgtgaaagcggagaccaaggtcgcgtccgacagcggtaccgtagccatcatcgacttgggcaagtcctcgaacgcgacggtgcgcatgaactgggtgcgtcagactctacctgatttcgccatgccgttctatttcgccggaggactgctggcgctgctggccgtactggccgcatccctgttcgccatgccgccgcacaagcgtcgcaagcgcgtggtgagtggttccgcagccgaaaagcaggcagaggaggtcgccgtttcgcaggcggtggcgggcagtgtcgcgagtctcaaggcggcggtcagtttcaagccgaaatccaagcgccgccgtcatgccgcgcatcgtgggaaacccggtgcgggcacgccggcaaagccggaaatctcccagccgaaggtcgtcgatcccggcagccgcaaccttgtcgccgaccagcagaacgcgcaggccatggaccagcccgacgattcggcgacgtcggtaatcaccgccagcgagctgcagacgtatttcgcgcggctttcgcaggaatccgatgatgacacgaaggggagctccaatgaataaacgcataaccaccgccctggcggcgacgatggtctgcgctctgacgctcggccttgcaggctgcgaggggcaggtgccacagaccgtggcgccgtcggtgaaggacaacgagatcatcgatgtgaccgtcgcacaggagaagcagatccgcgggaagatccttgacgtgctgaaccaggcgaacgaggcgaaaagcaccgacgggctcgccgcgcgcgtgtccggctcgcaactggagatccgcaccgcccaattgaacattgcgcaatacacgcagcaggatgtcacgccgttggcgactatccccagtgatgtgacgcaggtggtcatcccgaccgacaacgcatggccgaggtatattttcaccgtcaccaccaccaccgaggaccagcaggcgaagcgtctgctggtgatgcggcaggagtccgcccggcagaactacaagctgtgggctgtcgcccgactgcttgaggacgtgtcactgccgggcttcgcgcccgctaagcagggcaatgtcatgggcgatgccaacgactccaatctggtcatgacccccaagcaggcggtgcagcgatacgccgatgtgctgcagaacaacacgaacagcaaatacgcgggaagcttcgaggatgaccagttccgccagtcgctagtcaagcagcaggaagaaagccagaagggtgtgacccagaacaagggcacgcagcaggaggtgttcgcgccggtcgtcgaccagatcgccgtgatgcgctcccctcgtggcggtgacctggtcgtcgcgcagatcaactcggagtggacacggtccatgagcgagggccgtgagtcgttgccggggtccccgaacgaggatgcgctgttcaagatgacgaatcagaaggccaccagttcgctgaaagccacttatgtgaacgttgtggcgatattcgtgccgctggccgggtcggatcagaaggtgaccgtggtggcgggcgatcgtcaggcggtcaaggtcgaggcgcagtagacgccggactcgggccggcgcacggacttgccaagcaccggaatcgggcgcttgcagcgtaaccggaggcggtgagacgccgtggcctatatagtggtatgcgtcaacgatgttcgcgacggaatcgacggtggtcgcaggtatgcggccgcgccgattttcgcgcggcatggatgtgacggaacggcgtgcggcgcagaccgcgggccggtatgagtcgtgaaaacggaggcatgatggcacagcagcaggagtttcatccgggattgtcactcgcgggcgcggtggatctcgaatcgttgaagcatcaggtgaaggcggagccggggcaggccgggggagcgccggccgcgggcggctatgtcatcgacacgaccgagaacacgttccaggcgatggtgcagacctccgccacgttcccgatcctgctgctgctgtggatcccgaccgatgaccgtctgttcccgatggcccgtacgctcggcgacgcggtgaacaagctcaaagggcagattcagctgtcccgcatcgacatcgcaagctacccatcgatcgcgcaggcgttccaggtgcagggcgcaccggcgctgttcgcgctgatcggtggccgcccgatgccgattcttcaggggctgccgggcgatgacgagctgaagcagatcgtcgatcaggtcatccccaagctaatttcggtggccgcgcagtccggcgtgaacggtactgcgccgtattccggcgacccggactcggccgacggtgacggtgctggtgccggtgacggcgcaggtgcggcggctggtgccgacgtggtgccgcccgagcatcaggaagcgcaccagcttgcggcgcagggcgattacgccggtgccgccgcggcctacgagcaggtgttgcaggcgaaccccaatgacacgctcgccgcgcgggagcgcgcgaaggcgctgctgttggcgcgttcggcgaccgctgacgtgcgcgaggtacgcaaagccgccgcagatcgtcccgatgacgtcgaagcgcagctggccgtggcggatgtggacatgatcggcggccagatcgaggacgccttctcccgtctgctggattatctggcggacggtcacaccgatcaggtcgagccggtacgtaagcgtctgctggagtacttcatgattcccgaagcgaccgatgagcgcgtcaagcgtgcccgtcgccgccttgccacgctgatgtactgagcgccatcgcgccaaaatatgtcattatgctgaaaccgccgcggtgccaattcttgcatcgtggcggtttcagcggttttgggcctgtggtctacgccttatagtcccatgcggttacggccaaactgggtttggaatcggggcccgtcccggtgcagctcggcgtcgaagtccgcggcccactgcgagaacggccgcgaagccagtccgtcgttgctgaaccgcgcctgatcggtgatctccgtcacgcagaacgatggaatctgcagattggtcacgggtccgctacgctccgcctcggcgacgaccagcggggcgttcgcgccgccaaatatgtcgaggctccatccgtcctcgccgatccatgcggagaaccggttcttgataatcggacagcctccgcgcatcaccagttccgcggctatgcgggcgtcgatctcccgttcggcctcataacgggtgccgcccaccgacggccccttgacggtgacgaacgcctcggtgaaccggtctcggtattgcctcagtacggctatcggatcggtgtcggcgttcatatcgatgcgcaccccgtgtgtctgtagccgcactcgcaacgcgtaattaccgtcgtgcacataatagctctgcacgatcagcatcggctcgccgtcatccagttccggcggcagcgccctgcagaagaaccgacgttcatattcgaaatcgttcatggcgatgtccataccactccagtgtagtcggtgcgggagcgcgtaaacccgggaattccgcgaaattgtcgacatgttgggagtgggatggtgtacagtaatacagttgcttgccgcaaggcgagcgatgtctcgggttcgtagctcagtggatagagcgtctgtctccggaacagaaggtcgagggttcgaatcccttcgagcccaccagcaaaggttccataccatcggcatggagccttttttcgtggtctatctgcgtttcgagggggtgattcgggatgcgccggacatctatctacgtttcgaggggttgatagccaagtataaacgctacgggaaccgcatgattccagcaagaatcaggtcgaaatactctgcatatcgtgttttggcaaccccttgaaacgcagatagatgtccccagactgcaaaatcaccccctcgaaacgcagataggagatgttgcggcgaaagccggtcgcggcggttgtctccgcctcgcgaccggtcagctcttcttgggggcggtggtgctttcgcggacgaccaggcgtgtgggcaggatcaggtagtggtcagcgacggagcctgcacgcgcgtcgagaatcatgtccacggccttgcgggcgatcatgtcgaacggctggctgatggtggtgagcgccgggtacaggtattgtgccgggtacacgttgtcgaagccgacgaccgacaggtcagcgggcagggacaggccgcgttggcgggcagcgcggtacacgttgagcgccgtgacgtcgttgcatgcgaagatcgcagtcggccgtttggcggcgggcaggtcgagcagttggcatgcgcactcgtagccgcgttccggcatgtagtcgccgtaggcgaccagctcggggtccagctggatcccggcgcgacgcagcgcggtggcgtagccactgtagcgggcctgagcggattctgcgttctgcgggccggtgatgatgccgatgcgctgatggccgagtttgatgaggtgctcggtggcgatcagcccgccggtccagttgtcgatgcccacgccgagcgtgtcctgcgacccttcgccgatggagtcgataatgacgaagggaatgttgcgcgaacgcaatagtgttttttcgcgttcggtcgcgttggacagcagcaaaatgacgccgaggggattgcggttgaggatttcccggaagctttcctcgctgcgcttgccccgcccggtctgcgtgatggtgatgccgatgggcatcgatttcacatattcggaggtctccgcgatcatcgcgttgatgccgttcgccatgacctcggtgagcacgagctcgatggtctgtgatgtcttcgtggtgacgagagacttggagtacccggattcctccatgattttctcgatgcgcgcccttgtggagctggatacgccctctcgcccgttgatgacctttgatacggtcgcggtggagactccggcaagcttcgctatctcactgactcgcggttttttcatatcgcctgccatcggttgctccgtttcttccgtacttcattgtgggtgtgtctgcgttcgttgcagacgcacttcacactatagtaaagcgtttcgagatagatgaaagaaaatttctagaataagtggtgatttttctaaaagatgtgtatgatgggaacgaaacacaatacatcgagaaccattgaggcgaaggagccaacatgggcaccatcatcggagtcaaaacctacgacctgcgtttccccacgtccagcacgctgtcgggctcggacgcgatgaacaaggaccccgattatcctcggcatacgtcgtcatcaccaccgacgcggatggcggcctgagcggcagcggcttcgttttcactgtcggccgtggcaacgacgtggtcgtggctgccgtcgactcgctctcccgcatgctcgtcggccgcaacgtcgagaacctgctcgacgacatgcgcgccgcatgggacatgttcgtccacgactctcagctgcgctggctcggcccggagaagggcgtcgagcacatggccatcggcgccgtgctcagcgcgccatcgacccgatcgcggtcgccaacggcgagcagatgcagaaccgcatcatggacaagcagtatctgcaggcgggcagcttcaaggtcatgcagatcgacgccacgcgcgtcgccgggccgcaggagatcgtgctcgaatacctgctcgccaacaagttcggcgtgcgcgtgtgcccccacgccggcggtgtcggcctgtgcgaggcggtgcgccacttcgccatgtccgattacctggcggtcagtggacaatgggatgatcgcgtcatcgaatatgtggacaaccagcacgaatacttcgtgcatcccactgagatcgtcaatggtcgttacaaggccccgaccgctccgggctcgggcgtcgacatgaaactcgaagccgccgaacggtgcctgtacaagggctgatcgcagcgccgcggtgccgcggctcgcacggacacgaacacaacaaaggacactgaaacatcatggatttgcatctggaaggcaaggtcgtcatcctcaccggcggtttcaagggcatcggcaagggcatcgccctgcgactggccaaggagggggccatcgtggcggttatcaaccgagacgacggcgccgccgagcagttcgccgccgaaatgaaggccatcaccgacaactaccgcacgtatctgatggacctcaacgacaccgacgacatcgcgccgatcgtcgaggatgtggtgaagacctacggccatatcgacggtctggtcaacaacgcgggccgcaacgacaacctcgacctcgaccacacctcgtggcgcgaattcgagcagtcgctgcacggcaacctcacgcgctattacgagctcgcccaccgctgtgccccgtacctgcgcgaatcgaagggcgcgatcgtcaatatctcgtccaagaccgcgctgaccggccagggcaagaccggcgcctacgccgccaacttgctcgtgttcgacgcctccaagggcgtccacttccacgacgaggtcttcaaggacaccgtctacttcatgaacaacgtgttctgcaacacctccaccacgccgacgcagtggtaccgcaagaccgacgcgctcgccaaggccgcgttctcgaacaacgactactacgaggccggcggcaaggcttcggacacccagcctgaggacaagcgtggtctggaagtcgacccgaagttcgtcggcttctccggcggctccgacaccccggccggcaagctcgccggcgtggcgccgaagccaaggccaacctcgacaaggcatacacctcctccaagctgcgcgtgagcctcgactccgtcaaggccggcgtgcagtgggcgccgacgatgagcgagatccaggtgcacaacggctccggttctgcctcctcgcacaagccggctgtcgccgtcgtcaacagcaacttcaacaagcaggctcctgagacgctgcccgagtacaccgtcacgctggacggtgacaagctgcagtccatccgctggatcggctccgaaggcaacgtgctgagcagcctcgacgagggagactacacggtgagcggcgagggtgacaagatcacggtgaagatcgccgccgacttcctcaagggcaaggacgcgggcaactacggtctgcagttcgagtttgcgtccgtcgccacccgcaaggtgtcgctgaacgtgaccgacgaggcagtcgagccaagcaagtcgacgactccggccaagccgggcgctaacgagcagccgaagaccgaaggcgtcgcgaagaccggttcgtccgtgcccgccgtcgccgccggcaccacgatgatcgtccgcaagcgcgccactcgctgaatgacacgccgtaaaggccggggccggtaactatgtgccggctccggcctttgccggtacgatggatataatggatgtcttgccgttgcgataacgccgcggcagacaaaatagaagaaacgttccagagcacagaaaggaacattgatgtcaacttctggccgttttacgattccgagtgaatcgaacttcgcggagaagaccgcggaactggcccggttgtggggtgccgacgcggttcgcaactcggatggcacgcagttggacgacgaggtcgtggcgctgggtatgaaggtctacacggcctacttcccgacccgcgcgcacaacgagtggatcacgctgcacatggacgagaccccgcaggtgtacctgctcaataaaatcaaccaaaaaagtagtacaaacacactcttgagttctcaaaccaccacacatcaacaagcttcgttctcaggaggagaagtccgccgtgctgagcagcaagagataaacatacacgggatgggcgaacaacgcaaaccgatgggcgcaggaaagctaggaaccgttgcaatgacgcggttccttcggcgtgtcgcaaaagcctgtttttggccttctgataccagagtagacctcgaataccgctccacacagcactacactcactgtatttcggcgtgtcgcggattgttcaccgcccattcaccgcgtccgcgtcgccgcatgccgggtacagcgcgtcctaatgtttcagtatgaacgaacgaaacatcatcgaaacccaaccggagcgcacggatctgccgctcatcgtgattcccgtgatcgtcgaatcaatgatcgagccgttcgccgccaacttccccctgctgcacgatatcgcccgtatccgcatgcactgcgatttcacgctggacaccgacaccatcctcgaacgcaccaaggatgccgaagccgtcatcgtcatcggcttccacatcaccgatgacatattggacgcgatgaccgttcgtggccatgtctcgtgctttgcgttcggcggcaccggcgtcgccagctatatcaatcttcccgtcgcgcgcgagcgtggcatccgcgtgtgcaacgtcgtgcattacggcgaccatgccgtggccgagcacgcattcgccctgatcatggagctcacccgacaggtcggccggcttgacgcgcaggtgcgccgcggcgactggggcggcatcgacggcatcgggctgcacggcaagaagctcggtctggtcggattcggcggcatcggccggaccgtcgcccgcatcgccaatggcttcggcatgaagacactggtatggaacagccatgtgcacggcatcgatgggttggacatcaccctcattgacgatatggatgaggtgttcgcgcagtcggatatcatcagcctgcatctgccgctgctcgacggcaccgcaggcatcatcacgtctcggcagctcgaccggatgcgccccggttcgatgatcgtcaataccgcccgcgcagaaatcattgaaccgggggcgttgacccgccggcttcaacgaggcgacgtgcgtgcggccatcgacgtgttcgaccacgagccgctgccgatgggcgacccgctgcgctccttggacaatgtcgtattgacgccgcatgtggcatggcgtgacgacgaggcctgcgtcaatctgacccgacaggtgatcgacgcggtggcctcgtatttcactggcggcgactataacgccgtgccgtagcaccagtcagctgtggcggcgcttgccgcggcaccgctacagcgaggcggcttcgataagacgaaccgtatattcggacttgggatcgcccagaatgcttgcagtggagccgacctccaccacatgaccgtcgtgcagcacgagaatacggtccgctatatgctgcacgacgcccaggtcgtgcgaaaccatgatcagcgccgtggacggcttggcctgtcggatcgcggcgaacgtctccaggatctgcaggcgagccggcacatcgatggcgctcatcggctcatcggcgagtatcacgtccggctcggtgatgatcgcgcgggcgatggcgacgcgctgcgcctggccgccggacagatccattggatatcggtcgatgaacacgccggcatccaatccgacccgttccagcgccgcgtgcacgttctcgcgaatgcctgcggggtcgggcctgctcccccgccgtcgcagggacaacggctcggcgacgatatcgccgaccgtccatctggggtccagtgatccgtagggatcctgatatatcagtccggaatcgtggcgcagccgccgcagaccggagccgccacgcagcaccggcgtgccgcggtactccacagtgccgccatcggcgttccccaaccccagcatgatgcgggtcaacgtcgacttgccggagccggagccgccgatcacagcaaggcactccccctcatatacgtccacgtccacgtcgaacagcacctgatgcgcggcggcgcgccggccgaacgacttgcagatcgaccgcgcgcccaatacgacggcgggcctgtcgagtttccgctcggaaccacttgttgacggttccgtcatggagggtgacgcggcaacttgggatatacggaaatcgctcacgatgactgctccttatccccggcatccccggcatgcaatgtcagttcccgggcagccccgatcagccgccgcgtccgctcgtcgcgcggcgaggcgagcacgtcggcggtgcgccctgactccactatccgcccttcgtcaagcacatagcagtgtgtcgtcgcgtgggccagcacggcgaaatcatgggtgatgaacagcagtgacgcgcccatgtcatcgaccagggagaccagcaggcgcacgatctgccgctgggtgatcgaatcaagcgcggtcgtcggctcgtcggcgatgatgaaacgcggagaggtaatcagcgcagtggcgatgccgacgcgctgctgctgcccgccggacaactcgtgggggaatttgccgaggacgtcgtccggcagcccgaccttgcggatcatcgcgcggacacgctcccgacgctcgacggcggtcaggtcataatggagccgcagcggtagtccgacctgcttctccacactcatcaccggattgagggatgcggccggattctggaacaccatgccggcgtaacggccacggatgtcggcaagacgcctgtcatccgtaccgaccgtctccatgccgcccatcactaccgagccggacaccacggcatgcgtcggcagcaggccgagcatcgccttggaaatcatcgacttgccggagcccgatgcccccaccaggccgacgcgctgcgcgtcggcgatatccaagtcgacgccgcgcacgatgggcgcaccgccgatggcaatgttcaggtcacgaaccgtaacgctcatcgcgcacctcgcaatcggtgattcgtcaatgggtcggcggcgtcgcgcagcgcgtcgccgaacaggttcaacgcgaccaccacgagcgtgacgatcagccccggccacagcacggtcagcgggtacacgttgatgaacttcacggacgtggccagggagtgcccccaactgggcacgcccgacggcacgccgatgccaaggtacgtcagaccgctttcggccaacaccgcggtgcctgccgacagtgacagctgcaccgtcagcacaggcgagatattcggcaggatatggcgcgccagcacgttcagtcccgaagcgccgttcgacagcgccgactcgacataggacgaacgcgcggcgagcatcgcctgagggcgggacacgcgcgccagattcaacccgtatccgaatccgcacgcgatcacgatgacggccacggacggaccgagcggcacggcgagaatcagcgcgatcagcaccgtgggaatggatatcagcgcgtcgacgacgaccaccgatgccgccgaaagcgccgcgtgcctggacaccatcaacgccacgatggccagtccgaacaccgcagcgacggccacggtcagcacgacgatcagcaggttggtgcgggagccggccagcaaccagctgaacacgtcggcaccggtgccgtcggttcccagccagtggtcgcgcgacggcttcgcccacacatggtagccgtcggtgctccacagcgaatacggggtccagaccagcgacaccgcggatgatgccagccataggccgagcacgatcagcgagaacttgcccgcagcgtggccccacatcgtacccagaacgacacgtgcggcgcgcacgccgcgggcagtgcgggcacggtcttgcgccgtcgtcgcactgttcccggaagacggttttccggctccggcttgagtcttggcatcgatcggtcgcgtcatgcgttcacctccgtgacatcgtcagccgacttcagccgcgggtcaagcacccgatgcagcaggtcgaccagcaggccgatcagcaggaaaaaagccgccagcatgaacagctcgctctgcacggcgatgagatcacggttgccgacatcggtcaccagaccgttgccgatgcccggcagcgcgaacagattctcgatgaccatgacgccggtgaccatctccgcgaacgtcagtccgatgacggagaccagttgcggcatggcgaggcgcaatcccacgcacagcaccgcctgccggtgggtcatgccacaggacatggccatgtcgatgtaaccggaggatgccagtccgcccaatgccgagcgggtgtaccgcatcagcccggcccccacgatgatgcccaccgagcaggctggcaacaccagcgacatcagcgccgaaccgaaatcggaccacccgccttgggggaatccctgcgacggaaacacgccaatcagtccggttccgcgcgagaacagcaggatcagcagcagaccaccccacagcgcgggcacggcgccaccgatgatggcgaccatgtgaaacatgccgcgagcggcgcggctgcgggccagtgtcgcctcgcatcccagcggaatgcccagccccatcgcgataagcagcccgaggacgatcagcgggaacgtcaccgatgcccgctcgccgacctgggcgctgatggagcggccggtcagaatggaggtgccgaaatcaccgtgcagcaacgcgccgatccagtcggcgtattgcgcgatcagcggccggtccagaccgagttgcgagcgcagcgcggcgacccgttccggcggggaattcagcccggccatcaccgaggccacgtcgccgggcagcacgcgcaatgccgcgaacacgacgatggagatgccgaacagcgccgccgcgaacagcagcagacggcgtatgacgaatcgcaagtggactccttccggtgagagcgccgcgcatcccgtcacagcccccgagaccctgacggccggaatcgcctgtgccgggatacgcggcgatttcagccgtcacttggtgtaggcgacgttgtacagcggcaacagggtctggttgaggttgatcgggaagccggtgacgcccttcgcgtacgcggtggtgacgcggtagttgaacagccagtcggcgggggcgtcttcggacaccttgcgtgcggcttcggcgagcagcttgtcgcggtcgtcgtcgttcgtggcggcgatggccttggcgtacagggcctggacctccttgttgtcgtagttgtagtagtaggtcgggtcggcccactggtagaagtcgtggctttcgttgtggtcaacgagcgagatgtcgtaattcctgttcgtatacacgtcctgcagccacgtggagaattcgaccacgttgaccttcaggtcgatgccgatcttcttgagctggctgcgcagctggtcgccgatctcggtgccgtatatgttcgcgtaggtcaggctcagctgcagcggcttcgattcggagtatcccgcctcggacatcagcgacttcgccttgtcaaggtcgtacgggtagatgccggtcaggtcctcgtagccggggtcgagggaggggatcgggccgccgagggcggtgtccgaaccgccgcgcgaggcgatgatctccttatggttgatggcgtagcgaatcgcctggcgcacgcgcttgtcggaggtcttcgctccggtgccgttgaacgcgagcacgaatttgtcggtatcgtcgccggccttgaccacgtaatggtcgctgtccttggtgaacggttcggccaggttctcgctgatcggcgcgagcacctgcacatcgccggacttgagcgcgttcacggccgcgttgtcgtcggtgaaataccgcacgacgaccgtgtcggtcttcgccttgttggcgccccagtagttggggttcgccttgagcgttatggacgagttggtgacgaacttctcgacggtgtacgggccggagccgatcgcctgggtcttcgcgtcgtatttcgcgtccttgtcgaacacgagtccgggacggccggtcagcccccacagcaggttcgcgtacggcgcgctgagcttgagttcgacggtgttcgggtcgctcgctttgacggagacgaagttgaccagcgaatcggcgtcatggtactgcttcgtgacgagctcgttgatggaccatgccacgtcgtcggcgtcgagcttgtctccgttcgagaacgtcatgccgtcgttgagatgaaacgtgtatgtggtgccgtcgtcgctgacatcccatgccttcgcgatggctggtacgacctgattgtgctcgtcgcgcgccacgagtccctcgtagacgttgccgatgagtacctggtcgatggccgatccggcggtgttgcggatgtcgaggttggtgggcgcgagtttcaacccgatggtgaccgtatcgttcgccttggcgcccgtcgtgtcgtttttgcgtccggcgaacgccgcgatgcatcccgcgacgacggcgacgaccgcgatcacggcgacgatggcgacgatccaccatgtagcccgccggtgcccggcggcgttcttggcgcggctctccagctgcgcgtccatgctggccgcggcgctctcgttcgtcgcagcggtttcctgtgtgttcagatcttcgttgtcggttgcgccggcgtcgccgtgcgcaccatggttttcagtcatgattcctcttcatttgtattgtgatactgcggctggccgcccttgcgggtcgtccgccacaggacattgtagcgtcaggtcgaacctgactcgcgcggatgccgcgctggcgttctatcatgggtgaaggcatccgttcatgatgcgcccacgcatcacgattcataaggggattcgcatgctcgtagcggtcgacatcggcaacaccaacatcgttctcggcttcctggacggcgacgacatcatcggcacctaccgaatcacgacgaaatcgaaccacacgtccgacgagtacggcctgatgatcacgcagttcctcgcgctgagcggtctgcgtccctctgatatcgatgacgtgatcatcgcgtccgtcgtgccgaaggtcatgcactcgttccgtgcaagcatcatcaagttcctgaacatcaatcccatggtggtcggccctggaatcaaaaccggcatcaacattcgcatcgacgacccgaagtcgctgggttcggactgcctcgccgactgcgtgggcgcgtattacacgtacggcggtccggtgctggtcgccgatttcggcaccgccacgacgttcaactacgtcaatgacgagggcgtgatcacctgcggcctgatcaccacgggcatccgcacggccgcggcggccttgtggggcgagacggcccagctgcccgaggtggaaatcaccaagccgaaatccattctcgccacaggcacgaagaccgcgatgcaggccggactctactacaacttcctcggcggcatcgaacgcacgatccggcagttccgcatggagctggacgagccgttcaccgtcgtggcgaccggcggcctgggccgcgtgttcaaggatgacacggagctgatcgacgtgtatgaccccgagctgatcttcaaaggcatggcgctgatccacagccgcaactcgcatcgctgaatcgcgcgggcaggcagcgggttcgcgtgaccggcttcggcattggccacgccggcgcaggtcatttgatggtgaagccctgattgacgccgtactccttgaggtcgcgctgccatgcggcgatgccgctcatcagcgtgatcttcttgccaggtcggtccggcagtgtaatcggaccgccatcgtcattggtcagtcctgcgtccttgcgcgccttggcccggtcgtatgcctgcttggccgccgaccacgtgtatgcgtctgcggtggcgctgcggaagtggctgcgcgcgtacacttcgaacggcaggtactggtatccgaccgacacggactccgctgcctcggacagcacctcgttgaaccgctgcccgccgaaatactccacctcggcgtgatgctcactggtgacggtggtcttgttgaggaattcgccgctgttcaacgtcgcattgtcggccgggaaggcgccaccatcgacgcgggtcttgatgccggatttgttgtggcagacataatccacgaaacggaatgccgcttcaggcttgcgtgtggtgtgcagcacgcccagcgcggagccgccgttctcggcattggtgaccgtgccgtcctgagtcggcatgcgcgtgacgcgccacagtcccgatgtgcccggcacgtcggccagcagcagcgacggcatccaggctccggcgaacacggaggcgaccgacccgccacccagcgcacgtttccaatcctcggaccagactttgagatgggtgttgaccagtccctcgtcgatcatgcgctgccagaattcggtgaacgtcctggttccggcgtcgcccttgagatcgacggtcacggtcttgccgtcggatgacgtatggaaaggccgaccgcccgcgagccatatcatcgcattgtagaagctggcgtcaccggcgtctgcggcgatgtacacgccgatgtttttcagctttttcgcggcctcgtaataatcatcccatgtggtgatcttggtcgcgtcgacaccggcctggcggaatgcgtcatcgttgtagaagaacgccataggcccggaatccatgggtagcgcgtacgtgcgctgcgcgagctgcaccgacgcccaggtgcctggggtgaagaacgagctgtagctgccgacacgaccggtgaggtccatcagctggccgctcaccgcgtactgcggcagggcatagtattcgagctgcaccacgtcgggcgtgccgtacccgtcctgtatagcgctgttgaggtggtcgtagccgctgatgttgttcagcttcacgcggacgtctggattagccttctcgaaatcggcgatcagcgtcgtcatgctgggttcccacgaccagacggtgatgacggtgcgcgtgtccggctgcccgcaggaggcgactgccagcgtcatcgcacagatcgtgagcaacgccgagatacgcagacgcagccgccgcaaccgtgccgatatcgtcatgtcatctccttagcgtgctcgatgtatcgggaagaattcgctcatcgtagagtctacacgcgcgctgcaacaggtgaagatacgtgaaggcccctccctgatgaggggaggggccttcacacgaggaagggatgaccgaaggtcaccgtattccggtcattaccacgccagattgcttgactgcgaaggttacttgacggtgtagccctgatccttcgcgtagtccttcagagcctgttcccaaagcggcgacaccatcgctcagcttctggttgccggtgtaggacttgccaaggtagtcgccgaagataccgcgggccttgaccttcggggcgccagtcaggttaatggtgaccgtctcgccttcggtggagaacagcgtcgcactggccagccaggtcatcgagtcgtagaagccggcgacaccggtgtcggacgtgatgtagtagttgtcgccaagggtgtgaatcttcttggcgtcctgatagaactcgtcccaggtcttgtcgccctggccggtgttcaccaggttgacattgatgccggtctccttttttgaagtccttggccacctgagtcagcgtaggccccaagcccacacggtgatttccttgacgtcgccttcctgcttcggagcggagctgctgcttgagttgccgcacgcagcgacgctgaccagcatcgccgcagcccggtaagcgccagcgccttctttcccataaggcgtatgtcgcgtgtcaccgcaaacatacgcctttcctaagcccttacagcccagtgtttccaacgattatcgcctgagcacgacaacgcccgtcggatcgatggtggcccgcccgtcgtcgacatgcgcgagcgaagccgcgatggcctccccttcaacgtcgacggtcaccggttcatgggtgcggttgaacacgaactcgaagcggctcgccgccgcggcgtcggcgcgttcgacacgcagcacgcggccatcaccggcgaggtccgacagccccatggaacccagcatcgccggcaggctcttcgcaagcccctgacggcccagacggcatccgacatatacggtccgcccgtcgccatacccgttggccacgatggccggcacctcgttcatgccggtccagcgttccgccttataggaggccagtaccgtggacgtgtcggccgtggacgtgatcacgtcggcaaagtcatgcgccaccgtgccattgtccaggtcgaggtgatccaatgcgcccggcatgtcgttgcccatcggggcgaactcttcgacgcgcacgccgacgacgtcacgaatcgagcccgggtagccgccaagccagatgtggtcgttctcgtcgctcaatccggtgtagtacgtcacgaacaacttgccgccgttcgccacgaactcccgaaccctgcggctcgtctcttcggacagcaaatacacgcacggcagcacggcaatctcgtaggaatcccaatcggaccgcaccggaaccacgtcggcggtgatgccgttgtcggcaagcgcgcggaaccaatccaacggctcggtccaatgatcgacctgctgggtcgggttcgcggtgcactcggtggcccactgggactcgtagtcgaacacgacggcgaccttggacttgaccgtcttggtgcccatcagaccctcgtcggacagacgtcccagatcggcgcccagctcgcacacatcacggaagatctgcgaatcctcgcccgcatgcggcaccatcgaggagtgccacttctccgcgccggccttggactgtcgccactggaaatagcagatggcgtcggcacccatggcgacctgcgcgagggagtcgcgcacgaccgagcccggctccgcacggtagttgatcggacgccaattcaccgcggaggtggaatgctccatctggaaccacggttccttgcgtgaaatgccgtccatcagcgacgcggagtacgcaacctcgtcgaaatggtcctcgcccggcgtgaagtagtggtcgttggagacgaaatcgacctccgcgccccagtcgtcatagtcaagcatcgagccgccggcggacaccatgaaattggtggtcagcggcagacccggcgtgatggactccagcacgtcacgttcggcgatgtagagctccttgagcgcgtcggagctgaaccgcttgtagtcgagcagcttgcccgggttcatgaagttgccgtcaccgatgtagcgaggcgggatgatctcggagaaatcgttcatgtgctgggcccagaacgctgttccccaggcctcgttcaccgcgtcgatggtcttgtagcgcttcttgcaccacttctggaaggcgcgcatggcgtcgtccgagtagtcgaagcggttgtggcagccgtattcgttgctcacgtgccaggccaccacgtatgggttgcccttatagtgctcggccatacgacggcacaggttcagcgcgtactcgcggaacacagggctcgtcgggcgccaatgctcacgggcgcccggccacacggtgtcgccgcgctcgtccttccacagcacctccggatgggcctgggtcagccacatcggcggggaggcggtggcggaggcgaggtctacggcgatgcccgccttgccgagcttatcgatggcacggtccagccagtcgaaatcgtacttgccttcctccggctcgatcttcgcccatgagaagatgccgactgatacaaggttgacgccggccttcttcatcagacggatatcatcgtcccagacctcctccggccattggtcgggattgtaatcaccgccataccagagacgggattcggcgcccttcagcggctgcggccaactgtgctttctgcgtttactcatattccgctccattacttgttcattgtctgacgccccggccgaaccgtcgcatcgacgaaaaatcaactgtgacatgcgagcgggctggtgccatatcgcgccagcccgcatcgcacacggtgagcgtccctccatatcatatacatgttccgtatggagagccagccgctaggcgcacgtcaagaccgtcagacgaacgtgacgcatgctgcaagcggacactgaccctcccgcgagatcactccttgacggcgccggcggcgaggccggactgccagtacttctgcaggcacaggaacgcgatgaccagcgggatgatcgtgatcagcgagcccgtgatgaccaggttctggatggcttggccgcccgcagtggacgcttggtccttccactggttcagaccgatggtcagcgggaaccagtccgagtccttcaacatgatcagcggcagaaagcagtcgttccacgtggcaacgatcgtgaacagggccgccagcgcgatgcccggcaccgagatcgagccgatgatcaccgcggacacggccttgcggcccgggaagcggaacttcgtcaaagcgtagccgcccatgatcgccagcagggtcgcgccgcccgcgcccaccaccacgtagatcagcgtgttgaccagccagcgcgcgaagatgccgtcgtcataggtgaacaccgtcacgatgttgtcccacagcgcgaacgtcttgccaaagcccaggccgaacgcgcccgtgaagtccgattgggtcttcgtcgcgttgatgagcatggagacgaacgggaacaggcagcagaccgcgaagatcggcacgatgaacacgaacacgaacaccaacgcgaacggccacatgaacttccaaccacgccaatcccgcttgtgcttattcacacgagccaaaggcgacacactcaccgatgtcatgcccctctccttcgaaggactcgaagcgaagcacaccgcacagaacttgccacaacgcaacagctcattgaacttgttccgcgagatgcaccctctataaatgtttgcgttaccataatatcaatattgttggaattgtccacttgagggtacggcaagtcatcaggaaatagtctatactgatggtaaccaaaacatagaaatgccaaaaaacaagcaggaaccatggatcattcgcaacccgcttccatgcaggacgtggcgaaagccgccagcgtgtcgccccagacggtctcacgagtcgccaacggaagcaatgccgtccggccggaaacacggcagcgtgtggaagccgccatggccaagctgggttaccggcccaactatgcggccagggcgcttaagcacggcaagttcaaggatgtcggcgtcgtgctgttcaacatgctcacctatggtaacgcgcgtatcctcggcggcatcgccgacgcggcgaacagcaatggttacgccatcacgatgcagtccttcggacgcaatcgggaacgcaccctgcatgccgccatcgagcgtatgaagcagcttcccgtggacggcgtcatcgccgtcatggaggagcacgtgacggacttctcggagttccgcccgcccaaggagctgccggtcgttatcatctccgaggatcccgcgaactactgccccaccatcgatgccgaccagtacggctgctcagccgccgtcgtggactatctgctcagcaaggggcacaagaccgtctaccacatcgccgggccgtcctcatcgcgagccgcggaaagccgcgcgcaggggtggcacgacacgctcgaccaactggagctgcgcatccctccgacctatatgggcgactgggaggcggacagcggatatcaagccggactcgcactggctcacgaccccgattgcaccgcgatctatgcggccaacgaccagatggcgtatggcgcgatgctcggattgcaggccgccggcaaacgcgtgccggaagacgtcagcatcgtcggagtggacgattcgctgagcgggacgattccacggctgtcgctgaccaccatgcgcatgaaattcaacgacatcggacgcgaggcgttcttcatgaccaagcgtctgtgcgagggccttcgagtgccttcgggcgtgaagaccgtggttcccgcggagctggtggaacgcgggtcggtgcgcgacctggaatcctagacgaagaatctcaagcgataatggcttcggtctcgccggtgtcgaacgggcgaagccgaagccattatccgttcagcgccggcgattcgtcagaggttcgccggctacataacgccttacgttctccaatgcgatacatccggtcgatgccttccgccgtgcgggtcgggtcacgacgcactcccagcgtgttcgcgcccatggccttgcatatgctggcgaaatgcgagccgatgtccccggtgccgaccaccagcaccgtggagccgcgcacgctcagcgcacggccgacatcgtgccatcgccgctccccttgttgacgggcatatatcgacattgtaggcgcacggaatattgccgcgacgccggtgacaaaaatgacgatgcgccggcccgtcttttctaggagacgggccggcgcatcagacggccggagaaccgatgttaccggttggacttacgcttggcttcaagcgtcacgaccgcacccgctaccatcgcaagtgcagcgaagacaacgcccattgtggaggcgccggtctttgcgatcacgtcgccgggcttcttgccttcaccaggcttctcaccttcaccgccgggggtcgtcggcttggtcttcagcgcgtcgatcgccgcagacagagccgcctcggcggcattgacatcatcctggctcaccttgtcatcgtcatagaccttgagcgctgcggcgagcttgtcatcaagcaccttgagcgactcgtccgtataggcggaacggtcgatcgcctgagccttggtgatcgtggcgtgcagcttgtccttgttgacttcggtcggaggcttctcgccacccttcttggtgaacgtcagctcatacgtgactggggacgtcacaccatccgggaagcggtatccgtcggcgggctcggcggtgaccgtgacggtcacgtcctcatcgcccacgttcactacggaaccagcggccaacaccttgccgtcgaccttgtacacgactccctcgatgtcggggatggtgtatgtatcggcatcatcgtccactgtcggcttctgcggggtagcgaccttgtcctcctctacggccgtgggcagcaactcgacattcatttccgccgcggagccgaagttcgatccggaataatcggtcttgatgacaaacttgacgtaccgtccgttcttgggggtcagcttgatgcgctgcgtgtaggcgacgttcttcaacgtgcccgaggccacagaggctccaaaatcgttgggatcgtcggagacatacacctcgtaatccttggcggcaccgttattgttgccgtcgatacgggcgaggtagtcgaagtaggcgacgttctcacgcgattcgccgagatcgagagtcacccaatgcggggcggacgcggcggtcgggctgtactgggagtgccagttcgtcgacgagtcgccgtcgagcgccttcgccgcctctgcgccggagttctgcgacgactgggcgtgcacgctgatctcatcctgcgggacatacacgcgggaggccggtgcagtggcggaatcggccacgacccagccggcgtcgtccttgccgagtgccttcagcgcctgcttcagcgtcagcccggcggtcatgccgtcgaagctcgcggtggtggctttgtcgcttttgccgtatgtcgtcacggtgatgggctcgtccttggtgccgtagccgaagacggcgaagtccccggtcagctcggtgcccgccttgacgaagatcacggagcctggcgcgacggtcacatcgtgcagctgctcgatcgacgtcatgggcttgtccttcgtgaatccatctcccgcggtctgcgccgtcgggtcgatgtagtaggcgcgggcgccggtctgaatctcggattcggtgtggaacacctcaagacggctcagacgcaccggaccgcgggaggagttgaccaccagacggatggcatcgatgttctgggacgtgaagcgaaggtcgcgctgctgcccgaccgtcgtcatagtcgccagattcgtccatgttccattgactcgtccctgcagggtggcgctttcgatctgctggccggcattgcgcacgtcctcggagatcttcactgcatccacggcgacagcgctgcccagatcgatggtgtacgtcggcgtattgcccacggccttgtcggaggagagcttcgaaccgtcggtcagcttcggggccgctaccgcggtgccgttcgcggacgcggcgacggtcgcgctcttgcccagggcaagatcggtgccgtagcgtcgggcgagctcctcgcccagccccttaagtcccgcggcatccgcatcggcgagcttgccggtatcggacggtgggacgttcagcagatactgcgagttgcgtcccgtggactgctcgtagtacttcacgacttgagctacggacgccggcgattggttggcatggtagaaccatccgggccggttcttggcgtcgacttcggccggataccagtgcagctggttggcggcgccgctgcggatctcggacagcacgctcgacatggtgccaagcgtaccgtcgggggccatctggccaggcttgagcgacaccttgtctacgccgtcgttgtatgccgcctgcgggctccactcggtctgacgggcccagccgtcctcgttgcccacccatcgggcatcgtatgcggcgttggcctgaattgcctggggctgaagctggcggatcatcttgtagaacacgccatagtcgtaatgctcagtgcctgcggtgttgccttgggcaccgtcgaaccagacctcggagatgtcgccgtactcagtcagcagctcatagagctggttgagcatgtaggcgccgtactccgtggccttgtacttgaacgtgggcagtttgccggaagccaccttgtcggcgcggtcgtcgttctccaccagcgtggggatcgtgcgctcgacgcgtgcggagccgttgccccagacgcccttcttctccatgtaggaatcagccggcgaatagtagatgccgaccttcaggccgtatttcttcgccgaggcgacaatcttgcggaacaggtccttctcccccgtgcgcttggcgacggcggtgtttgcccagtcgtgctcggtgttgtaccgcgagtcgtacagctcgaagccgtcatggtgcttgaccgtcaccatgatcatcttgaagccaccgtcggcgaaggacttcgcccactggtcggtgtcgaggccggtcgggtcgatgcgggagggatcctcgttaccgtgaccccactcctggttgtagtacgtgttgatgccgtaatggaggaatccgatctgaccccagtcgatgtagtcggcctgcccttcggtcggacgcagcttggacagcttggtcttaagcgcggcctcgcactcggcgggcttcacgtcgaaggtattcgcctccttgatgcccgacgtgtcgcagctgacctgagagtagaccagcttgaattcgttggtggtgaagttcgcggaggttttggccaggcggatctcgctcagcgagccgacgaagccgcggctgagcgcggcggaatgcacttcgttgccgaagccgatcttgcccttgatgttcgaattcaggtaagccagaccggtgatgtccttggtctgggcgtcgccgccatccacgcgcatgacgagcttcgcgccggtgccggcctcattgggcacgtacgccaccgacacgacgtgctccgcacccgtggcggccgcggactcgatcttgtggtcggtccaattatcgccggacttggtggaggcgccgaacacgagcttgttcgactcgtagcgcaggaacaggttgccgcccgcgccgaacagggtctggttgtcgccggtctgcgtcggggtgaagcgcagctccgcgaccagcggcgtggtgagggcctcgttgttaccgagggtgaagtccgtgggcgtgaaatcgaatccggccgtgccgccggccagcgtgacggcggagttcgagatggacggattggctgagcgcgacaccagcgagcccagcatctgctcgccgctcgccgcggtatatgaggtgccgctgaacgtgccgttgaaattgacatgcagcagctgggatgcgtcaagaatctcccacggggcgttcgaatcggcgacacgcacgcggaacacgtcaccggcaagaccgcggctcgccgcgccggaagcggggttcacctcgtagccgatcccgaacttgttctcgacggaatcgctgacggccgcgagctcgccggccgtggaggtggcggtctcgccggccacgccatccaccttcaactgcaacgtcgaggcagcgccgtcggctcccggcagatatgtcagctggatgatgtgcttcacattgttggaaggcagcgtcacggactttgtgtagtcgttccatgtattgccggaagggttcgtggagaagccgtattcgaggttgctgccgttcgcccgcacgaagatgttgcccatggcggagaacaatgtggcgaggttgctgggcgtctgcttcgtacggtattccatttcggcgcggaatcccttgttcgccttcccgctcgcgctgaagctcgcggtcgaggtgaaggtcacgccgttggtgccgccagcgagggtgatgccgccgccgtcaagcttggtcggtatgctgccgtgcttggtcacggagcccttcgccacctcgtcgccacctgtggtgtaggtgtcttcagcgaacgtgccgccgaacgacacatcgaggtattccgtcggattcgccgccaccgcgacgttcggcaatgccacgaacgcgagcgccgagaccgctatcaatgcggtgagtctgcgcagccacgaacgcgagcgtccccttgatgctgtgtgtagcatatttcaatcctctatgattttgaacattcttgtacttcttgccggaatctttgccccggaggcacgacatcgttccgccaagtgttcggattcccgcagacagtctatcagatcaggctgacttaaggtaccctatgcaggagttcgacatatgacggtgccggagagcattggactctccggcaccggtcatgttcagcccctacggcgcttgatggtcagcagcaccgtcgcagcgctggcgagcgccatgaccgcgaccgatatcgcggtcacgttcgcgccggtcgccgacagcggaggcttgggtttgtcgcaggtctcatacccatgatcgctggttctcgcatagtacgtcgcacacattatcaccacctcgtcaatcgctccgtatcgcaacgccatcgtcgcagcgcaagcataccgcggaacaacaaaagtggtcccgccgccaagcggcaggaccacttcatgcattccacgcgcccgtgcgtcacgcagcgggcgcggtcggctcaccacggcgtcacgccttggcgacctccacacccagctcggcgccttccttcaccgcgaaggaggtggccagcgtctcatgggcgatcagatcgcggaaccgctcgacatcggccacattggcggacggcacggtcagcaccagggcgatgcgatcggcgatgtccaggtcggcggccttgcgggcgtcctgcacggcgcgaatcacatcgcgggcgtagccctcggcctccaagtcggcggtcagcacggtatcgaggatcacgaaaccgccggtaggcagagcggccgacacggaagcgtcggcctcggcggcgttctcctcctccacgcggttgattaactcgtattcgccggcctccagcgcaacctcgccgttcggcgtctcgacgaccggagcaccggtcgcggcatcgacgtgccaggcaccggtcttggacgccttgatggcgaactggacctgcttgccgaggcgcgggccggcggcgcgggcgttgaccttcagctcgtgcacgatcttcagcccctgcgaaccggcatcctccatcgtgcagaactcaatatcctttatattaagctctgacttgagaatttcgtcgtacgccttgacggcgtccacatcctcgaccacgacggtgagcttggcgagcggctggcgcacacggatctgggcggccttgcgcaacgacagagtgccggagacgatctcgcgcaccttctccatcgcgtccaccagtgccgggtcgtcgaccagcacacggccaagctcggtcgcctcaccggtcttctcgtccgcgacgtacggccaatcggccagatgcacggattcgccgccggtcaggccacgccacacggattcggactccatcggggcgagcggcgcgagaacgcgcatgaacacctcaagcacggtgtacagcgtgttgaacgcgttcgcgtcctccttccagaagcggtcacgggtgttgcggatgtaccagttggtgagcacgtcgatgaagtcacttgccgcatcgcacgcgtcagaaatcgcgaactcgtcgagcgacttctctacacgctctacgagcctgcgggtgcgggccagcaggtaacggtccatctcgggcagacccgccacctcgtccgcgcgcagctgacgggcgtcgaagccggccccgccattggccgcgttcgcatacagcgtgaagaagtagtaggagctccacaccggcagcatgacctggcgcacggtgtcgcggatgccctcagcggtaacaatgaggttgccgccgcgcaggattggcgacgacataaggaaccagcgcatggcgtcggaaccgtacttgtcgaacacgccgttcacgtccgggtagttgcacaggtgcttcgacatcttctggccgtcggaaccgagcacgatgccgtggcagatcacgttcttgaacgccgggcggtcgaacagcgcggtggccatcacgtgcagcaggtagaaccagccgcgagtctggccgatgtattcgacaatgtaatcggccgggaagtgctgctcgaacttctccttgttctcgaacgggtagtggaactgcgcgaacgacatcgaaccggattcgaaccagcagtcgagcacgtcgctgatacggtgcatgtggctcttgccggccgggtcgtccgggttgacgcgcgtgaggttgtcgatccacggacggtgcatgttgacgttgccgtccttgtcgcgcgggtagtcgccgaagtcggccttgagctcctccaacgaaccgtacacgtcgacgcgcgggtacttcgggtcatcgctcacccacaccgggatcggcgaaccccagaagcggttgcgggagatcgaccagtcgcgcgcgttggcgagccacttaccgaactggccgtccttgacattctcaggaatccagttgatctgctggttgagctccaacaggcgcggcttgatcttcgtcaccgacacgaaccaggagctcacaggcttgtagatcagcggcgtggcgcaacgccagcaatgcgggtaggagtgcacatagctcttctcctggaacaggatcgcgcgatgctcggccgggatctcggccagcgggccgtctccgttgcgcaggttgcgcaggatcggcttgttcgcgtcgaacacgtacataccctcgtaatcggggcactgcgcggtgaagcggcagccggcgtcgagcacgtcagtgctcttgatgccgtgcgcgttcagcgtgttcatatcgtcctcaccatagggagcctggtgaaccaggccggtaccctcgacggtgtcgacgtagtccgcggtaaagatttggtagccttcgggccccggcacgttgccctcagactcggctttgtcgccagcgaagtacgggaacaccggccagtaacgccaaccggccatctcggagcccttgagctcgcgcacgacctcgtaatcctcgccgagctccttctcgtacttggagagcaggggcttgccgaagtagaacttcttgccggcgtacttgccctgcgtcgggcgcacctcgacatagtcgatgtcagcgccgacgacgatcgcgaagttggtgggcacggtccacggcgtggtggtccagaagaccgcgtaggcgtcctcctcgtcgcgcagcttcacggccaccgacacggtggtgtcctgacgatcctgatacacgtcggcgtccatgcgcagctcgtgcgccgaaagcggcgtctgatccttcgggcagtacggcagcacgcggtagccctggtacgccagacccttctcgtacagctgcttgaacgcccacatcaccgactccatgtacgggatgttcagcgtcttgtacccgtgctcgaagtcgacccagcgggcctgacgatgcacgtaatcctgccattcgtgcgtgtacttcagcacggaggcgcggcaggcgtcattgaacttgtcgatgcccatcttctcgatctggtcgaccgagtcgatgccgagctccttctgcgcctccagctcggcgggcagaccgtgcgtgtcccagccgaacacgcggttgaccttgcggcccttcatggtctggtagcgcgggatcacgtccttcgcgtaaccggtcagcaggtggccgtagtgcggcaggccgttcgcgaacggcgggccgtcgaagaacacgaactcgttctggctatggtcgccggaagggttgcgttcaacggacttgttgaaggtgtcgtccttgtcccaatacttcaggacggtttcctccatgttggggaaactcgggttcggcgcgacgctggcggtctcgccgccctcgttcgccttgggatacacgtgggaattggtggtttcgctcaccattgctctcctcgatgtcgcattgcactggtcctacgggagctggctatagcgaaccattcacgggaagaacagggattgagacggccgttcgccacaccggcggcatatatgcgccggcgatgtcctcgcagccggaacccttgttccgcccggaatagccgtcatggccattcccgcctacgaggacgatgatcggcggcatgccctcaggctgccgaccgccaccgcggtaccacctcgcttgtcgctcgcatccggccatcctaagatggcgaaaactcgcaaccgcttgtgttcggctgtgacgggccgatcccgtcggttctactcagcttcgtgccgtcgacgttcgatcgaccgtcatgaagcttttcttccgaagactccccgctgataacggatcatcgccttgacttcggtgcatatcctagcacggtatgtggccgacggaaccggagtgtccgcgaacgccgtcggctcgcggccaggcaatcatgcgaggcccgaaatccgaccatcatgccggatgtacgccgacgctcaatcgcgcacgatgctgccgacgatccccgagacaatggacatgatgagagagccgagcaccgcccaccagaacccgtgcaccaacacgccaacaccgaacagactgattgccaaccatgaggcgagccgcatgaacagccagttgatgaccagatacagcagcccgaacgtgagaatcgaaaacggcagcgcgatcagctgcgtcaccggcttgatcgaggcgttgatcagcgccatgaacagcgcgaacactgcgattcccaaaatcggaggctgccccaccgcggtcatgccgggcagaagcaccaccatcaccgcggccgcaaccgtcagcaccagccatcgtatcagaaaatccttcatgacgtccatcttatgccatccaagccgtcaccgatcggttgcgatgtgccggttcggtgcattcatcatatgtcgggcacgatcatcgagaacgattgcacttaagggcacaatcgccgcctaaagacccagaccaccctcagtcggctccgccgacagctcccgccagcaggagccagcatgcaactccaatacgacgtcagggcggaaatcgtcgattacgttccgcggattcttcggctaccatgcaaacaggaggacgacgatgactacaaaggaaacggcggcggcgaccacgacgaagcaggcagccgcccggcaacgggcgttcgcgcaactggacgcgaccttccgctcaggagtcacccggccactgcgctggcgaaaggcgcaactcgacgcgatggcccgaatgctgaggcagaatgccaccgtcatcgcccgtgcggtacgcgccgacctgggcaaacccgccgcggagaccgcgctgatggaaatcgggctggtgctcgatgagattcgcttcatcaagccacgcctcggcaggtgggcggcgcggcatcccaagccgatgcattacctgctgcagcccgcagtcggctggacagtcgccgagccgaaaggcgtggcgctcatcatctcgccgtggaactatccggtgctgctcagtttcgagcctatggcggacgcgatcgccgcaggcaattgcgtgtgcatgaaaccatcggagctgtctccgcacaccagcggcgtgatggcggacctcatcgcacggtacatggacccgcaggcgttccgcgtggttcagggaggaccgcaggagacgacaaagctgctggagcagccgttcaatcacatcttctacaccggcggaggaaaagtcggttcaatagtcatggccgccgccgcgaagcatctcacaccggtcactttggagctcggaggcaagtcgccggtgttcgtcgaccgtaccgcgaacctcgacgtcgccgcgcggcgcattgcctgggggcggttcatcaacgccgggcagacctgcgtggcacccgactatgtgctcgcaacgtccgatgtcatcgagccgctggcaggaaagatcgccgaggccgtcacgcggttcttcggctcagacctgcaacattccgacagtttcggacgcatcatcaacgcccggcatttcgaccggctgactgcgctgctgcccgatccgaagagccccgccaccggacgcacggtatgcggtggcaataccagacgcgatgacctctacatcgcaccgaccgtgctattgggcgtcaaacccgatgcgccggtgatgcaggaggagatattcggcccgattctgcccattttggaagtcgccgacgcgaaagccgcagtggaattcatcaacgcccggccacgcccgctggcggcctacgcgttcacgggcagcaagagggtacggcggatgttcgagcgcgaagtcagttgcggagcgctgggattcaacctgccgcttggccatctgatctccagtcggctgccgttcggcggcgtgggagcttcgggcatgggctcatatcacggcaaggccgggttcctggagttcagtcatgtcaagaccgtggtcggcaagcccgcggtgccggatacgctttcgctggtgtatccgccgtatgacggcttgaagaagatactgatttcggcggtcagccatacgccgagagtgcggtagcgggacacggcgcacctcccgctggcgggagatgacgcgcagcgccggtgggtggtgaccacccccagtcgtctccgccgacagccattcgggccctgcaattatggacgggctaagcatgactgttccgctggctcgctgtcgttcgctcttcgcctacaaacagcaccgctgtttgcttgacggctcagcccgtcaacgggggcataacgtaaaagcccctcgcgatgaggggctttatcgatgagtaggacttgttacttggcttcgtttgtggtgagcatggccttggtgacctgttggtagagatcctcgtagccgccgggcgtggaggcgggcagcacgacggtcttggtgttgttcgactcggacagcgagcgcatcacatcaaggtactggttgaacagcacgacgttgttgacgtcgttgatgtccatgcccacggcctgcaggctcttgatctggtcgacgatgccgtttgcgatctcacgacggtagttggcctggccctcaccctggagtcgggtcttctcggcgtccgcagcggcctgcgtctcgatctggatgcgctgcgcctcggcacgctggcgggtggcctccttctcacgctgcgcggcgttgatggagtccatcgcgctcttgacctgcgggctcgggtcaatggcggtgatcagcgtcttgacgacggtgaagccgaagcgcgccatctcggcgccgaccgtcttctgcacgtcgaaggcgacgtcgtccttgcgggcgaaggcgtcatcgaggctgagcgccgggatcgcggaacgcagcgcgtcctccatgtagctcctgagctgtccggctggatcgcgcagctcatagtatgcggtggcgacgttctcaggattgacacggaactgcgtcgaagcgacgaccgtgacgaacacgttgtcgagcgtcttggtttccagctgcacgttcagctgggagactcgcatgttcgtcttcgtcgagatgcggtcgacgaacgggatcttggcgtggatgccggcgaactggaccttattgtatttgccgaaccgttcgatgatgtatgcctgctgttgcggcacgatgaaaatcgaggcgcacagcacggcgaggacgatgacgacgatgacgcccaacatgatcagagcacccgtcattcccaccagaacacccatcattcctccttgactggtgttgccacaccctacttcgggcgcgatgtctattccatcctatccgaaaacgacgggctttcagtgaaagctcacataaaattcaagagttgttcgccgtgtggcccttcttcgtctcaccgtacgggacggcggcatgcccgcgtctactccccgtatgcgccggctatggcccggtcaaggtcggccatcaggtctcccgcgtcctcaagaccgatggacagacgaatcagatcgtcgctcacaccggcggccttgcgatacgattccggcacctcgcggtgagtgatgttcgcggggtcgacgatcagcgaccttgcgtcgccgatatttggcacgtatgagaacagcttcacgccgtcgaggatgcgacgcacacggtccgcgccgccttccaccttgaacgagaggatctggccgacgcctcgggggaagtatttcccggcgagcgcatgatacggcgagtccggcaaccctgaataattcaccgacacgacatgcggcgtgtgttcgaggtgcccggcgatggccgtcgccgtttcgacctggcgggcgacccgctgcggcagcgtctccagtccgatcagctgcaggtatgcgttgaacgggctttgcacggcaccgaacgtgcgcaggtatttgacgcggatgcgcctgatgaacgcttcggagccaaacgccccggagaagctgcgccggttgccgtcgatgtcggcgatgacctgctcaggccgcgtgaattgcaggaaacggccgttcgcccagtcgaaccgtccggcgtcgacgatcacgccgccgatggcgttgccatgcccggtgatgcccttggtggtcgaatgcacaacgatgtcggcgccgaattcgatcgggcgcagcaggtacggcgtcggcacggtgttgtcgagaatcagcgccagcccgtgccggtgcgccagatcggccagcggacggatatcggtgatggcggtgttcgggttggcgaccgtctcggcgaagatggcacgggtcgcgggaccgatcagagactcgatctcatgcaggtcgttgatgtccttgacgaaatcagcgtggatgccgaactgcggcaggaagtcgccgagcgcatcgactgacgccccatacaggttcgtcggcgcgatgatgcggccaccgccctcccccgcgcacatcagcgcgtatgacaccgcggccatgcccgacgacaccgccaccgcgccgacgccaccctccagggcggcaagccggcgttcgagcgcatcgacggtcggattggcgactctggaatactcgaacccggatatctcaccggcggccagatcacggccacgagcggcgttctccaaatcgaaggcggcggaggcgtagatgggcacgctgaccgcatcgtcgttgcggttcgcattatacccgccatgaaccgcaagcgtgctgaaatcagtcatttccaaatccctttcatccgcatgaccgccaaaacaacgaacaccgaccgccatatttcttcaagacacgacagtgcgggcgtcatcgccatgaacgtcgacgcccgcacggcccgcaccgcatgataggcacggtacgcgaccctatgcggccacttccgtcgtcagccggtcgagcacctgaccgcttacgccgtcgatgtccagcgcctcgaacgccttgtcgaagccctgccccagatcctcgatcaggtcggacacgtcctcgatgcccaccgacagacgcaccagctcgtcggtgatgcccaccttgagacgctcctcgcgaggcagctcgaaatgcgtcatgcggcatggcagctcggcgaggctttccaccgcgcccagactgacggcgagatggaacacgtgcaggttgtcgagcacgatggacgggtcgacccccggcaccacttcgaaggacagcacaccgccgaaccccttgagtccattctcggcgagcagacggttgcggtcgccatacacgcccgggtaatgcacggcccgaacgagcggatgcgccagcaggtattccgccacagcctgcgcgttgcgctgctgacactccatgcgcagcgccaacgtctggatgccacggcgcacgtcgttgcattcggtcggggcgagcacgccgccgaaccggttctgcgcgaagtagatgccattgccgacctcatcgtccaacaccaccacaaggccggcgttcacctcggaatggcctgccaggtatttggtggccgaatggatgacgatatccgcgcccaaatcgagcggctgctgcaggtacggggtgacgaacgtgttgtcgacgatggacagcgcgccgtatcggtgcgcgatggccgagatgcggttgacgttgttgatctgcagcagcgggttggtcagcgtctcgaaatatacggcgctggccgcgcggccgcctctgtcgcgcccgctgatcgcggcgtcgagcgcctcgtagtcggcggtgtcgacgctgtcgaactccagcccgcgctcggcgaagtactcgttgaacagcgaatacgtgccgccgtagatgttcttgccgaccacgatgcggtccccgggtttgaagatggacagcaccgcgtgaatcgcggcgagtccggacgcgaacgcgaagccgcgagtcccgtgctccagctgggcgatctgcttttccagaaagtcgcgggtcgggttgccgctgcgcgcataatcccagcggggcatggcgttgaccgattcgacagcgtatgtggatgagttgtagatgggcgggttgacggctccggtgttgttgtcgttgaccggcaatccgtggaccagctgagtgttgaacctcgtcatgagcaccccctgcggtttttttggcgggtttcccgatgaaccccgcgtgacccttatgaaggtagtcagcggccggcggccccgcaacccggacggcatacacattatttataggatgctcaaaacccttgcaaacactggattttcacgacttgcacggcatctttgacgaccggcaagagccatttgcgacacgcacggaatgttctggcggcaaccaaggcgcgactaagtgcgacatggcttcgcgcagaaaccgacgctacgacccatcggccatcgtgatgttcgtcacatccgggccctgtagggcatttggcctcaccctggcagcggaaccgggcgatatgctggagtgacgccggcgggattcacgcgccggagggacccaagcaaaggagctcgcccatgaccaccgtagccatcgtcggatgcactcacgcgggaacgttcgccgccacatccattctcaagcagcatcccgactggacggtccacgtattcgaacgcaacgactcgctgtcgttcctttcctgcggcatcgcgctgtgggtcggcgaccacgtgtccgatccgaagcgcatgttctattcgtcgccgaaggccctcgccgaagccggcgccacgatgcatatgcgccacgacgtgctcgatgtggatgtcgccggcaaggtgttgcgcgcccgtgacatgaacaccggggaagtcggcgaataccgatacgacaagctggtgatcaccaccggttccgcgcccgtggtgccgccgatcgacgggctggacgaggcgctcgaatcgggacgcgtgctgctgtgcaagaactgggaccatgcgatggcgatcaaggagcgcgcgggcagcgcgaaatcggccgtcgtgatcggcgcggggtacatcggcgcggagatcgccgagcagttcagcgaaatcggcgtgaagaccacgctggtggatgcgctggaccgcgtgctggcgaacaatttcgacgcgaccatcaccgatgacgtggagcaggcgttcgacgagcatggcgtgaccctggcgctcggccagaaggtgacggcgttccggccggcggccggcagcgacgggatcgagggctccggcgtgaccgtggtcaccgagaagggcgagtacacggctgatgtggcgatcctgggcgccggattccgcccgaacaccgcgttgttcgcggatcagctgcgtatgctgaagaacggggcgctcgtcatcgacgactacatgcgcgcctcattgccggacaacacggtgctcgacgacgtgttcgcggcgggcgacagcgccacggtccgatacaacccgaccggcgcggacgattacatcccgctcgccaccaatgcggtgcggcaggggctgctcatcggcgagaacatcgtcgccgcaacgaagcggtatcccggcacgcaggccaccagcgcagtgcagttgtacgatctggcgatgtccgccacgggactcaccgccggcggcgcgaaacgccgaggcatcgccgcgaaatcgacgacgatcacgcaggattaccgccccgatttcatgctcaccaccacgccggtgacgaccacgctggtgtggagcccggtcacccggcgcatcctgggtgcgcagttcctgtcgaagcatgacatctcgcaggcggcgaacgtcgtgtccgtggccattcaggcggggttcacgatcgatcagctcgccggcgccgacctgttcttccagccgaacttcagccagccgatcaatttcgtcggagccgtggccattcaggcagtggccgaaagctgaccccaatcgttgactcgcgctcaacgcggacgcgaaagccccgatcattgggaaacagccattccggttctcgtatccgcggctaatgcgagcacacgattcgcatcagccgcgtgacctgttcggcggtgcgggccacgttcgcacgggcgtcgcgcagcagctcatcgaggctcgcggcactcggcgcggcaccgaagaccgcatcgatgccgcgcccgtgcagacactcgatgccgtcgccgacgcggccggcgatggcaatcaccggtttgccgtgacgcttcgccacggaggcgaccccgaccggcgtcttgccgaacatggtctgcgcgtcaatcgaaccttcgccggtgaacacgatgtccgcccattgtacggcggcatccagcccggattgctcgatcaccaagtcgatgcccgggcgaaaatcggcgtgtagcacggcgagtagcgccatgccgatgccgcccgccgccccggctccgggatgatcggcgatgggcatgcgggtacggtggccaggacgggaacggtggccaggagacgatgattcagccacggccgcttcgacttttccgccatcgccattccgttcggcgggcacctgttcagcgagcgcacgttcgatgaccgacgagacgtgccgcagggcgccgtccaacagcgtcacgtcttcgcgactcgcgcccttctgcgggccgaacaccgcgctggcgccctcggggccggtcagcggattggtcacatcgcaggcggcgatgacatgcacgtcgccaagccgtctgtccaggccgctcaggtcaacgcgctccacttcggcgagcgccgccccgcccggccgcacgtcacgcccgtcatggtcaagcagccgcacccccaacgcctgcaggagaccgcagcccgcgtcgttggtggcgctgccgccgagcccgacgatgatcgtctcggcgccggcgtcgagcgcggcccggatcagttcgcccgtgccgtatgatgtcgtggccttcgggtcgcgttcggatgggcgcagcagcgccagtccgctggcggcggcggtctccacgaccgcggtgcggccgtcgccgagcagcgcgaacccggcctgcaccgggcgtccgaggggatcgtgcgcgccggccgtcagcatcgtgccgccggtggcgtcggccagcgcccgcgcggttccctctcccccgtcagccatgggcaggcatcgtatttcggcgtcggggtcaccgcggcggatgccttcggccatggcccgtgccgcctcggcggcggtcaggctctccttgaaggaatcaggcgcacataggtatcgcatcgccggatcacgcctgctattcggtgcgcagcgcggtggccgggtcctgcttggcggccttgcgcgacggaatcaggccgccgataagggtgagcaccatgctgagcaccaccaggatcaccgctccggccaccggcagcgcggcgttcacgtcgttggtgccgatgaaatggtgcagcacctggttgcccggtatgagcagcagcagcgtcacgcctatgccgatcaggccggcgcacaggccgatgagtccggtctccgcgttgaacacctgcgatacattgcgcttcgaggcgcccatcgcgcgcaggatgccgatctccttggtgcgttccagcaccgagatgtacgtgatgatgccgatcatgatcgacgacaccaccagcgacacggacacgaacgcgatcagcacataggagatcacgttgatgatcgtcgtcaccgagctcatcatcaggccgacgtaatcggtgtagacgatcttgtcggccttgggcacggtcttgttgtagtcggtgatggccttggacacgtggtccttgtcctcgaagctgtcggtgtagatgttgatcgtcgagggcacgtcccggctcaccacgccgaacgcggcgaggttgtcgtcatacgtgccggtcgagacgtactggtcgtagatcttgaccagcacgtcctgcgaggcggtggcgatgtactggtcgaagctgtcggcgagctgctgctcgctcatcgccgccatccgctgcccgcccgcggctgactgcccggcctgcccgggctgagccgactgcgctgactgcgactgcatcatggccttggccatgttcgccttgtcgctcacgccgagcgaggccacataggtcttggcatcagcggccttcgccgcgtcgtccgacggcgagaacgccaggccgttgagcacgtcgcgggtcttgtccttctcctggtcggtgacgatggcgctggagttcgcatggtcgatcagctcgtcggtcagtgcgcgggtgtagccgattccggtggccagcggcgtggcggaggcgtccttgatcggcttgaccacgcccacgatcttcagctgctccgccgagtcgaagcgctctgcgatggcgtccgcgtcgtcgccgatgtacgtgtagtcgccgttcgtgtccttcacgtactggtctgcggcgggtatcatggccagcgtctgccccatcgccgtcgcgtagtcgatcttgccggtgggtgtcttgaccgtctcgccgtcgttgagcttgttcatcatgtcggtgtagtcgctggccttgagcaggcccagctcatacagcgtggtgagcggtaccttgttgtcgtcgtcaagcacgagcacgacctggtccttgccggtcggccatgcgcccttgaccacgcggtagttgtcggtgatgaccttgctgatgagctgatcgtccttcgcccccggcatgatttcatggaacgagtcgggcgacgcgctcgtgtcggtcttgccggtcagcaccgtcatctgcatgctcgtcatgtcggacatgctcgacgactggcccatcgagctcatccgcgcagcgttcgatgtcgaatcggacttggcaccgatggtgacgccgttcgcggtgaccagcgtgccgtcgggatcgtggctgaacacggagaacttcacgtcgtacgtgtattggatgccggttccgccgacatattggcgaacctcgctgttggggtcgtccagatacttcttgaaatcggcgaggttgttcttcgtgatgctgctcgtcaggctggaggcctgcttgatgctgcggccatccgggtagatgccgtcgttcttcgccgatctgcctccggtctccttgccgcccgcctgggcgcccatgatgctggtcatgtcgaaggtctgcgagtcgatggtgatcggataggcggtcatcgtgtcgcgctgtatgctgtcgatgtacgcgttgacgccggtggaaaccgacaggatcagggcgatgccgatgatgccgatagacccggcaaacgaggtgagcagcgtacggcccttcttggtcctcagattgttgaagctcagcgcgatggacgtggcgagcgacatcgaggccttgcccagcctcttgtgtacgggtgcctcggacgcgccctcctcgacctcgtacgggtcggaatcgctgcggatcacgccgtcgcgcagctggacggttctggtggcgtactgctcggcgagctcgggattatgtgtgaccatgaccaccagacggtccttcgccacctccttgagcaggttcatgatctgcacggacgtgtcggagtcgagcgctccggtcggctcgtcggccagcacgatgtccgggtcgttgaccagggcgcgggcgatggcgacgcgctgcatctgcccgccggacagctggttcggcttcttgttgatgtggtcgcccagcccgacctgttcgagggccttgcgggcacgctcccgccgttcggtacgggatacgccggagatcgtcagcgcgagctccacgttcgacagaatcgtctggtgcggaatcaggttgtagctttggaacacgaagccgatcgtgtggttgcggtacgaattccagtcacggtccttgtaccgtttggtggagaccccgttgatgatcaggtcgccgctgtcgtaccggtccagtccgccgatgatgttgagcagcgtggtcttgccggaacccgacgggcccaatatcgccacgaattcgctgtcgcgcaggttcaggctgacgtcatccaacgccttctgtacgaaatcgccggtcttgtattgcttggaaatcgacttgatctgcagcacgatgctccccttattacccatgggtggttcgtcgtatgtctccatgatttgcgatatgacaccactgtatccgacccgttcccccagcgcctcgtgattcactgcaagcattgggaataaaaccgacaacaaacgactttgcgtcgctttgacatgacggaaccgtgacggccctcgcgcgtcaagtgtgtgtatcaagcatgctttgcgtttttttagcgcccccctcagcagttttcccatacagtcgaaaccatgacaggactcactacatctgaagtcgaagaacgccgcgcgcgaggcgagggcgaaaccggggcgcgaagcgtcaccaaatcgacaggcgcgatactgcgcgagaacatctgcacgctgttcaacgcactgaacttcgctatagcgatactgctgttcgcggtcggcgcgtactccaacatgctgttcatcgcgatcatcatcctcaacatcgtcatcggcatcgtgcaggaattcaaggcgaagaaactcgtcgacgagctgacgatcctcaaccagccgcacgcggtggtgctgcgcgacggcaaggagacgaccatcgaggccggcgacatcgtcaaggacgatgtcatggtgctggattccggcaagcagatctgcaacgacgccgtggtcatcgacggccgtctggaagtcaacgaatcgctgctgaccggcgaaagcgactccatcgacaagaccgccggcagcgagctgtattccggcagttcggtgatttccggccgcgcgtacgcccgtgtgacgcacgtcggcgacgagaactacacgaattcgctgatcaacgaggtgcgccaggagaagcgcgtgcactccgagctgctggattcgatgcgcaaggtcacccggttcaccagcttcctgatcatcccgctgggcgtgctgctgttcgtcgaggcgatgttcctgcggcactccggcacgtacgacgccgtggtgtcgtccgccgcggcgctgctcggcatgctgccgaagggactggtgctgctgatctccgtgtcgctggccaccggcgtgatccgcctcgcgaaggccaagatcctcgtgcagaacatctattcactggagacgctggcgcatgtggacgtgctgtgcctcgacaagaccggcacgctgacggacggcaacatgagcgtggaccggatcgtgccgctcggcgagcgcggtgccgccgaggattccgacgcgctgctgcgcgcctacctggacgccagcgaggacaacaacgtgaccatcgcggcgctgcgcgcccatttcggtgccgacggctccaccgccgatgccgggcagcccgcggcgcccgccggcgacggccgtttcgccgcgcaggccatcatcccgttctcgtcgaagcgcaaatggggcgccatcacgatgcgcgcagcggctggtgcggcagacgcgcctcgccacgcgcaggagggcgagtcggccgcggcggcgaccggaaccgtgttcctgggcgccccggagcgcatccttggcgcgaacctgcccgatgaggcggccgcgctgatgggtcagggactgcgtctgatcgccgtcggatacctgcccggcgcgtggacggacgaggagcgtctgccggatgcgctgcagccgatgttcctgatcgcgctgcgcgacaacatccgcccgcgggccaaggagacgctggcgtacttccgcgaccagggcgtcgacgtgaaggtcatctccggcgaccatcccgacaccgtcgccgccgtcgcccggcaggccggcctggagcgttggcgtgacgtcatcgacatgacctcggtgccggcggacgccccggattccacgttcaacgacgtcgccggccgatacacggtgttctctcgcgtcacccccaagcagaagcgccagctggtgcaggcgatgcagcgggccgggcatcaggtcgcgatgaccggcgacggcgtgaatgacctgctcgccctgcgcgaggccgactgctcgatcgccatcgcctccgggtcggacgccgcgcgccagatctcgcaggtcgtgctgctcgactccgatttcacctacctgccgcaggtggtgctggagggccgcaaggtcgtcaacaacgtgacccgcacggccgccgtgttcttcatcaagacgatctactcggtgctggtgtcgttcttctgcctggctttgaacgtcccgttcccgttcattccgatccagatcacgcttgtcgatgcctgcatcgaggcgtggccgtcgttcctgacgatattcgaatcggacacgcgacgcatccgcggccggttcctgcccactgcgctcggcaaggcggcgccgttcgcgatcgtcgtcaccggcatgatcatcgcattcagcctcatcgctccgttcggcgagacgcagaaccgcacggtcatgttcgcgctgctggtcgccgcgtcgatggtcgccgtgatcaagagctgcgtgccgttcacgaagatccgcgtgttcgtctgcgtgacgatggtgctgggtgccccgttcgcgctgctcatcctgccgcacctgttcgaagtggttgcgatgaccggcccgatgtgggcatggttcgcggtggcgttcgtggtgatgatggccgtcaccgccgcgatcatcgcggcgcagcgggcatggctgcggtcccggcgctgaccggcgagcgattccccgtgataccggccggcgtccggccaatgttggtgagcagccccgcatcctcgtaataccgcagcgtcgacggctccatatggaacatgtcggcgacctcgcggattgtgtatcgttccatgcttgacatcgtagccgcgaggatgacacgccggcgcccttgcactcaagccaacttgaagcgtgacaatggagacatcggaccgatcgacgacacctggaggcacccatgttcgaacccaccggcacctacgcgcccgccacgacgcgctacgacgccatgctgtacaagcgctgcggcgccagcggcctgaagctcccggccatatcgctgggcttctggcacaacttcggcgacatcacgccctacgaccagatgaaggccctagtgctcaccgcattcgaccacggcatcacgcacttcgacctggccaacaactacggccccgaacccggcgccgcggagaagaacgcgggacggctgatccggcaatacctcgccgcccaccgcgacgaactggtcgtcagcaccaaggccggctacgagatgtggtcgggcccgtacggcgattggggcagccgcaaatacctgctcgcctcactcgaccagagcctggaacgcctgggactcgactacgtcgacatcttctaccatcaccgtccggaccccgagacccctttggaggaaacgatgggcgcgctcgcccaggccgtcgccagcggcaaggcgctctatgttggcctgtcgaactacgacgggccacagctggagcgggcggcgacgatcctcgatgaactgcacgtgccattcatcatcaaccagaacaagtacaacatcttcgaccgcaccgtcgagcgcaacgggctcaaggacaccgccaagcacctgggcaagggtctcatcacgttctgcccgctcgcgcagggtctgctgaccgaccggtatctcaacggcatccccgcggattcgcgcgtggcgcacgatccgcgcttcctgcacgccgacgacgtgacgcgcgtccacggccagatcatggccctgaacgagatcgccaagcagcgcgggcagacgctcgccgagatgtcgctcgcctggctgctgcacgacgacgccgtgaccagcgtgctcgccggcgcatccaagccgcagcaaatcatcgacaacatcggggcgctgaagaacacggacttcagcgacgaggagctgaaagccatcgacgagatctccatgcagtgacgaataccgctggaagtcgcatccggaaacggctcccagggtaccggaaggaaacgtaccggcatatattcatgccaatcacagcacagcttccaggatggtggagtgatatggaggttgtcggcaagagccggcgaggtcactcaaggtaaccccacaattgtccccctctctcttctccttctcacccggcccttttgggccgggtttccttttcttcggagcctgcgacaccggaaagccgacgacggcgaatcgtatcgcaatggtgatgtacagtagtgagttcgccacgaccattacgaggcggcttcatgccgccgggaggagacaccgatgctgcccgacgggacactgcccaacgattatgtcgtactggatctggaaaccaccggtgtcaactggtatcgggacaccatcatcgagttcggagcggtgaaggtcgtcgaccgcaagcccgtcgacacctatcagcagttggtcaatccgatgcgcaacctcaatccgttcatcacgcagctgaccggcatcacgccggacatgctcgaaccggcaccgacgctggacaccgtgctgcccgacttcctgcgctggtgcggcgacgacgcgatgatcgggcacaacatcatgcagttcgacatcaagttcatcgatctggcggcgcagcgcatcctgcaccatgcggtgccgaaccgcatcatcgatacgttgcagatgagccggagcatgtacccgcagtacaaccgacaccggctggtcgacctgatccagcgtttcgacatcgccgacgtcgaggagcaccgcgcgctgtcggacgccgagcagacgcagatgtgcttcgaatacatgcgcgacgagcagcgtcgcagagactgctgagagcggagagagctgactgatggcattgggcgttggcgcgcggtctctgacgccgcccgccaacgtccaatgccatcggcgcagttttctgcttccgtcagcgttgattcagggggatgtaggcgcgctccacctcgccggtgtacacctgacgcggacgaccgatcttcgtgttcgggtcggcgagcatctcgcggtactgggcgatccatccggggatgcggccaagcgcgaacagcgtggtgaacatcgccggatcgaaaccgatcgcgcggtatatcaggccggtgtagaagtcgacattcggatacaagtgacgtgacacgaaatactcgtcgttgagcgcgatgtcctcaagctcgaccgcgacgtcgaacagggcgcgctcgtcggcgggaagcttgcgggtgtcctcacgcgcgatgatcttctccagatacaggcgcgcgatcgcggcacgcggatcatacgacttgtacacgcgatgccccaggcctgagatgcgatgcccctcggccttcgcgtcctccacgaactggcggacggacttgccggagtcgcggatcgccttcaactgacgcaacacggcctcgttcgcgccgccatgcaacggcccggacagcgcgttgatgccggcggagatcgccgcatacaggttcgcgtgggcggagccggcgatgcggaccaccgacgtggagcaattctgctcatggtcggcatggatgatgagcagacggccgagcgcgtgcacgtacagcgggtcggaatcgaaccgctcgtatggcacggcgaagcacatgcgcaggaaatcgtcgacgtagccgcgggcgaggtccgggtagagcatcggctcatcgcggcggcgccggaaaatgtagctgaccaccgtgcgcgccttcgccatgatgatcttcgcggcctcatccagctggtcggagtcggtgatgtcggtggtgtcggggtagaacgccgcaagcgcgttcaccgccgcagcgagcacgctcatcggatgggcggcacgggggaacgagcccatgaacgtgcggaaatcctcgcccaccatggtcttgtggttgatgtcgctgcaaaaccggtcgtattccgcctgcgtaggcaggtcgccgtgtcgcagcagccacgcgacctcaaggaaatcggaatgctcgcacagctgctcgatggggtagccccggtagcgcaggatcgaccgattgccgtctatgaacgtgatcttcgattcgcactgcgccgtggtcaggaagccgggatcaagcgtgacccagccgtcattgcgcagcttggagaccacgatgccatccgggccggccgaagccttgacgaccggcagcgtgtactgattcgaatccacatgaagttcagctgtcgccatgcacgctccttaatcccttgattgagtcgttcgaattgtcaagtcgtcgaaattatcgaattcgtcgtcccggtgccttgtattggacacactatattgcgtgcatgtttccaccaaaaacgccgctccagcacgtggacatcatcacatgccaaagcggcgacggcatcgcccgatacagaccgtggacgatggacgaccggttgccggtcagtcgcgggtggtcaggatgaccggaccgttctcggtgatggcgatcgtgtgctcgctgtgggcgccacgcgacccgtcctcggaacgcagcgtccagccgtccttggggtcctggtagatctcgtcggtggtcttgaggaaccacggttcgatggcgatgaccagacccgggcgcaggcggtagccgtggccggccttgccgtcgttggcgacgtgcgggtcgccgtgcatgatgtggccgacgccatggccgccgaattccaagttgatcgggtagccgtacgaacgggcgatgtcgccgatggtggaggacacgtcgcccagacggttgcccggacgggccgcgtcaatgccggcggcgagcgcctcctcggtgcacttgatgagcttgaggtcgctcgggtcggggtcgttgccgaccacgaagctgatggcggagtcgccgacccagccgttgacgctgatggccagatcaaggctgatgaggtccccgtccttgaggttgtagtcgaacgggatgccatgcagcaccgcgtcgttgaccgacgtgcagatgtagtgtgcgaacgggccggtgccgaagtccggcgcataatccacgtagcacgattcggcgcccttgcggtcgacgatcttcttgtgcacgtactcgtcgatctccagcaggttggtgccgaccttcgtcatggccttgagttccttgagaatctcgccgacgaaacgaccggccggcttcatctcctcgatttccttagcggttttcagttcgatcatgcaacccagcctactgtgcgggggttacttacgcctcggacggccgaacttgaacgcgcggaccatcgaggaaacacccatgacgatcagcgcacatccgcagaaaatcaccaggaacagcatcgacgagaccggcgagaccagtacgacgagaccggcgataatcgagatgatcgcgtacagcaccgcccagccggagctcggcaggcgccatgattcggcgagcgccatcacgccttccatcatccagccgaggccaaccaccatcgtgatgaacactgcgagcgcctgtccggacagggccgcgttcttcagcatgagtacgccgccgaccgacagcattatgccgatgaggatgtccaggatgcgccatccggccggcagtcccaatgtgacgatggcgctgacgatgcggatcacgccggagaccacgaagtagatgccgagtgcgacggccgcgacgccgagcgtcttgccgggccagatcagcagcgcgacgccgagcacgatcgccgcgacgccgatgatgccgtacaggccgcggatcgcgttcttcgccttctgcggcagcatctcctcgatcagccggaacgggctgaagtcctcccagccgccctgcccttgctgctggccgggctgctgttggccgaacggcggctggtaggcgtagggctggccgtacggacggcctggctggtcggatgcgacgcctggctgcgtctggtattggccggatgaggcgccgtcctgcggcgctcccccgtacgggtattgccggcccgcaggctggccttgaggcgcgtaggctccgtattccggctctccggcacggccggtctgttcgttcccgccgggctgtccgccgtcaccgcgcccgttgtcgccatgtccgtcgctgtgcgggaaaggcccgccatcgtatgtgctcatcatgactccttcaccgttcatgcggcctgccgtcaaccgtgtgcgggcatccgaagcgggccacttcgatatcgtcaccgtcaccaccatattttagacaagttgtccaattcatgccatcaacacaacccgccgttccgtccaataccttacgtgtcgttcgctatgggaaaagacgggccgcggaaggtcagaaggaacgtcaccgaacccggatagtatgagaccatgaccacagatttgacgtccggcctcgatacggccgctttttcctctgttatcaaaccatccgacgatctgttccgtttcgtcaacggcccttggatcgacacgtaccggctgcctgacgacaaggcgcgctacggttcctttgacaagctcgcggaagacgccgagagccagatccgcgacatcctggaggacgaggactgccccgcagccaagtcgcaggcgctgtaccgctcgttcatggacaccgacgccatcgaggcggccggcgccacgccgatcaggcccgccctcgacgccatcgaccacgccgccgacaaggcggcgctgacccgcgccatcggagccctcaagcccatcgacatggggccggacgtcttcgacatcgccgtattcggcgaccccaagaaccccgacacgaacgtcgtgcacctcgaacagtccggcatcggcctgcccgacgaagcctactaccgcgaggaccactacgccccgatccgcgaagcctacgtcgacatggtcgccaagcagctgcgtctggccggctacggcgacgaggagaccacccgcgcacaggcgggccgcttcctcgatgtcgagacccgcatcgccgcgaaccactgggacaacgtcgccacgcgcgactcgcagaagacctacaacccgaccgatttcgccacgctgagcgacgaattggcccacttcgacatcgcggcgtgggccgacgcctggcagggcgcctacgacgccacgccggcggcgaagacccagccggtggacctgacggccgcgctgcagcacaccatcgtccacgagcccagcttcctcaagggcttcgacgccttctggaacaacgctgaccttgacgacctcaagctgtgggctcgcgtgcacgtcatcatcggcaccgcgagcctgctcagccacgactacgacgccgccaacttcgacttctacggcaaagtgctgtccggcaccacccagcagcgcgaccgctggcgtcgcggtgtctccctggtcaacggcgtttgcggcgaggacgtcggccgcgaatacgtcaagcgtcacttccccgaaagctccaagcagcgtatggggcagctggtcggcaacctgatcgacgcctaccgcgtgtcgatcaccaacagcgactggctcggcgaggagaccaaggccaaggcgctggagaagctgtcgaagttcacgccgatgatcggctacaccgagcgttggcgcgactacaccgcgttcgacgtgcatgccgacgccggcctggtggcgaacatgcaggccgcggcgctctacgagtggggcttccagctgtccaaggccggcaagccggtcgacaagggcgagtggctgatgaacccgcagaccgtgaacgcctactacgagccgagcatgaacgtcatcgtgttcccggcggccattctgcagcctcctttcttcaacccggatgccgaggacgccgcgaactacggcggcatcggcgcggtgatcggtcacgagatcggccacggcttcgacgaccagggcgcacagtacgacggtgacggcgtgctcaacgactggtggacggccgacgacaaggccaacttcgagaagcgcacgaaggcgctcatcgagcagtacaacgccttcgtgcctacgcagctggacgagaagtacgccgacgagccggacaaggcgccgcacgtcaacggagcgctgaccatcggcgagaacatcggcgacctcggcggcgtgaacatcgcgctgaaggcctacgcgttcgcgctcgacgaggccgcgggacgcgacaaggacggctccgcgaaggctatcgaggagtcgctgtccgcggccccggtgatggacggatggaccggcctgcagcgtttcttcctgagctacgcctcgatctggcgctcgaagaaccgtgacgagctcgccgagaaatacctgcagatcgacccgcactcccccgccgaatgccgcacgaacggcatcgtgcgcaacgtggacctgttctaccgtgcgtttgatgtgacgcccgacagcgccatgtggctcgaccccgataagcgcgtacgcatctggtaatccgttgccggcaggcaggctgaaccgcacctgcctgccggcagatcatcgaaattcggcttctcccgccggccgcatgtccccggtcgtcgactcatcgagcggcgattcggcgaatcccgaaccgaactcctgcgcctgtgaggtctcctgcgtctgtgaggcctgcggattattggtcggggtttcttcgcccagattatcgaacgtcaccggcgttggatgcaccgggcgcgcatccgcctgctgtcccgcgtccgccgttgccgtgccgccgcccggagatggcggcaggccgggattcgccggcgtgccgttcccctgcgccggggcgtcacgatccgatttctggaacttcttcagttccgacaccccgtaattgatgtcgtggccgatattggtggcctccacaacgatgcgggagcgcctctcatcgttctgggtcgtccattcctccgtgctgagcacgccggtcacgatcgccgcctcccccacgtgcaatgacatgcgagcgttggacgcgagcgtcctgaacgccttcacggtaatccatgtggtcggcaggttgtgccattcgccggttccgccgtcccggtaccgccgcgtgctgcccatccggaacgagcatccctcgactcccccgctgcgcccgaacggcaccggcatcgatccgacgaacccggtgatggtcaccgtcccctgttgtatggccatgtcggcctcctttccttccctgtactgacgttggaccgccgatcccccttcggcggtgtactcactatcgcagatttcccgccggcatcacatggttttcggacaatgtggtcgaaggctacccctttggcgtgttgtggacagcatgtggatagaaaaccggttatccacaatcacgccgtcaatgcccggctcattcatgaccggctatgctgggttcggtatcgcagacgaacagcaaggggaatatcatggggcagaccgccatgaatgcgacagacccgtgacagcgcgaggatgggggaatagtatctgcacatgttcggcatcaccctggcgggcgactggcggccgatcgcggttctgcccatcctgttcggccccgggggcataatgccatggatattgggcggcgccttcaataatcggccctggatcgtcgccatcgctaatgttctcgtcctgcaattcatcatcatcaacgcattgggcgcttccatcggacacttcgccatgtatctgacgttcggtccgcatgtgccgggactgaccgattcgaccaccggccgcgcagcagagcagctgtatgtctccagctcaccgcagacatgaattccaggtctcatcaccgccggtatcgccctgacgcttgccgtaatcatggccgctgtcactgtggcgagcagcgcaaggcagaacggcacggcgatgaatcgtctgcgcatcatcgcgtacatcttatcctgcctggaattcgtcgcattgctcatagcgatctgcataatgcttgcatctctgcgcaacaagcagaccaatatcctgctggcggtattggcgttcctgacactggtcgtttggattcccgggataaaacgcagaagtggggtctttcgcatgaaagaccccacttcgagcgatcaggaaagctgtcggactacttgccgagcagcgtgtccagacgcgacgccagcgtcggcgcagcgtcggcgaccggcacggcggcggaatcggagccgtcacggttgcggatctcgattgttccgttattcacggtgtcacggccggcgactgcaatcagcggcacgccgatcagctcggcgtccttgaacttgacgcccggggagaccttcttgcggtcgtcgtaaatgacctcgatgccgcgctcctccagttctgcgaccagcttctcggccgcgtcgaacgccgccgcatccttgccggtggcgacgacgtgcacctgggcgggcgcgatgacggtcggccatgccagaccgcgctcgtcatgatgcgtctcagcgatgcaggcgagcacgcgggagacaccgatgccgtagcagcccatccacacgggcacagtcttgccgttctggtcgagcaccttgaggtcaagcgccttggagtacttgaggccaagctggaacacctggccaatctccacgccgcgctcgaagctcagcgggccggaaccatccgggctcatgtcgccatggcgcacctcgaccgcctcgacggtgccgtcggccttgaaatcacggccgtacacggcgtggaagcggtgcttgcccgcctcgtcgccgccgatgatccactcagtgccctcagccacgtgcgcgtcgatgaagaagcgcaccggttcggcgacgcccgcggcctcgccctgcttgccgaagaccatcggccccatgtagccggccaccatctcgggatgggccttgagatcgtcctcggtggattcctccagctcggcgggcgcgaactgcgcctcaagacgcttcatatcgacctgacggtcaccgggcagcgccacggcgatgacctcgcgccacggcccctcatgatcatcgtcctcggggtgcagcacagtcacggccacggtcttcaacgtgtcggcggcagtccattcgcgaccgtcctcacgcgggtacagacggttggcggtggcgaccagatcctcgatggtcttggaatccggggtttcacggctttccatcgcgggcacggcggagctgtccacggccggcagctctggggtggtcagcgcctcgacgttccacgccttgccggagggcgccagcgcgaacgtgtcctcgccaatcgccatgggggccaggaactcctcggacgcggaaccacccatcgggccggacatcgcgaacacgggcacgtacttcaggtcgagacgctggaagatgcgctcgtaggcgccgcgctcgtcgtagtacgccttcttcatgccctcctcgtcgatggtgaacgagtaagcgtccttcatgatgaactcgcggccgcggatcaggcccgcgcgcgggcggaactcgtcgcggtacttggtctggatctggtagagcgtgaccggcaggtccttgtacgaggagtacatatccttgaccagcagcgtgaacatttcctcatgcgtgggggcgagcaggtagtcggcctcgtgacggtccttcagacggaacaggttctcgccgtattcctcccagcggtgggtggcctcatacggctcgcgcggcagcagcgccgggaagtggacctcctgggcgccgatgccgtcgatctcctcgcggacgatggcctcgatcttgttgaggaccttcagacccagcggcagccaggtccagataccgggagccgccttgcgcacatagccggcgcgcagcagcagtttcgccgaatcggtgtcggcgtcggcgggatcctcgcgcagcgtgcgcaggaacatggtggacattcgaagtgctttggaactcatgggttccaaggtattcgcgttcggggacattgcgggcccggttcagttcggcaaacccgcagtatcgaaaaaggccacccacccggagctcaccgagcgagcggccttcgtattggcctcgcagccgtgccgcgcttatcgcgtcatccggcgcagccgttcgagggtaatgccggccgccagcatggccatcgccaggacggtcaccagcgacatgtcgataccggtatgggccagcgaatcggccgcggacgtcttgcccccggcaactacgcccgtgttcgcgcccggcttggcggaaggcgagccatcacccgacgtgccacccggcacggtaccgggcttgttctgctcattgccgcccggcgcggtgctgttcggtctgggctgcgtgacgatagcactgcgggcggttcatcagaaaggccgtcaaccgttgcgcgcatggtccctgtacgcctctttctctttgcccgtgtcgctgattgctgtgcgacctgccgatgctgccgagatacatgtccgaagccgtcagcgtggctgtcttcactatgctcgcgggagccgcctgtcttatcggcccgggcaatatgtcgccgagcgcatcatcgtcgccttcatcagcgctttgagccttaccgtcatcgcgatcgccgatttcagcaatcgcatggttgagaaaaacctcgtggcgattgccgcatatgtgctgctgccggcattggccgccaccgcatggctgcgtacatgccatcaatggccggcagcgcgacccgcaacctgcgctggatattcggtgccgccgcgcgctacgaggcaagcctcaaatcggtgcaatcgctcggcaaacgcatctcacagctgcgctagcgcaccactacccggcgaaagtcccattcggcgacgtcataatgggactttcgcgggattgatatctacttccgcccaatagcagtcccatatccgaaagcagccaccgctagaacagctcggcttgttcgaattcgccagcaggctcgtcctcgtgaggcgtttgcggccggaacgcagccacgccctcgttgcccagccgcgcgctggcggcctgtgacccgccgcgcaaatcgccgtcgagcatcaccgcatccgctgaaaccgcgaacatgcgctcgttgacgccggcaagatacaatccgcccatgcgttccacacgcgaaagcgccacgtatcccataccgggcgcaaacgtgcggctcagatccatcaccgcccggtcgagggtcattccctgcgatttgtggatggtgatcgcccacgcacagcgcagcggcacctgcgccacggacgccatcaccgtgtcgccgtccatcatctcccacgtggcctgcttcatcgtgacgatgttgccgttctcgaattcgacgatgggccagccgcccttgctctcgttggcgaagccgcgcacggtaccgagcgaaccgttgacatactggtggtcggcgtcgttgcgcagcgccatgacggcggcaccggtcttgagcacgaggcactccggcgccagcatgttgcgcttgagccgttcgaccagatgggccggccccatctgcttggcatggaactcgtgcggctccttgtctatccgcgcaagcctggaatcgttgaggttatcggcctgccggttgacggggaacaggtggaccgccacctcgcccggctgcggtgtcacaccgagccgcgtgacgagcgcgtcacggtcatcctgatccacgcatccggcacggatgtcggtgagcacgtgcagcagccggccgtcgtcctgacgatgctgctcggtcagatagcagatgaccggcgcgagttcgccccacaccagcgattcggtgacgaatccttccggattgagtccggccttcgcgtaccgttcgcgggacgccacgaaatccgggccgggcggcagcacgtcgcggtcgcgcccggacacggagaccggcggcagctggaagaagtcaccggacagcaccacttgcaatccaccgaacggccgcggatcatgccgcacttcacggcacacctgatcgaccatgtcgaacagccaggcgtgcatcatcgacacctcgtcgatgatgagcacgtcggctgcctgtatcttgcgccgacgacgggtcttgatggtcttcagcagattcggcgtcagcacgttggcgagtccgacgccgctccacgagtggatggtctggccgtcgatatgcgtggcagcgatgcccgttgacgcggtgacggccacgttcgcgccgtctgcgcgcgcctgccggatgaactcgttcagcacgtacgtctttcctgcgccgggcgcacccgtcaggaacacgttcgcgccggcgttcagaatcgcgagcgcctcagactgccgcatatgccctccttaagctcatgcatcacgcacgatccgcgcgccctggcgtatgacatcgctcgcccgcgggctcagaccagccggcgtaccacctgcagcacgccgtgctcggtgttggccggcgcgatgtaccgcgccgcgcgtttcagatccggatgcgcgttggccatggcgaacgaccattcgccggcgtcgagcatctgcaaatcgttgagatagtcgccgaacaccgccgtctgcgcggacgtgacgccgagatgccgctgcagcgcgacgacaccctgccgcttgtcggttccgggattcatgatatcgacccagtgcgctccggataccaccacctgatgggtgcgttccacatcgcccagcaggttcgcggccatgccttgcgcgtcgccgaaatcgaagatcgccagtttgagcacggtttcgtcctcggtctccagcacctcgtgcaggtcgtccacgatgcgcagcgccttgtagtatttggagcattcctcgacgaacggcctgtcctgccgctggatgtacgccgtgttcagaccgcataccacgagtccgatgtcatgcgagcccgacgccaccgcggcgtccaccagatcgatcagcgtacgcgtgatgccccagctcaccccgtgcacgtcgatgacgttgtcgtcggcgaccacgacgttgccgttctccgcgatatacgacatggcgccgtcgacgcggtccgcgaacatggagcgcagcgtggcgagctggcggccggaagccggcacgaactcgacacccttggcgtgcagctcgtcgagcagcggccagaagccatcggggatgttgctgtcgccgtccagcagcgtgccatccatgtccgccacgatcaggcggatgtcgcgcggcttgtcgcagatggcggtccaatcgttcgcggtcatggtgtcgttcctctcagtcgtgtgcgtgacgttttctgtttttcgagaccggccgtctacttattcagcaggctggtggcgacgatctggtcggcgatggccttcgactcggcctcgttcggcccgggagccggcgccatgaacgcctgacggtagtagcgaagctcgtccagcgactcgatgatgtcggcgagggcgcggtgcccgccgttcttggcggggcggttctcatacaccgcggggtaccagcggcgcgcgagctccttcagcgtgctcacgtccacgctgcggtagtgcagatggctcatgagacccggcatgtaatggtcgaggaatttcttgtcggagccgatggtgttgcccgcgagcagcggcctgactccgtccggcgtgaaccgcagcacgtattcggtgaccttgcgttccgcctcttcgaggctcaggccgtgctcccattcgttgatgagcccggaacgggtgtgcatggcgcgcacgaagtcgttcatgtgcgcgacggcggcgtcggacggcttgatgacgtagtccacgccttcgtccaacacgttgaggtcgaaatcggtaggcaccactgacacctcgacgagctcgtcgccaccgaagatgtcaagtcccgtcatctcgcaatcaatccagatcaggcgcgaatccttcgcgctgtacgtttccgcatcatggctgtcgaccatcgcaagccgcctttcctgctgtgttttcctagggaacgttacaggctatagcagaccggggacgcgccgtcaggccagcgggaaagagagcagcatcgtagtgccggacggggacgaggactccaccgcgaccgagcctccataccggttcgccacatcacgggcgagcgcgaggccgagcccgtacccttggcgcgcggtgccgtcatcgtcccgggcgaagcggcggaacagtcgttcgggatcgccgccgatgcccggtccatggtcggacacgcggatctgcgcccattggcgatgacgcgcgcacccgagcgacaccgccctgccgtccggatcctcgatgatgccggagtgcggcttgagcacgcccagtcgcccaccaccacgctggccgtctgggcgttgaacccccgcagcagcgcgcgcagccgggcctgcagttcgatgaagcggaacggcttggtcaggtagtcgttcacgccgcagtccagcccttccacgatgtcgtccacctgcgcgagcgcggtcagcatcagcgcgggtgtagtgacgccggagccgcacagggtacgaatcaaatccagcccgtcgccgtcgggcagccggcggtcgacgatcagcgcgtcatgctcttgccctatccaattgggaccccgctaaagcgccgctaagaagacacgcgggcacgacggaagcttggtgtcgctacacgacatgacccgccgcttcgggtggaacgggacggatataatcttggacattcgggacgcgaccggccacgcgccattacggcagcgcaggaacggcagcggtacatgcatacggccaggaggactacatggcagaggaaacgcaatctatcacgacgcggcacgacgccgagaccgacccggcactgtggtggcggcaggccgtggtctaccaggtctacccgcgcagcttccaggacaccaccggctccggtctgggcgacatcaatggcatcaccgggcggatcccctatctgcggcagctgggcgtcgacgcgatctggctgtcgcccttctacccgagcgaactcgcggacggcggctacgacgtggccgactaccgtgacgtggatccgaagctcggctcgatggacgacttcgaccggctggccgccgccgcgcatgcggcagacatcaaagtggtggtggacatcgtgcccaaccacagctcccacctgcacccctggttccgtcaggcgctggcggacggccccggctcccctgcgcgcgaccggtacatcttccgcgacggcaagggcccgaacggcgacgagccgccgacccgctggcagaaccatttcggaggtccggcatggacgcgcgtggacgacggccaatggtacctgcacatgttcgccaaggagcagcccgactggaactggaagaacccggacgtgcgcgccgatttccttgagacgctgcgtttctggtgcgatcacggcgtggacgggttccgcatcgatgtggcgcacgggctcgccaaggacctcgaccgcgacgacctcgacgactacgtggtgatgagcacgaacgacatgcccgcggacggatcccacccagtgctcgaccgcgacgaggtgcacgacatctaccgtgagtggcgccgcgaggtgttcaaccgctacgatcccccgcgcttcgcggtcgccgaggcatgggtccggccggaacgccagtacctgtacgcgtcaccggatgaactggggcaggtgttcaacttcgagttcgccaaggcggattggaccttcgacgcgatgagcaaagccatcgacaaggggctggcgtgcgccgagaggtcgggctcaacgtccacctgggtgatgagcaaccatgatgtgccgcgccacgccacgcgttacgcgctgccgcaagtgccgaccagcgaataccatcagatcgccaacgactggctgctgcgtgacggcaccacctatatcgaggatcgccaggccggcgcattgcgggcacgcgccgcactgatgctcgaaatggcgctgcccggctcggcctacgtgtatcagggcgaggagctgggcctgtttgaggtggcggatattccatgggaccgcatcgaggatccctccggcctgcgcacctcgcgggcgcagtccaccaagggccgtgacggctgccgcgtgccgctgccctgggtcgcgtccgacgtgcccgagacgtacacgtccgacaagaggcacgtccatgccggctcgttcgggttctcccctgccgtcagcgacgccgaaccacacctcccgcagcccgcgtggttcaaggatttcgccatggacatccaggacgccgacgacggctccatgctgaacttctatcgtcgcgtgctgcggctgcgtcacgagatgcagactccggacaccagttgcacgttgcttcccgagaaccgtccgagcggcatgcgcgacggcgcagacggccagcccggcggcgtgatcgcctaccgtcgtgccaacggttgggcgaatctgacgaatttcggcaccacaccggtttcgctgcccaacggcgaggtgctgctctcgtccgcgccgctcaccgatgacggccggctgccgcaggatacgtccgtctggatgcggctgcggtaggcctgcccgcgcccgccacgacgcgggcggcggagccgattcgacgcggccgggcctatatgcaagatggcgggctcccctcgcaaatcgtgaggggagcccgccatcatattcatatgagccgaatcctatgaaccgatcggcatcggcctatcagttgtggaagccggtgtagttcggcgcttcggtggtcatcacgatgtcgtgcggatgcgactcgcgcaggccggcgtcggtgatgcggatgaagcggcccttctcctgcagctcggcgatgttgtgcgcgcccacatagaacatggactggtgcaggccgccgatcagctggtacagcacggcgttcagcggtccgcggtacggcacttcgccctcgacgccttccggaacgaccttgtcgttggaggtgacgtcggcctggaagtaacggtccttggagtaggacttcttgccgcgcggggccatggcacccagcgagcccatgccgcggtacagcttgtactgcttgccgtgcagcaggaccttctcgcccggagcctcctcgcagccggccagcgtgccgccgagcatgacggtgttggcaccggcgacgagcgccttggcgatgtctccggagtagtggatgccaccgtcggcgatgcacggcacgccggcggccttacatgcctgggcggcgtcatagacggcggtgagctgcgggacgccgacaccggcgaccacgcgggtggtgcagatggagccggggccgacaccgatcttgacggcgtcgacgcccgcgtcgatcatggcctgggcgccggaacgggtggcgatgttgccgccgatgacctgcacgccgcggaaggcggggtcgcgcttgatgcggctgatcatgtcgagcgccagacgggcctcgccgttggcggtgtcgacgacgagcacatcgacgccggcctccatcagagcggaggcgcgctgccaggcgtcgccgaggaagccgatgccggcggccacgcgcagacgtccctgctcgtccttggtggcgtccgggtactgctcggtcttgacgaagtccttgacggtgatcaggccggcgagcttgccgttgtcgtcgatcagcggcagcttctcgaccttgtgctgggcgagcagacggtgggcgtcatccttggagatgttcgccggaccagtgatgaggttctccttggtcatcacgtccttgaccttgaggtggtcgtagtcttcggacgggatgaagcgcatgtcgcggttggtgatgatgccgacgaggcggttctcctcgtcaacgaccggcaggccggagatgtggaacttgccgcacagcttgtcgaggtcggcgagcgtgacgtccgggttgacggtcagcgggtcggtgatcataccggactcggagcgcttgaccacatcgacctgggccgcctggtcgtcgatcgacaggttgcggtgcagcacaccgataccgccgttacgggccatggcgatggccatctcggattcggtgacggtatccatcgccgcggagatcgccggaaccttcatggtgatctcacgggtcagatgagtggtggtgtcgacttcggagggaatcacgtccgtctcgttcggcagcagcagcacatcgtcatacgcgaggcccagcttggagaaaatcggggggacgggagcataggattgcatattcgcttcagaatttgtagccatgcattcactatatgagcgtaatgcgacgaatgcgacacgaacatggtctcgaccatcatcatcggcaggtcacgggcgccgttttttcccgtcaccgctttcgtcaaacgaatgacgtgcccgtcgccgcgcggatgcatacgactggttctccgcggcgatctccggcaggcgacgcttcagatacgggtacatcgtcgccaccgtcagcaacaccacggcgatgacgaagccgatgagcacataatggaccttgaagaacaacgtcatgatcgagccgaccgcgatcagagccgcccacccccacagaatcagcaccgctccctgcacggtgtggccgatgcgcagcatgcggtggtgcagatgcatacggtccgggtgcatcggcgactgcccgtggctgagtcggcgcacgatcgccagacacatgtccagcactggcaggaacagcaccaggatcggcagcaggatcggcatgaacactggcaggtacacgctggcatgaatcgacgccggatccagacggccggtcatcacgattgacgcgcaggtgatgagatacccgagcagcatcgagccggagtcgcccatgaacagcttggccggatgccagttgtgcaggatgaacccgacgcagatgccgaccatcgccacgtcgatcagcgtcgccatcgaggcgtaggacggcgaattgcgcgcgatgatgtaggagtacgcggcgaacgcgacgccgccgatggcgacgatgcccgccgcgaggccgtccaggccgtcgacgaaattgaccgcgttgatcgacgcgacgatcagtatcgcggtgatcgtcaccgagatactggggctggcggtgatcagggagccgagcggcagcgatatgatctgcaggccgccccacgccacgaacaccgagatcagcagctgcccggccatcttcagcatccagtccagatcccacaggtcgtcggccatgcccagcaggcatatcagcaccgcgccggcgaggatcacccactcctggttgttgttctcgaacagtccggtcgtgaatgcgatgcgactggagtagatcattgcaaacgcgaatccgatcagcatgcccagtccgcccatgcgcggcgtcgggatggtgtgcacgtcgcgcgcacgaacctctccgaccgcgccgatatggatggcgacatggcgaatcagcggcgtgaccagccaggtgacgccgcctgcgatggcggcgatcagcagatatatcctcatgcgcccagaccaccaccgttcatgtgcacggccttgcgcacgacgggctgagggatgacaccctctcgcaggatgacgatgccgtcgcgctcatgagggtcggcggcgaccaccgtgctggcgacatggccttgcgtcggcccgccgtcaagatacagctgcacatcgtcgccgaacgcctgcacggcctcttcgaccgtctgcgcgctttcgtcgccggaacggttcgcgctcgacgcggcaagaggaccgagctcattcaatacgcgcagggtcagggccgaattcggcacgcggatgccctgcgtacgcctgccctgcggggtggcactgaccgtggcgagcgtgcagtcctcgcgggccaccgcgatcggcgagaacgcaccaggcaggaactgcgcggccagccggttcagcggcgacggcaagtcgagcccgagcccgtccaactggtcgacggatgccagcagcacctgcagcgctttgaagcgcgggcggctcttgacctgatagatgcggtcgattgcggcctcgttgcgcgggtcgcaggccacgccatacaccgtgtcggtgggaatgaccaccaagcctccgcctgcgatgaccgacgccgcctcggcgagggattcctcattcaccttgcgaaccgcactcatcagacctcccgtatcgcgtatcacgcccatcgcggcggtcacatgccgccgcgcgtatccgaataccgctatccaagtattatggcacgtcctgccacaccgatggtaggccggtgcatggcccgacgccacgggttcgctctcccccgcgtcgcgcgggccggcctggacacggcttcccattgcaccattgcgccacgacttggcgctggccggcgccggcgacgacgggcctcatgtgacggtacgtcggagagacacgaccgtatccgcccgaaatcccgccgatcccgagctctccgctatgcgagagcgcgcaggcgacttgtgcacccggttcaacgcgctgcctcggggagaccatgccggccgagccgcggtactggacgagctgctgccgccgatgcatccgatccggttccaggaccgcaacgtgcggcgtgcggctgacgggtcgtattacgactacgagtatggcaagccgatcgtgatcgggtcgaactgctggttcggcggcaatgtgacggtggtcggcggcgtgacgatcggcgagggctgcgtgatcggcgccggctcggcccggccacggcatcagatcctgggtcaggatctgaccgcgaacaggtaccggggccggccggtccagtcgtcgccggtatgagcctggccgaacccgttggcctgtgcgaaggagaccagccgcggcccctgagagatgtcatgctccatcaccagcacgccgccggggcgcagcaatcccgccgctcgcatcacgatccgctccggtatcagcgtgccgtcggcggagccgccatacagcgccgccttcggatcatggtcgcgcacttcgggctgttcggggatctgcgcttcggggatgtacggcggattcgtgaccaccatgtcgatggtgccgtcaaactgggccagcgtcgtgccgctggtggcgtcgccgagctcgagatgataattatcggcggccagcgggtcgagacgtgatatcctccgccagttgcgcatcgtccagtcataggtgcgcggcaccttctcgaccgcccacacctgcgcgccgcgcacctcggtgaccagggacagtccgatggcgccgctgcccgcgcacaaatccacgatacgcggggtggacagccgttcgcgcgtgagccagtcgatgccggcctgcaccacggtctcggtttccgggcgcgggatgaacacgcccggaccgacttccagatcgaggtagcggaacggggcatggcctgtgatgtactgcaacggttcacgtgcggcccgccgagcgatcatggcgtggaatcgggcgagcgccgtggtgacggcatcgcccgcagtggcggagctgtcggagctcgcggcgccggcatccggggcatcaaaactcgcatgctcgtgtggcaggccgtccagaggctcccccatcaacatcgccttgtctatgtcgcgcaggtcgcggccgcacgcctcggcgagcaacaacttggcatcatgctcgggcgtgtcgatgtcggcgtcatgcagcgttcgcgccgcggagcgtatcacgtctgtcacgtcatggatggattcggatgtcatggtgtccttccgctcgttggtggctcatcgtctcagggcgttcatatcacggcgtttcgcgccggggcgtctgccggcatattcgccattgcgtcgctatgtgcgcgccgaaacgaagtacgcgcgcacatagcgacgcaaaccacggattttccgttcctaagtgcgcgcacttgtcgtttcggcgcgcacttagcgacgcagagacatcaacgggggtgcgattccccggggaaccatcactctgaccccgccgatggcccggtcactgctggttggcgagccgctcggcctcgtcagcttggatgtcggagtcgatcacggcctgcaggtcgccgtcgagcacggcgtcgaggttgtacgccttgtagttggtgcggtggtcgacgatgcggttctccgggaagttgtaggtgcggatgcgctcggaacggtcgagcgaacgcacctgcgagtggcgcatatcggcagcctcggcggcctcctgctcgtgcttcatggcgagcaggcgcgatttcaggacccgcaacgcggcggcgcggttctggatctgcgacttctcatcctgcatgctcaccacgatgccagtggggatgtgcgtcatgcgcacggcggagtacgtggtgttcacggactgtccgccgggaccggagctcatgaagatgtcgattttcatgtccttcggatcgatctcgatctcgtcgtcgtcctcgtcggcctcggggaacacgattacaccggccgcggaggtctggatgcggccctgcgattcggtgacggggatgcgctgcacgcggtgcacgccgccctcgtatttcaggctcgcccacacaccgtcctccggcgcgggcgtgcccttggcgcgaatggcgatctgcacgtccttgacgccgccgagctcggtggtgttctcggactgcacggtgacggcccagccgcgcttctcagcgtatcgcagatacatgcgcagcaggtcgccggcgaacagcgccgcctcctcgccgcccgtaccggccttgatctccatgatgacgtcccgggcgtcatcggggtcgcgcgggatcagcgcgttccgcagcttctcctcggccgccggcagctcggcttcgagccgcttggcctcatcggcgaattcggggtcctcccccgccatctcgcgcgcggcctcaaggtcgtcgcgcacggccgtgtatgactgatacgcggatacaatcgcgccgagttcggcatgacgacgacccagcttgcgcatcttatcggggttcgtcaccacctcggggctcgccatctgctgttcgatggattggtattcctccaacgcggtctgtgccgcggggaactgctcgactgccatgtctggcttgtccttccggatagtaacaacggtcggcaccgcgtcatcatcgctgtcgcgacgccattacagatacaaaaacgccagtcccccgagcgggtgcgccgaagcgcgcccaacccgtgcgggactggcgtcagatacgctacttggtcttcttgccgtaacgcttctcgaagcgagcgacacggccaccggtgtccagaatcttctgcttgccggtgtagaaggggtggcacttcgagcacacgtcgaccgtcatgtggtcgcccttgtaggtggaacgagtgacgaaggtgttgccgcatgagcacaggacttcaacggcatgataatcaggatggataccctgctgcatggttttgtctcctaggggattcgggggacccgggtcgccgcgccccgatggctggcgtgaaccggaacctacggaagtatacgccgaggcatggatttcagtggggccgcaggggcttgaaccctggaccggcggattatgagtccgatgctctaaccgactgagctacagccccacgttggcgaataggccaactatattattgtatagcagaccatcggacttgcgacaccctcccaaccgcccatcgtctgccacggctatcatgtcggcagggccggcaatcgggccgggacacgcggaaaggaacgcacatgcgcattgcggtaccgctgcccggcacgatgtgggcgttcgacgtcatctccatcatccagatcttcgacgacgattccgtcatgtacggctcgtccgaccgtccggtcatcgacttcatcgcgaatgcaagctccaaggcactcgaccacggtatgtccatcgccaccaccgcgctgcgcgactaccacgagaaacctgatctgatcatcatccccggtttcgccaacccgcttgagatcgccaccgacaggcgcaccggggacgccaaggcatggctgttcacagccgatcccgccgacgcgctcgccatccgcgactggctggtcgcgtcccaccgcgagggcgtggagatcgcggccatgtgcacgggcgtgttcgcgctggcatggaccggtctgctcgacggcgtggaatgcaccacgcacctgccgttcctcgacgatttggccgcgcagtttcccaaggcgctggtgcagaaggaccgtctgctgacgcacaacgcgaagcagcgcatctggacgtccgccggcggcagcatctgtctcgacctgtgcatcgcgctactcgccgaacatgccgggcagtccctggcgacggcggaggcgaacatgctgatgatgcattacccccgttcggtggccacccggcgcagcgacggcgctccatccgtcttgccgcgaccgtcccggcagagtgacgagatcatcgcgctgacccgcagggtccgcgagcatctcagttatgactggacgctgacgacgcttgcacagacctcccactcctccacgcgctcgttccagcgccggttcagcgaggtcatgggggtgccgccgagcacctggctgctgacggagcgtctgaacgccgccaaggaactgctggagctcaccgatctgccgatgcagcagatcgcactgagaacgggactgcgcaacgcggattcgctgcgcaagcatttctccgccgcgttcggcgtcagtccgagtcggtatcgtcaggattttctgcgcaccgaattgcgtccgacggaaaacgtgtgagcccgctggccggcgaaacgaacatgaggagtcggatatcggccacatgacgcggatctctctgtgttcgttttgttcggtactgtgcgcattcctcacacttttcttattgagaatgattcgctgaaccatcggcggggcaaagtggcgcgttcttaccgatatttggcgcgaaccgaccgcatcggcacccggttttcccgcgaccgacgcttagactcggacttgaaacaatgttgttaacgccatcatgacagacgcggatgtgtgtcatgccggcgcgatgaaaggatacgaacatgtggcctatcctcttggccctggtccccgcattcggctggggttttcagggcattgtcatgcagaaggtcggcggcaccaccgccaacaagcagatgggcatggtgctcaccacgctgctgttcggtatcgtggtgctgatcttccacccgatcaactggtcgtggacgctgatcgcggccgcggccatcaacggcatcccgtggagcatcgcgcagatactgcagatcaagtccttcgactatctgggcgtggcccgcgccatgccgctgtccactggcatgcagctggtgttcaccaccctgctcggcgcgctgttcttccatgaatggacgcacggctggcagttcggcttcggcatctgcgcgctcgtcgtcatcatcgtcggcgtcgcctgcaccgccttccaggagaagagcgaggacaagggtccgtcgaacctgaagcgcggcctgctcatcaccctgatctcctcactgctgtataccagctacgccgccgccggcaagttcttctcggtctccagctgggacatgctgttcccgcaggccgtgttcatggtgctcggcacgacaatcatctccttctgcatgagcggcaaggacgcgatggaccccgaaatcggcgtgttcggcaagaagagctggatgaacatgagcaccggcgccctgttcgccaccgcgaacctcaccgtgatgctgtccaatgagatgaacggtctggcggtcggctggacgctgtcgcagatgaacgtcatcgtcgccacgctgggcggcctgttcattctcaaggagaagaagaccaagaaggagatggcgttcgtcatcgccggcatgattctcatcgcgctcggcggcatcctgatcggcatcacgaagaacgcatgaccgccgcccgcgcatcatcaaccatcaaccatcaaccatcaaccatcaacaagtcaacaagggagtatcaaccatgatcaatgtcggtttcatcggatgcggcgccatgggccgcgaccacgtgcgtcggatcacggacaagtgcggcaacgcgcaggtcgtcggcgtatacgacaccgtgctcggcaacgcgaagcaggccatcgaagacaaccgcctcgacgcgacgatctacgattcggccgatgcactgatcgacgacccgaacgtcgacgccgtcgtcatcgccagccgcaacgacgtgcatctcgacccgctgctgcacactatcgcgatcggcaagccgacgttcaccgaaaagccgatgaccatcaacggctccgacagctggaaggtcgtcgaagccgaggtggccaatggccgcaagaccattcaggtcggtttcaactggcgcttcgaccccggctacgacgcgatgaagaccttcgtcggcgacggacagatcggcgccctgctgatggccggcatgcgtcactacaacgcgcaggcatccacgagctactacggcaccgacaacgtcatcaacgacacgctcatccacaacttcgacatgctgcattacatgttcgacggcgacatcaccagcgtcgagatgaagttcgcccggatgaacacgctcaacccgaacggggagtccctgcgcgaaccgcagctggccatcgtcgagttctccgacggagccctcgccacagccgaggcgaacgtcaactgccagtacggctacgacatccaatgccgcctggtcggcgagtccggcatcatctcgctgccggatgtcgccacgccggaggtgcgcaaggccggtcagatcagccacgcgatctcgtccgcctggttcgaccgattcatcgaggcatacgaccgcgagttcgaccggttcttcgcgaatatcgaggccgaccggcagccgggcggcaaggaggcgaccgcgtgggacggctatgtggcgaacgtggttgccgacgccgcgctggacagcctgcaccacggcgggcgcatccccgtgacgctcaacgagcagccggcgctgtaccggtaatccgccgtttgttcaacggctcaggccgcccaccacggacgcagcgggtaccagttgcccttcggcagcccctccttgtcgggcttgacggcgaggaactgatgcacctggatgccgttgagctcgaagttcaactcgcacgcggccagatacaggccgtacaccttcgcccgctcgtagccgacctgcttgacggcgtcggcccagttggccttgagattggcgttccaatgatgcagcgtcagcgcgtaatgctgccgcaggttctcctggttgacgacctcgaagccggcgtcgtgcagcgccgactcgatgaacccgggcgaggcgaggtcgccgtcggggaagatgtatcggtcgaggaactcgtccgttccgggccggttgttcggcttgtccttggagatcgtgatctggtggttgagcaggcggccggccggcttgagcagcttgaacatctcatcgaagtagtggcggtagttcttcgcgcccacatgttccatcatgcccaccgaggtgatgccgtcgaagtctcgttccggcacttcgcggtagtccatcacgcgcagctcggccagatcctccagcccttcgcgcctgatccactcctgaccgtactcgatctgctcgtgcgacagcgatacgcccagtgccttgatgccgcgcttggctgcggcgatgaccagagcgccccagccgcatccgatgtcgagcatgcggtcgccgggcttgaggtccagcttgtcgagcaccaggtcgattttgttgcgctgcgcgtcatccaggctcatgtcgggcgtgtcgaacaccgcgcacgtgtacgtcatcgacggtccgatgaagtcggcgtagaactcgttcgacaggtcataatggaagctgacggtctcggagtcggccttttcggtgtgcgggaacagaccggacttgatgcgttcgaatttcgaggggccttcggactgcggcacctccaccttgtggtagccgtggctgagaacggccgcccccatgcgcgccagttcgagcggagatggctttcggatgtacgatgccagttcgacgagcttgcgcagctgcggatacgggtcggccacgtccagtccttcgatgtcgaagtagcccaggatgtatgcgcgggccaaaccgatctcgttcaggttgctcgccaactgatagatggccttaggactggtgacccggacctgcaggtcggcgtcttccggcccgaacgtcgatccgtcgaaggcttcgatgcacaccggcgcgtcctctttgaggaccgcctgcgccatttcacttaccaacatggtttttccactgcccatgtttcgcctcttttcccaacgactgtgccttgccggatatggcaatcaccgtgtcactgtagtcccgcgtcgtcatttttcgcgctgcgaggaaacagaaatcgctcactatgcatgcatcgggcaaccactatgtgaccggtcactctgaaagcgagcatttggcggatatatatggacagcgcggccgcgccagtcgcattccgcatgtgaatcggaatgcggccagcggggccgcggttttcaggatgatcccggaccagccgtcatgagacggcgttcatgtactccttcagggattcgccgatgccgccggactcgccagacgacttcaacgcggtgacgtgcccgtcggtatcgacgccaagcactccggagattgggttgatggcattgtagacgacgtcatattcgttgagtagcagcaggaactcggcggtgccactcgccttcgcctcgttcagcagcgtggttgacgtctcgcgtcgaacgatgccgctcttgtcgacgccgcccacctgcgcgacctcaatgatgtcgccgactttcgcgtcgcccttgatgactttggtgacacgcacccgggtgacggtctccggcacgcccagcgcgtccatgtcgatgtcgtcctccgtcagcccgtattgcgggttcgtttcaggcgttccggacgtgaaatcgatctcgggatacaggatgcgctcgcgcgagtcgagcgggacaccggtgaccaccagaccggcggccttgacgccctcttcggcggaagagtagccgggatagtcggcggtgatggactcggcggtcttcgccgtggtctccgtcgcggtcttcgccgtattctgcgtcgagtggccagcggtcggagagccgacggaatgcatatgcacggcgacacctaccaccagcgccgcaacgagcgccacgacggcgagcgtgcccttgatgacgtttgactgcttcatcagtaacagctcctcacgtaactcatgtcatatgcctgaggcatacggatatatctttcaatcacagttcagcaacggtattcatcagcggccagaccggtcggctgattgatccgtcgattatttttttcatatcagtctccgatgtccagcatgcagtgaatccgcgccaacttcgccgttgacagagcattgagtaaagaacagccgtttttaaaagaaaaaataagagaaacgctgtaaattcaacgtttctctcacttttcatcaatgccgcagaccggaatcgaaccgttttacttaatctcaaatactgatagaaaggggctttgaagacttcatcacggttacggtgttcaaaaagtgttcaaacgtttgttgcatacaaactgaaatttgtcatatccctatttctgagtagattctttcgacaaacggtgacttatgttcgatatacttctcaatatcaaatggatagagcgcagcgccttcttctttaattctactgtattcacgcacagcttccggatgagaacgcaaatattcacggaaagcaatatgccttttcagttcctcagaatctcgcgggcatacatatagatgatgcttccgcaaatgggttttgccttcatatttaaatgcttcccgtccggcaataccaaggtttccttcatggtgatagtcgattctttctaaggcagagattacagcgtcaagcatggagtaatctttaatgacgacatcaatatcaataatcggtttcgctgataaaccatgcactgaagtgctgccaacatgttctatcgcaagagccagttgatcaagagcttcctgaatttcactcttgatttcacaaaaatcccgcgcccagtgtttatcataaggtagcacaacaacatgctttgtaatcattctctttacctccacaaatcccgatttgtctgtttcacaatgtcaataagaggaagaataacaggcttgcttttcagaatctcggtatttcatcataaagtgttcaaaggtgttcaaacattttatataaaaaacagctatgaccaaggtaagtattttcaaaggccggcatcgacatatactgtgatctatgattactacgtttactattcgcaacgtcgccaatgaagacggtgccgcgcagatcagcgatttcggcgctcacgtgctctcctggacgcccgcgggcggccatcccgccgtatggcagcccaaggccgtctatctgggtaagccgatccgcggaggcgtgcccgtggtactgccatggttcgcgctcggtttcgagcatggcgaaatcgccggtaagaagccgaagcacggattcgcccgcacctctgtctggcatgtggacgaggacgcgaccgacgaccgacgcatccgatacacgctgtccgacgccgacgcgacgcccgaactgctcgcccagctgcattccggggcctccccgcggttccatgcggtctacgacatcgaagtcggcaaggagctgaccatgacgctgaccgtcaccaacgacggtaccgagccgctgcgctatgagaccgcgctgcacacgcacttccatgtcggcgacctgacccaggtgagcctacacggattggagggctccgactatctcgacgccacggtcgccgagtaccctccccgcgtgcagcccgatgagccggtgaccttcgacggtaccacggtcgaccgcatctactactccaccgacacgttgcgtctggatgacccggcatgggatcgcgtcatcgtcatcgagacccatggcacgaagcagaccgtcacatggaacccgggaaccgcggccgacaccgaaatcggcgacatgcagcccggcgaatggcgcgatttcgtagccatcgaggcagccgcctgccgcgagtatgccatcgagctcgctcccggcgaatcgcacgcgctcacgcagcgcatcagcgtcgagaaccgctgaaaaaccgattcattcatacggccgccgcatctgccggcggccgtcaccatctccgacggcaactgttcacagcagctgatacagcgcagcgctggcgttggctatcgccgtccacgacgagccggaagtcatgatgacgaacgcatagtcgcccttgccggaatatacgatgcccgcatcatgcaggtacgagtcgcggaatccgaccttgtcggcaacggttccgttgccgccgatgccggccggtatgccgctgcggtactgctgccgtttcatcaggccgatcaccatgtcccggtcgtcgtcgttccagatctcgccccgatacagtttggtcaggatcagcgccagatcggccgatgtcgtgcgcacatccagataatgcaatgtcgtgttcttcgcgccgagcgcgttcgcctgctgcgttactttgtcgtagccggtgccgttatcgcgcatcagccatgccttgggacattcgttgtcggaatcaacgatcatcgtggtcaggcactgctgcagcgtcatgccgttgagcggcgaatcccatgtcatctcgcctaattccacggccgtcaccatcgaatgcgccacgaacagcttgtacgtgctcgccgatgcgaacacctgggaggagtcgatgtcgacgagtgtgccggcattgctcagatcgaccacggagacggaatatctcgcgccggaaaacacaccggccagcgcggcggatgcctgggcagtcaggtcgcgttcgggctgggccggagccggcacggccgccttgaacatgctccgagacgccgattgggaacgaaccctgccggaccccgacttgtcggagaaactttcgtcggaggagccgtcatcggcgacactgccgtcggtggggtcgaccgtggcaccggaccgggccgcaccggctgatgaaacgctgccggacgagccatcgccatcgttcgagcacccgcgcacggacaatagcaccaccatcgtcaccacggagaacatcgcgatcagcaccgtcagacggcggcgcacatacgtcagctcacgggtggatattattcggccgccaggcgggttcgcccgccgacgagggccgacacgaccgccggcatgcgtcacgatgccgcgcaggatacgtcccatcctgcgccgcggcgggcgcatatgctttgccatcgcgcacctccccgactgctcacatcgacgcccccattgtaaccccccccccgaacgcagctagtcaggggcgagcatccacaccttggtcacccgtcatggcacggctaagacaggtcatatatacgacaggtcatatatgacagccgggcgtcggcagtatcgacaggtacgtcgatgccgccgacgcccggccggtcaatgattgctcagcgaccgcggcggaacggcgccgcgttgcgcttgccgtgcgacttgcggaatcccgcggccttgcgcgtggcacggttcggcccgctctggctcctgcggttccgcccgtcacgacggttgtcaccgtcgttgttgtgcgagccgcccttgcggtcctcgaacgacgtgtcgtggaaacgcccgttgcgacggttactgcggcgatcggcctcgcgaccgtcaaacggcgtgttgaaatcgtcgccgaagtcgttgccacggcgcttcttgtcgcccttgcgaccctcagcgtcacggtactgacgccggtcgtcaaaacggccgtcatcgaagccggagcgcccgtatccgtcgaaacggtcccgcttggtggtgtgcttgcgcttgccgtgcggcttgccctcgccgatgatcgacatctgcgattcgtcccgatggtcgaaccggtattgggcgctctcgcggccctccatttcggcgccgtcatgacgatggccgtcacggcgtgcggacggacgggagaaatcatgctcgccgccacgggcgcgggacttgcggccggaacgtccccgcccgccgcgcgcctcaccaccgcgaccgcccttgcgatcggagcggccggcgcgctcggaacggcgcaaagcctcaagcgccttgtccagcgaccagccctcgacgaccggcgcgtgctcgccgaccaactcggtcagatcttcggacgccggcgtgattgccaccgacttgactcggatgccggcgcgcttcatcatctggcgagtgctgcgggcctgattcggcagaacgagcgtcaccacgtcaccctgttcgccggcgcgcgcagtgcggccggaacgatgcaggaacgatttggggtcggccggcggatcggtctgcacgaccagcgtcacatcatggacgtcgatgccgcgagcggccacgtcggtggcaaccaatacgcgtaccaggcccttctcgaacgccaacaggttgcggtcacgctgcttctggctgagattgccctgcaggtcgaccgcgggaatgccctcgtcgatcagtttcttcgtcatcttcttggcctggaacttggtgcgcgtgaacaggatgcgcttgccggtgccgctggccagcagacgaatcacctcatgcttgttgccctgcgacacttcgaacacgtgatgggtcatcgtgtcgacctgcgagacgacagaactgaccgcatgcactttcgcatccggcaggaaccgcttgaccagcgcgtccactccgtggtcgagcgtcgccgagaacagcatacgctgaccgcgtgaatcggtctgctccagcagacgcgtgacgggcggcaggaatcccatgtcggccatctcgtcggcctcgtcgagaatcgtgatctccacggcgtccagagacagcttgccctgacgcagcagatcctcaagacgtcccgggcaagcgacgacgatatcggcgcccgcgcgaagccccgcgacctgacgggcgtagctcacgccgccatacacggtgacggtgctcatgccgtacgcctcggcgagcggctgaatcacctcgtcgatctggttgacgagctcacgggtcggcgcgagcaccaatccgcgcggacgcggcagggacgcctgctcccgcgcggccttctcgtcggacgccttgcgaatctgctcgaattccttcatggccacttcggtgacgctgtgctcgctcaggcgggcgaccagcggaatggcgaatgcgagcgtcttgccggagccggtctgcccgcgaccgagcagatcgacgccgttcagcgaatcggcgagcgtgtccgcctgaatcgggaacgcggtgaccttgccgtccatggcgagcacgtgcaccagcggcttgggcacgccgagctcggcgaacgtcggagcggcatcctgctccttgtcatctgcggaagcatcaagggcggcatcgatatcatctatatcaacagtgtccgtatcggtatgcataacggaacgcgcagcggaaccagccgcgaaatcatggtgacgtttcggcacaatagcctttcaacaacgaagccgatcacttacgcggcttctgacggagtgtccaccatatcagcaccccctccccaggatgccgggccggacgcggcgcggcgcggcggtttcgctattaccatgttatcgggccgccgatgacgtgccaatgcgcgccaatgccatatcgactcattgagagaggttcaacgatgaagaaaggactgtccccgacgacggggcgggtcatgctgctgtgctgcgcgatgctgtggggaggcagctatcccatagccaaggtcgcgatgggtgtcgtcacgccgcaatggctgatgggattgcggctggtcggcgcgtcgacgatcatgctgatcctgtttcgcaagcgaatcgtaccgtatctgaacaaatccatcatcatcccggggctggtgaccgggctcacgtattggggcacgatgatcagccagacggtcggcctgacgatgatcgaacccggccgcagcgcattcctgacctcggcgtattgcgtgctggtgccgttcgtctcatggctgctgatgcggcagcgccctgcggcgcgcaacatcgtcgcggccgccctgtgcctgaccggcgtcggcttcgtgtcgctcgggtccgggctgggcgggctcacgattggcaccggcgacctgttgacgctgctgtgcgcggtgatcttttcgttcaatctggtgtgtctgggcaagtggagccgcgtcatcgacccggtggcgctgacgttcgcgcagttcgtgacggccggcgtgtgcttcatagtcggcgcgtcgttcagcgaaccggcgccgaacgcctcatggcttgcgccgggcgtcctcgcatgcctggtctacctgtttctcggcgcgacgatgctggctcagatcatgcagaacgtcgggctcaaggtgaccccgccttcgcaggcgtcgatcatcatgtgcctggagaccgtgttcagcatggtgttttcggtgctgttctatggagagactgtcagtggtgctgcggcgactggattcgcgctgattttcctggcgatactggtgtcgcagatccggctcaacgggcgtctgctggagcgggtcggccgcaaggcgcggtagtggtgccaccacacggcaccacaccaccacacgacaccacaccaccgtgcgacaccacaccaccgtgcgacaccacaccaccgtgcgacacgcccggagtgtgtagcacaatcatcgaatcgtcactggccatgcattgccattgcgccgttcttcgattcgcaccttgcgattgtgctacgcattccgggcgtgtcgcatgcaatcgtgcggtcagcggcgacgcagcttggcgagctgatagacctcgtcgaaggccgcggcgacttctggactggtcacgcacttgccctcctcatgggcgagcgccatgatgtcgtcctgcgtggccatgtcgagattgccggtcggctcgtcggcgaggacaatcgacggaccatagctcagcgcccgcgcgatggcgacgcgttgccggagtcgccgctcgtaccagtcgaaccggaaccacccgaatcagagctgctgccgggagcgccgcccatgtcggcgccgcgaccgaactgctcctcctggctggcggtctgggtctcctgcgaggagacgcagctggttcgacacgggcaccgacgccacggccccgccggccacgccaagcgcgataccgcacatcgtcacgatcagcagctcgattgcgaactgcgccgccaccttgaccttcttcacgccgatggcggtgagtacgccgacctcgtatttgcgttcgcagatgttgaacagattgagcacgaccgcaccgaccgccagtacgacgatgagcagcgtgagggcgaacttggcgaggttgtcgagcggcacgaggctcgattcgtggttctccacgtcggcggactgcacggtgcaggtgtcgtccagtccggccttccggacgtcggagcgaaggtctcgtagtcgtcggcgctgccgagcacgtaggtgtagctcagctgggtcgtggtgttgttgtcatcgtcgttcgcggtggtgtcggcgtccaagccaagcgatttaagcgtggagacggatgtgtatatcgcgttgtcggcgtcctgcgaggtgccgcccatcgggcccatcgcgctggtgttgctggacgtgctgttcttgtagatgccgctgatggtgaacgtgtaggtcgtcgacgtgtcggacgggttggtgacggtgatctcgtcgccgaccttcaggccgttgaagtcggcgagcgccttggagatgatgaccttgccgttgtccgactcgccatagccgaacacttcgccggacgacatcgtgaacgtgccgttcgccgcgttggcgatggcggtgtccgacgagaagccggtgagcgtgaagtcgccggaggtcatcatcatgacgctaagagagaacgccacgaccgtcgaatcttgtctggctcttttctgaaaactctctgaacggagaaatgcgatattatgccggataccgtcgcattcgacggcttccgattcgtcacaggtaggttttcatcgccagatcaacggtgagtacgatgccggcgagcacagccgcgatgcgcatgatccgggccgggatcctgcgagtgacgggcgacgctatgtatccgccgatgaagcagccgatgcacagcaggatggccacaggccagtccacgacgccgcgcacgatgaagatgaccgacgcgctgatgttcgcaccggtgccgatcagcgtcttgagcgcattgatctgatggaacggaccgatcttgcctgcgtcgagcaccgcgagcgcgcacgtgccggcaccggcaccgaaatatccgctgtataccgccacgaacgcgacgccgagccatatccaccatgggtccttggacatgggttgcgtcgatgcgggagccgacgcgggcgcgccgtcgctcccctgcccttgcggcgtcgtcagggatctggcctgggccatgacgtccgccgcggcctgccgcgcctgcatgcggccgcgcggattgaccgctatgatcagcgagctgaacaggatcagcggcggaacggcgaattcgaagatcttcgggtcgaggctgagcagcagcgcagcgccggcgacgcctcccaccgcgccgatgcttacgtaggtgatggaacgcagccgctgcccgcgcagctccttgcgggcgcccagcacgccgccgacgccggtgccgatcacgccgacggtattgctcgcgttggcgaggaccggcggaatacccagcgccagcagggccggatacgataccagcgaagacgcgccgaccgcatatcccacgaatccggcaccgatgccggccagcaggatcagcagcatcgtcatcagcgaaaaaccggcaatcaccaccgcatcaactccccgcatatatggacatcccgactcagggagaatacgtcaaagcggcacggcccgcagccgctcgtcaacatagcggacatgaatcacgatgcgcgacacggtcgcacgatggcccgcgctacagcgatccgagtgctcaggcctccctgtcgccgccgcgcgggcgaccgccgtcacggcggcggtcattgcttcgtcgcgatcaccgacgtcgcggctgtcgcggcgaaccccttgagtacgtctgccatcacgtcacggtcctcggcgtcaatgccgcggacggcggcgagcatgaccggcaacgactgcgtccaatgcgaggtgagttcgccgaacgtgtcatacccgccggcctcgaggacggcgaacaggttctcgatgaaccggcggcgatgctcgtcatcgaacttcgccatccacccgttgatcgtacgcgccagataccgggagctcgcggacaggccgccggcgtgcacgaactcgccgcgctcgacctgccagttcaacgcgaaatgctgcatgatgctggcgccgtcgctggagacgatcgtatagccgtcctccacatgctcgcgcatctcgaacagcatgccgacgatcgacgattccggcaccgacttgtcgacgagcggcgcgacccgcgcataaccgggagtatcgaagaagtcggcgtcgaagcccggcccgtcatggcagaacacggcgataaggcgctcctgcaccgcggcaggcgcgtttgcggccgcatacaccgccagattgccgcctttggaatggcctccgaccatgagcgagccgtcccggtgccccgcgatgtcggccagataccgcgcggcggactcctgcgcggcgaccggacgacggaacgccatcgcgaaatcctccttccagccgacgatcgtgctgtcggtgccgcggaacgcgacgtacgatgagccgtcgccgacgtcgaacacgcaggcggagaactgcttggtggtctcggggtcgaactcgtccacgtagccgccgacgcgcagatcccgccagcgcgggctttcgcacatcgctcgcaacaggtcgacattcatcgacggcgaccacaccttgccgaacatgtcgtcatagcattccgcgcgtagcaggtccctgacgcccaccatggcgaggtcgacgtccgtcgcctccgcatcgagtctcggcacgttgacgggcatccgcgcgtatgacagctgcgcgagcgccagactgtcgacctcgttgaacggacggtcggcgaacgtgtcctcgttcgcgcggatgtcatcgatgatgttccccatggcggcctcccgtgatgccatcgattctacgcgctccccttcacacgcgacgccccggccgcctggcacgcgccgacacgcactacaatggtctggtcacgtcaacatcacgcatgcatcccatgcacgccaagcggtttcaagcgcgaaggagagcactatgacgcacatcgacaccacctgtgtccagggcggataccagccgggcaacggggagtcccgcactcccccgatcatccaggccacgacgttcaagtacacgtcgagcgagcagatgagccgactgttcgacctgtccgaatccggctacttctacacccgtctgcagaacccgaccaacgacacggtcgccgccaagatctgcgagctcgaaggcggcgcggccgcgatgctcaccagctccggccaggcggcgaacttcttcgccctgttcaacatctgcaacgcgggcgaccatatcgtggcctcgtccgcgatctacggcggcacgttcaacctcatcaacgtgacgatgcgcaagatgggcatcgaatgcacgttcgtgagccccgactgcacgcccgaggagctggacgccgcgttccggccgaacaccaaggccgtgttcggcgaatccatctccaacccggcgctcatcgtgctggacttcgacaagttcaccgccgccgcgcacgaccacggcgtgccgatcatcgtcgacaacacgttccccacgccggtcaactgccgcccgttcgactacggcgtcgacatcgtcacgcacgcgaccaccaagtacatggacggccacggctcctgcgtgggcggcgcgatcgtcgactccggccgcttcgactggatggcccacgccgacaagttcccgggactgaccacgcccgacgactcgtaccacggcgtcacctacgccaccgacttcggcccggccgcctacatcatcaaggccaccgcgcagctcatgcgcgacttcggttccacgccggcgccgatcaactcgtggatcatgggcatgcacctggagtcgctggccgtgcgcatggaacgccattgcgccaacgcactcgccgtggcgaggttcctcgaagccgacccgcgcatctcatgggtgagctacccggggctggaaggcgaccgcaaccatgcgctggccgccaagtacatgccgaacggcacgtgcggcgtgatctccttcggcgtgcccggcgggcgcgacacggtttcctcgctgctcgaccatttccggatgatctcgatcgccacgcacgtggcggacgcgcgcagctgcacgctctatccggcaggcaccacccaccgccagctcaccgaggagcagcttgaggaggctggcgtcggcatcgacctggtacgcctgagctgcggcatcgaaaacgccgatgacattatcgccgacctcaggcaggccatggacgccgtgctctgatcaatcatcgatttcgctcagccggctcgcaaaatcattctcggacacgctctcccggatccgcttcgcgagccggcaccagccagcggggaagcccaatcacttcagccgacgtggcgctcgaagcggtggaagccggtgatgcggtcgatctcggccatggcgtcgacggggatctggaagccggatgccttgaggttgttctccagctggccgggcttgctcgccccggcgatcacgcagctgatttcaggatgctgcaggatccatgccatcgacaggaccggcaggttcgtgccaagctcgtcggcgacgccgcgcagccgctccaccatgtccaggttctcatcggtgagcaggtcgttgatctggtgatccgcctgccatgtggcacgcgacccggccggcagcggctgaaccacagtgatcgggtacagaatgacgcttcagcatgccgccgaccaccgtggccgacacggcgccgagcaccgcgccgggcaacagggcgagcgctcccagcaccgtgccggcggtgaagatcgcgatcgccatgatgaacagggtcttcgtggcgaacttgcgcaccatgaacggcgagctggggatcgacaccgacagcaacagcaggtagccggcggtcagccattgcacgaccgatgcgctgatcgagaattcctccatcagtgtggagtaggcgatgttcagcgacgcttccgacaggatgccgaggaacgtcaggatggccaaagacaccacgacgatgacgagtttcgtggcgaccggctctttgccgccgtggggcaggcgtgcggttgatgtgctcattgtgtcctttccttgatttccggtacccggatgcggccggatgcgtggcggatgagctgcggccgcgggaccgggacggccgtcgtctcggcgagcacgtcgcccagatgcgcgtggtactcctcgacgtaggttcggcgcaggtcgagttcccgcgccgtgagcgtgagtgtgacggcacggcggtcggaggggtcggcgtgcttgtcgagcagtccgatggaagtcatgtcgttgaccagtttggtgacgctcggcgtggtgacgccgaggaacgcgcttacatcgcattcccgtgcggtgccggccgactgcccgttgggttcgttgagtagatgacaccgttctcagcacaggagcggcaggtgatgcacgatccggcacgtcaccccgtaaagcccggcatacagggtacatacaccaggtaaaacacgcccggcagaatggtcataccggctcgataccatatctgccatacttacccaccatcaaacatcacaggagatctcatgaccacgctagccattgatatcggaggaaccaaaatcgccgcagccgtatgcgatgaaaacgatgccatcacacatcgctggcgcgttcccacaccgatggacgccgacgccatcaaccaccacatcgccaacatctaccatgaggccgtcgccgccggccacgacgacatccaggccatcggcatctccgcggccggcaacgtcggcgcggaccgccgcaccctcaccttcgccgcgaacatccccgcgtggatcaactacgacctgtccgagcacatcggcgcgctcatcgaccatgccgtgccggtcgtcgtcgagaacgacgccaactgcgccggctggggcgaatacgtgcacggtgcgggccagggcagctcgaacatggtcgcgctgaccgtaggtaccggactgggcggagcaatcgtcatcgacgggcggctgtaccgcggatcgttcggcatggccgcggaactcggacacctgccgatggtgccggacggcgacacctgcggatgcgggcttcgcggctgcgcggaacgctacacgtctggaagcgcgctggaacggttcgccaagtccgccgtgcgccgacgcccgcaggacgccgaacgcctgatggagttgtgcggcggcgacgtcgacaagctcgaaggcccgatggtctcgcaggccgcacaggagggcgacgtgctcggcctgtacgccttcggcaaaatcggcgaatggctcggccgcgcgatggccgccaccgccgcggtgctcgacccggacgtcttcgtgatcggcggtggcgtagtggcggtcggcgacatcctgctggagccggcgcgatacaactaccagcggttcctggagggcagcgcataccgtggccacgcgagcatcgtcgccgccaccgccgggcaggatgccggcctgatcggcgccgccaacctggcactgcgctaagatgcgcgatgagagatgacgatcagacgcaatcgcgacgcgtgcaacatcccaacatggaccgcacgcgggcttacgggttctgatacgtgcacaactcccgcgaaacggcataatgcacgcgttgtccaacgccagacgtgtacaacagtgcatgacaacgatttcatccactgttgtacaccgaccgcaattccagaaacgttgaaattccaacaagacacacatctacatgcataggtctcccaaggcgcctcgtgcacaactgccgcattcgcccgatatgcgcacgttgtacacgaggtccccttcgaaaagacctccggaccgaatcacgtccctttcatccccacctctcacatgaagccgaacgcgatgcctgccgttatgcgagatttgcaccggacacggatcacagatcccgtttaccttgatcgacaacggccgacaccctaagacaatgcgcgttcgcggtgggaaatgccacgaaatgtcgaaaacgtgggttcttgccggttcgtggcatgaaatatccgacttgtctcattgcttgaaacaaaggataccgaatactagacaagtcagtaattgggcctcccatgcagttctattcgcgtcccggaaaaatcttgcacgatacaacgagaaaattgccgaatcaccagcagcgttcgagcatcgccgtatcctccctcgccacaccctccggcccagccgcatcacagcatgtggtagtcttgctgtcgttcatattgggcggcattccgatatgccaggaaagccgcgttgcaaaggtagtatcgttttgatttctcgatgagcgtcgccgagtggcttcatgagcgaagccgtgcctcggcgtacacgatcgcaactcacaccaatcacagatccgcaaaccgcatcggcaagattgcgccgatccggtttctgcatccgcgctttatgtgaattttccccccccccatttcatcgagaacaaggaacccaatgatacctgcactgaccctgacgaacatcgttttcacttatcctggcacatcggagccgctgcttgacggcatcgacgtcactttcgcacgcggatggaccgccgtgctcggcgacaacggcatcggcaagacgacgctggccaagctcgcgatcggccggctctcgccagatgtcgggcgcatatcgccgaatccgaaccgcctgcataccggttactgcccgcagaacaccgacgaaacaccggagaatctggaggacttcgcctgcgactggtcaccgcaagccatggagatacgccgtgaactgggcatcggcgacgactggccttggcggcccggcaccctgtcggacggcgaggcgaaacgcctgcagatcgcatgtgcgttggcgaccgatcccgacgtgctggtgctggacgagccgacgaaccacgtagaccggccgacccgcgagcgcatcatcgcggcattgcgctcgtatgacggcatcggcatcctcgtctcgcacgacgtggccttgattgacgcggcggcgagcagctgcgcgttgttcgaacgagatcatgtgcgcggtcgtaacatcaccgtggtgcgcgtgcggccgggaaactactccgcggcatccatggatgcgcaacgggagcgggcagcggcggcaggcatggcgcgcgacgcccggcgcgaatccacgcgcatcgacgcggtcaaggagcagcgccgacgggcggcgacgagcgagatagccggcgcgcccaaagcgcatcggctcgtgaatccgaaagaccatgacgcgcgcagtcgcatcaagaaaagccataaccccagccggctcggccccgcgagcgcccgcatcgacgcacaggcggccgccgcccgggaacgggccgcagccgtcgtcaccgccacgaagcgctatgacggagacatctggatggatgccgaatcaagcaaccgacgggagcttgtgcggctggagccccagatcatcccgtacgcgccgcaatcgccggatggagtcggcgcggcagcgatatcggagacagcgggcctgaagataccgatgctgaccgtcggaccgcatgaccggatcggcatcagcgggccgaacggcaccggcaagaccacgctggttcgcacgctgctgcgcacgatcgcgatgcgggaacagtattccggcgtcccgctcccccggctgacgatcacgcagaacacgacggatcaggatgccagggaggcgatgcgccggctcacggcgttgacgcccatcgaccgcggtgacgtattgtcggcattcgcgcagctcaacgtcgacccaagccgcctcctcgccggcggcaacccgtcgccgggcgaattgcgcaagctgctgctgtgcttgggattgcgaggtcacccgcatctgatcgtgatggacgagccgaccaaccatctggatctgcattcgattcaggcgctggcccacgcgctggccggataccccggcgcactgctgctcgtctctcacgacgagggattcctggagtgcgccgcatccatccgctggacgctgcattcggacggcctcggcggcgcgcaactaacggtcagttgacgccgccatgaccagcgtcttggccttgacccatctgagcaggaagccgacgtatggcagcgccacgccgatggccagcatatagccgacgaccatccattgggcggtgccggatgacacggagaactcgtccaccagatcgggcagcgcgatgttcatcgacgtttccgacagcatgcccaggaacgcgccgatgtacagtcccagcatcaccttgtgcggatgcctgaatttcggggattcagcgggaatatcatgtgcggagccgtgttctgcggccgcgtgttcttgcagggttgtttctttcgaagttgtctggatcgcggacaacatgacctctcttgtactcttcccgtcaccgtcgagcgagcggcgcgcacggccgggccctgcgtacacgtcgagaagtccctaacgtccggacctgcgacggcaacgaaaaaccgcatgactggcatcgggcgagccgattcgacgaatgccatgcggttttgaaacagccgtcaccgtagcacgatttgcaaatccgcataagtcgcatccgcgtatcgtgcgcgtatcatgctggtagaggacgcggcgaatcctcgctcgcgccagaccgagcggcgacaggaaagggagaccatgcagcatttcacccaggtcatcgacggcatcgacggctcgcgggccgaactcgtcggctatgtgatcgacaacagcccggagatggacccggaccggcgccggccggcgatcctgatcattcccggcggcgggtacgctatcgggtccgaccgtgaatccgaaccggtcgcgctgcaattcctcgcggccggctatcaggcgttcgtactgaaatactcctgcgtgccaagccggtacccggtggcgttgctggagatggccgaggcgatgtcgatgattcgcgggcatgccgacgaatggcatgtggatgccgggcgcgtggcggccatcgggttttcggccggtggtcatctcgccgcgaacctgacgacggtttccagcgatgccgagctgcgcgacgccggatatgatccggctgccgtgcgcccggacgcgctgctgttgtgctatccggtaatcacgtctggccggttcgcgcaccgcggcagtttcgacaacctgctgggtgacggcaaagacgatgcgtcgctgctggagctgctgtcgatcgagaagcatgtcgacgcgaccatgccgccggtgttcatctggcacaccatcaccgatcaggccgttcctgtggagaattcactgttgatgatccaggcgtgccgtgacgccggggtcagtatcgaggcgcacctgttcccgcagggcgggcatggactgtcgctcgccaccgtggacaccgcgcgtgccggctcgccgggcgagggtgacctcaacaacgtcgtgccggcagtgcagatctggccgcggctcgccttcgactggctccgccgcacgttcgacgtgaggtaaaggctgctgtcggaggttcacaggcccattcgcgcatatcccgcgcctgtgccttggctgtgcgccgtcaccgtgcgtgggttattgcgtcactgtgcgagggtaccgtcaccgtgcgcgccctcacgcacagtgacacatcaagaaaatccctgttttccaatgctttccgggtaccgtcacgctgcgtgtgccctcgcagcgtgacggtacccgcgcacagtgacgccgcggaacagcccattggcagcaaccacggccggcaacttggcagtgtcactcaccggcagcttgacgccgcgcgttccgcggctcaggcttggcgtggatcttcgcggtgagatggcgcacttcgatcttccataccgtgacgctgcgcacctgctgatcggtgaactctatatccggcatgcccgcctgctgccccatcagcagccgcagccctttgcggcactcgtccaggtcgtcgatcatgctggccacgccgttgccgatcaccgacttgaacgcctcgccccagttgcacggggtgcggccggcgatgacctcacaatcggtctccatcgagaacgccacatccaacgcgtttcccgcagcccggatcgcgtcgagtttgcggccgatcgacgccgagtggatgtacagggtcaatccggccagttcgtcgccggtgccggcgtccccatcctgctgccattcgtatccgaaattcagcggcacgatcgtaagtccctcggcatccgcatagcccacatgcacgatacggcatgcggcgacgattccctcgatctgttcgcaatcggtcacctcgcgatcggcgcggcgcatcatgcgatgccgccctgcgaccgtgcgctcgttattgcgtcgcgtcggatgcgcttcatccagtcccgtcatcgccatcactccttgtgctgacccgagtttgatttgatgatactcccgttccatgacccgtaattgaagatggaatcagccgcagtgcggagaaaaaactgagcagaaaaagaaaaagcgaccccggccggacttgaaccggtgacctccgccgtgacagggcggcgctctaaccaactgagctacggggccgttcgtgccgtcatcgggcacaagagaatataatacaggactactcgaccacgggcgtgtcgcggccaagcgcccgataaagaccggtcgcacacggcaaccggtcaatgcccggccgggcgagcgcacagtacggccacaaatgcgccttggtaacggctatgaactcccggatgaacgccgtgggccagtagtagccacgcgtatggctgccgcaccccatccgccttcagccctgatgcgcgtattcgctggctcggaacacatggtaatcgctggtgaccagcgcgcaacggtaggcgaggccacggcgcccggggaccgattgcacgccgctgcgcgcatccatgatctccttcgaaaaacgaagattctccatggtcgtggtggaacggtcctccatgagcaccgcgtcggcgggaacatgacggctttccgtcaggtaccgccgcatcgactcggcttcggacaccacttcatcgttcccctgtccgccggcggcgacgaacacgcccgtcttgccctgcttctcccacaatggccgccgccagcagcgccgccaacgacgccaacgtcatgccgaaattcattccggtcttccccaccagtcatcgtcttctcgacgatgcgctgagacccgtcactataccgcggaacctgcggccgtaccacttacgccggcagccatccaccaccgtctcttcccccggcatgtgcgatgccctataatcgtagatttgccctattcacacgcctcgggcacaccgccgcgacctcatgcgtgtacagtacaggaaggatttccatatggaaccgaattatctcgtgttgctgggaatcgtcatcgtgatcatagagttcgccctcaagctcgatgcgatcctgatcatcatcgtgtccgccgtggcgactgcgctcgtcggcggcatcattcccaagggcaacgtcacgatcggcatcatcgtgttcggcgtgggcatgatgctgttcacgatgatcatgggcaacgcgttcgccgcgatcaccgtgatgaccgtgggcatcggcgcgccattcgtgctcgcctatggcggccaacttcaacatcgtgcccgttgcgatgctcgacatgaaggaccgcatgggcgtgatcaagaagcaggtgctgccggcgatggtgatgatcgtcgtgcagatcgtgtacatgctcatcgcccagtgacaccgtattccatccgtatatttcaagcaaaggagccattatgagcaagatcctggtcaccggattcgatccgttcggcggcgagccggtcaatcccgcattcgaagcggtcaagctgctgcccgagtccatcgcgggcgtgagcgtcgtcaaattggagattccgaccgtgttcacgcgcagcgccatggtggtcgaggaggccatcgaacgcgagaagcccgattacgtgctgtgcatcggtcaggccggaggccgttcggccgtgaccgtggagaaggtcgcgatcaatctggccgaagcccgcatccccgacaacgacggcgagcagccattcgacaccccgctgcgcgaggacggcgacaccgcgtatttcgccacgctgccggtcaagaccatggtcaagcgcatcaacgcgagcggcatcccggcgctcatgtcgtacacggctggcacctacgtgtgcaacagcatcatgtacaacgtgctgtacctgctcgaccgcaggttccccggagtcaagggcggcttcatccacgtgccgtacgcgaccgcgcagggcgtgggcaagccgaacggcacgcccaccatggaaatcgcgacaatggccaaggccatcgaggccgcgatcgaagccgcagtgagcgtcgatgaggatgccaccgacatcatgggcgaaacccactaatcacgcccacccgtcgaaaaccactgacatatcagcccgccgacgagcccgctcatgggttcgtcggcacactgcagacggaccgaatcacttatcgggaagccggccgtcgggatcgcacacgatccattcgccgctgggatccacggcgaccgtcgggtgaggaaacacctggtcgaacaggtccgcgtcctcgatgacccgttccgaggtcttgtacgggacaggcctggcaccggccagacgtatgcgcgcattatcgacctcaaatcgttccacggccatatggtcgccttctcgcgatggccactcgaacgagccgtgaaatcacgatgcgcaatatccaaataccggcgctctctccggggatgaacgtgcaaacgatgaacgggcagatgatgaacgtggcgaccccgccgcactcccatgagatttctcgcgcagccatactgattccgcggggccgcgcttgcgttccaaccactccgattccatacgaccattacctatcctgacggccattatttcccctgattggggcgccacgccccactccagcccttccgataccatggtatgcggtggtttggcatgcccgcgaccgacatgcggacgggcaccgcatggaacggccggcatgcgcggaccaaaagcacagaccagaaaacggcggaatcccaacccctttaaggagtaactgcataccatggcagagtttattgttcagatgggtcagccttcgtgatcgttgctatttcaacgtttccttggcgtgtccgctgacacaaaacgctcgggaaccaacccggtggttcccgagcgttttgtgtcaagactgtgtcacctattgtgtcatcaatcagtcggattccattcagatgatcatgcaattcactgcgttcggaacggatgacactagacacatgtcctggcccgcagctccgctgattcacgtcaacacagtaagcatcaatgcatacctatcccattcagccacgggcacagcctactcaacagaccaatccccgaaccaacggcgaaaccgaaacaagcttcaatcaaaatcagaaacctcatcgtttcaccccagaccagaaaccatcgttggcccacccgtgaccatcaccgcctcccttgaatccagagaacggattgacatcatcacacaagaccagtaaactaggcttgctttctcttagcaataaggaaggctccaagccgccgggggtattcccccggcacttctttttcatccggggaggccggcgatgcgcgagttgagcatcatggtcgacgagtccggcgaatggggcaaactctccaagtactatctcatcacgctcgtgttccatgaccagtcagaaccggtcatgccccacatcgaacgctatgagcaacacctcgcggatgcctcactgccagacattcccttccacgcaggaccattgctcaacgggcacgccgactacgagaccctcagcatggccgaccgcaagcgcctgttcgtcgcgttcttcaccctcgcacggaatctgcccttcacctacgtgacgttcgcacaccgcaaaagcgagttcgacaacgacaaacgtcgtttcgaggctcagctgcggcgagacctggcgaactatctgctgacacacctcgacagattccagtcgtacgacaccatcaagatctattacgacaacggacagcaggtcgttaccaacgcgttgaaggcatccatcggctatgcactctccaaggaagcggtcatctaccgcaaagccgaccctaaagactaccgcctcgaacaagcagccgatctcatgtgcaccatcgaattgaccgcgctgaaattcaaagccggagaaaacaccgaaaccgatcacaaaatgttcggagactggcgctcattcaaacagaactacctcaaagcgttacgccgcaaacaagcaaaataaccgccatatcccgcatcgtttccaacagacgcttgcataaaaacactcagcccgcatacgacgaaagggtgggcatgccatgaaaggacatgcccacccctgatgtcagtggttcggcaaaccggctacgtgtttagcagcggatcctcctcaccgctgtaaaaccggcacccagcacggccagggcgaccagcgcaccggccacgaccgcacgtcaacgccggtcttggccaacccctgcttcttgccatcgttcttggaatcggccttcttgtcacttgcagacggcctggttgcagccggtctgttgctatcggacggcttgcccttcgcctcatccttcaggttatcgatgtacacgcgggcggttttgcccggctcgaccttgccaccggcaaccgcagccttcacgtcagtcttatcaggcaacgtctcagcaggcttcgcagccgcgacggacttcgtcgtgaaatcagggacgaacttcaacgcgttctcgttgtcctccacccaatggctcaccttggtattggaatccttgtagatgggctgcgcgtacagcgcgacttgccggatatccaccggggtcttcacatgcacgccattacgcagcaattcgttcgacgtgtcctgaacgacttcctgataggggtacgaaggaaaatcagagccctttgcgttgttcgtatacgcggtgttgggagtcaagccaatcaatgggaaatcaaaactgccggaagccttgccattccaggagttcttgttgaaatacctggcgaaccattggccagaggccttgaaagccaccttgctcccatcagtcgataggtcattgtcgttaaagacgcccttgtactccttatcgccatggaagccatagatgctgtcgtacgagcctgcggtcagctcatcatcggaaacgcccgtgctgcatatgggaatccagtacccccgatggtattcgcacttgagtgcgccttctctatcggggtgatgtcggtgatacgctgcacctcgatagagaagcacacgtccttgatctcgtccacctgcgcagggtcgatcttgtagtcgaacgacacgttcgccgtctgcgctcccacatccgacaccctcacgttggacgacgtgatcggattgtccttattcgttacatccgccgcgttcgcagtggcgacgcccccgaacaatgtgcatgcggccacggccaacgccgccatggcctttccgaaacgcctcatgacattccctccccccccgtggactcattctggcggcgtcgggacacgccgcatgcacgcgttcgcgctgttgcgccatgacgatggcgtatgggataatccacaaggtgcttttgcgtggaccggaacggccgtggcgacacggaaacggccgggcggatgacacgaatgactgccgttcgggacacccccgaaaccggttgtgtcattaccggatcagggtcccgcaaaacgttggaacttcaacgtttagtgaatggttaggtattatatggctgaattcgtatatcagatgatcaaggctcgcaaggcgtacggcgaccgtgtgatcctcgacgacgtgaccctgagcttcctgccgggcgcgaagatcggcgtggtcggcccgaacggcatgggcaagtcgacgctgctgaagatcatggccggactggagaccgtcagcaacggcgaagcctacatcacaccgggcttcacggtcggcatccttcagcaggagccgccgctggacgacaccaagaccgtgggcgagaacatcaagatggcgttcggcccgatcgccgagaaggtcgcgcgtttcaacgccatcggcgaggagatggccaatccggacgccgatttcgacgcgctgatggacgagatgggcaagctgcagaccgagatcgacgcggccaacggctgggatctcgactcacagctcgaacaggccatggacgcgctgcagtgccccgacatggacaccccggtctccgtgtgctccggtggcgagcgtcgccgtgtggcgttgtgcaagctgctgctcgaagcccccgacctgctgctgctcgacgagcccaccaaccacctcgacgctgagtcgattctgtggctggagcagttcctgcaccagtacaagggcgccgtcatcgccgtcacccacgaccgttacttcatggacaacgtggccgaatggatctgcgaggtcgaccgcggccacctgtacccgtacaagggcaactactccacgtacctggagacgaaggcgaagcgtctggagatccagggcgccaaggacgccaagctcgccaagcgcctcaagaacgagctcgaatgggtgcgcagctcgcccaaggcccgtcaggccaagaacaaggcgcgtctggagcgttacgaccagatggagaacgaggcgcgcaacaacaagaagctcgacttctccgagatccagattccggccggcccgcgtctgggctccgtggtgctggaagccgagcacctgcacaaggctttcggcgaccgcgtgctcatcgacgacctgtccttcacgctgccgcgcaacggcatcgtcggcgtgatcggtccgaacggcgtcggcaagtccacgctgttcaagaccatcgtcggcctggagccgctgacatccggcaagctgaagatcggcgacaccgtgaagatcagctatgtcgaccagaaccgtgaaggcctcgacccgaacaagaacctgtgggaggctgtctccggcggactcgacttcatcgaggtggccggcgtcgaagtgccgacccgcgcctatgtggcgagcttcggattcaagggctccgaccagcagaagctgaccggcgtactctccggcggtgagcgcaaccgactgaacctggccctgaccctgaagcagggcggtaacctgctgctgctcgacgagcccaccaacgatctggacgtcgagacgctggaatcccttgaaaacgcactgctcggcttccccggctgcgccgtggtcatctcccacgatcgttggttcctcgaccgcatcgccacgcacatcctggcgtgggagggcgatgacgagaacccggccaagtggtactggttcgaaggcaacttccaggcctaccaggagaatcgtgtcgcccgcctcggcgaggacgcggcacgcccgcaccgcctgcacaagaagctgacccgcgtgtgacacttgatcaagtcatgaagaagcccccgcaagggggcttctcgcgttttcggccccctcgccaaatatcctcccgctggcgggaggtggcgcgcagcgccggggggggggcgagaccatggcgcataacatatacgaggaggcccctcacggttggtgaggggcctcctgtggctattgatcggtcagaaccgatcagcgtcagcggacgctgcggcgacgaaccgcgacgaccgcaccgccggccagcgcgaacagagccgcgatggtggcgagcaccgccgtgtcggcgccggtggcgctgagcttaccgtcgttcggcttcgtggtcggcttcgtggtcggcttctccgtacccggttcggtcggctcggtcgggccagtcgggccgggcacctcagagtcctcggtgacggtgacggtcacggtggcggacttgccgttcgccgtggtcgcggtcaccttcgccacgcccttcgcgacggcggtcaccttgccggtcttgtcgaccgtcacgaccttgtcatcgctggaggcccacgtcaccgcctggtccgcgtcatccggcgcgaccttcgcagtcagctgcgcggtggcgcccttcttcagcgacagcgcgccatcagccacgccatcaccggagatggtcacacccgtagcctccggagtctccgccacctcggggttgtccttcggctgctcgggctcggtgagctcgaccggagtgaccttggccgtcgcagccagctcggcgacagccgcccaggtgacgcctgcgctggtttcggagacgccccatgcgtcgttgatctggaacttgacgtacacgtcaccggccggaatggtatccggcagcttgatggtctgcagttccttggtgtacgggaacactgccgtggcgacgggttcgccccaatcggtgacatcagcgacgctgttggcggtgctggccgtcaccacgtacactgcgacgttcttggccgggccgttcagcttgtcctgcggcttgtcctgacggtacaggtgggtgatggtcgcgatcttgttgccctcgccgggcgacgccttgaacgccagccagtgcggaggattggcgccggttccggagtacttgctgtgccagaacgtattcgtgttcttgtcgaaggcgttggacacaggagcctgttcggatgtggtttcttgcgagctcgccgcgtagtcgcttgcttccacgtctgcggtcagacttccggtcagcgccacgctggtggtgccgagctcttcaccggtctcggtgttggtgagcttgaactgcacggtggcgtcgcccgtcccagtggtgttgaccacgttgaagtaggcgatggcggccttgccggccggaatcgacttgaggctgacgcttccgggcttgatctcccagccttccggcacgaccggggtgacggtgacgtcaccggtgttcgcgttggatgcggccctcaccttgacggtgatcttggacggggaggccgggttcacggtcttggagtccacggtggcggacatgcccatgtggccggtgagcgtgaacagcgcgttgtcgctgaccaggtcagccgggaactgagcgacggtgccagcggcgggacgatgggtctccagatcgatgttctgctcgttgccggtggcgatggcgagacgctgctgcgtcagcgccggggagatggtgtacttgccatccttgtcggcgcggatctgccacttctgcgtgttacgctcattggcggtgtcgcgctgatcctgaccgacggacacgtcggcgcagttgcgcagttccggcgtcgcgccgacctgggtgacgacatcgagatgcttacttccggtgaagagcgcaagacactttccggacactgtatccttcatctggtagtagccgtcaggcgtggtgatgagctcccacggacctttggagatcgacttcaactgggggatgtcgtagatgccggcatcgaccggggtgtagtcgtattcgcggatgtccagcgggtagccgatcttgtcgatgtccgccttcatatcgttccacgtcgcccacgggcgggaatcggaccaggtcatctgtgagatgaagcgcatgccgtcgaagatctccttctcgacctcgttctcggtctggtagatcgagctgtcgggccagatggacaccttcgcaccggtcagtttgtcgtagttcttgtcgatctgtcgtccgccgtcaaaggttccgacgttccagttgttgttgtacagtcttgcggcgttgaccttgtacacttgcgccgaacgggaccagtacagggcctgggtcgcgttcatcaacgtgtatccgtcctggacgagctcctgcggcttgcggccggcaccataccagtattcgatgacgatgtccttgttcagggagacgttcttggtgttgacgatgccgtcgttccagatgcgcagctgcttgcccttggccttgacgtatttatctatgtcattgatgaagccggtgaacgcatcattcggtgtcgcgccggctccgtactgcttttcggcgaacgtcttcaacttgctgtagttgtcgaagctggtgccgatcatgtactcatcggcgcccatgtgccagtatttcgtggtgaatacgccgtcgtattcgtcaatcagcgtcttgtagaacttcacggcctccgggttggagatgtcgagcttgttgggatccttccggcctgagttgtcggcaagctggtactccgggtagttctccagccagacgttcatgtggcccggggagttaatctccggaatcacgtcgatgccgtagttattcgccttcttgacgaacttcttgacgtcgtcgcgcgtgtagtacgaccatgtggcggccttcttggtgttgtcctcttccggcttgagcttcatctccagcagcacgtagttgaggcgcaggtcggccatgtccgacaggaaacggtcgatccagtcagtggagatgttgatctggcaggcgcacagcgtagcgccgcgctccttgtacttcggcttcgtggcgaccgtgccggcgggcagggtcagctggccctggcgaagcatctgcgagacggaacgggtgccgtagaacacgccgatgtcggtcgcgccgatgacctcaaggcccttcgagccgatgttcagcttgaatccctcatcacccagttcggccttcttcgatgcatccaacgtgagcgagatgtctttgcccgtcgctgaaccggtcgcggccttgatgtccacgtcggtgaacttggtcagctcggatgccaggctctgcgcacgcgcggccagtgcatcgctcgacacgacgcgggtgccttcacccagcgtccatgcgccggtgccgtcggtccagccgtccatgctcgggacggtggccgggcgggtgagattcacgggagccgtggcactgtacccggctgcactatcgtcggcggcgctggccgtcatcgcggtgcacatgccaccgaccatcaggccggctacaatggccgcaacggtacgcacaccgaaacgtctattggagcttttctccattgaaacttcctttattctcttgttgcggttatgacaggagagcttcatcgtctccaatggatgccgagccggcaaagcaagacaaagccgtcacaacatcatcaccgattaaacgtacactgtgttaacaaaattagcaagatgcatgaatgtcgccttgcgttccagccttttccacgcccggcacccatattccacgtcacatcgcgttcatcatcggcttacgctcgttacaaaaccggccgaccgaatttacctggtcacgctacactgctgtgagtaccgaaaccggctgggagccgagcgaaagcatgaacatataaacggaccgtatatataccgcatgatatacgtcccggcacgtcactggaagggagcggcaatgacgcacgaagacggaacgacaccgttgaatcatctggtaaaggtattgagactgggcgacccttccgaataccgcggacatacctacatcagcggggagagcctgtacttccccaccggacgcgtgtacggcgggcaggtgatcgcgcagtcgctgatcgccgcgtcgaagacggtctcgcccagccggctcccccattcggtgcacgggtatttcatcgcggcgggcgatatacgccaggatctgctgttcgacgtggagaccctgcgggacggccggtcgttctcggcgcgcagggtcaacgtgacgcagtccgaagggccgatcctgaccgccatcgcaagcttccaggaacaggggcagtccggagtggagttctccgatacgatgccgcaggacgtgccggcacccgaaacgctcaccagtgccaaggagctgatggaaccatatgccgacaaatcgccgttcgccaagttctatgcaaagaagtcgccgttcgacatccgccacgtcacgccgaccatcatgctcggcgccgacaaggacagcgcggcgcacgactcaggcaagcagctggtgtggatgaaggccgacggcgtggtggacgtgccgcaggtaatgcatcgggcgatgctggcgctcggctgcgatcaggtgatgatggaaccggtgctgcgcagggcggggctgagcatctcgacgcctggcatctcgtacgcgtcgatcgaccattcgatgtggtggtatcgcgacgtggacatcaaccagtggcacctgtacgtgcaagatacgccgaccgccgcgcacgggcgtggactgggcgtggccaaagtgtacacgcaggacggcgagctcgtcgccgcgatggcgcaggaggccatgatccgcgtgccacagcagtgaggccacggacgatgagtgcggcgggtattgaggctggggctgagactggttcggtgccgggaattgcggctgcggccggtatcccggttgcggctggtactgaggctggaccgtcgttggtgtgccattttgaactgccggaccggtctgggcagccgggccagacaccggtacggcattctcgaccttggttccacatttcgcgcagaatttagcgcctgcttcaagtgcactgcccacagtgcatgcagaacttcatgcttttccctctcggatacggcccatcacagaatgtgcgttccgatcagcggaaccgcggattccatgctctctccatggcgatcctattcctgcacctgcgaaacccccgtttatcgcggacgggggtgttcacctattgaaggggcacggagattgccggtgatcagagtgcgggatccgtggtcctgattggcaccggaccaccctcagccgctacgcggcacctcccgccagcgggaaggggcttagtggcgggttttggcggtggcggaggcgatgccgcggcggcgtttggcggccttcatcttggggttctccgggccctccatgggcggcagctggcacagccattcgccgacgataccgatcaccatgtccgccaggcatatcacagcggcgacggcgcattgcgtcacggccgtcgcatagtaatccgcctcgatatgatcgagtaccagcagaatctgcccgacataccagccggccagcgcagcgccggtcagccccagcgccttcgacagcataagcgtgtacacggccttggtcgggtcgagcggcttgagtcgggcccgcttctgcggatcggtggtggcgtactgatgcacctgcagcgccatcaccagcacgacaatgcccagcaacaggagcaccacggacacgaaccatggcgcccccaacaacgaaagccccgaggactcactgacctgcacaagcagacagcccgcgatcagaccgagcagcagcgcgacgacatactgccaccatggggtgcgacgtatcttcattccgtactccctacgatccaagtgtcggacagcagtcccacacggtcggcgtcgggtgccatggccagcagatacgacaccgggtcgccgccgagccgcgcctgcgggtccatgtccatccacggtgcgagcaccgaagcatgggtgcgggctgacggccacggcacccggcagtccggctcatcgcagaccgttcccggcatatccaccagatcgaggtcgacatccccgttcaacgactcctcgacggaaccgagcgtggcaatcagcgccttcgcgtccatccggcacgtcatttgcatgacagccgacatggcatccgacccatgcagatggctcacatgatacagcggtgagatgccctcgacctgatcaccgggaatgccctccaatgcgacaatcgccgtgcggaacagggtttcggcctcgttactgcggctgtccatcgagatgacggccgtatgtatggccggttgaacggtagcggtatcgccgtcgcccggtttccgcgccgaaccgtcgacggttccatcgaattgcggtatgtcggctgcgctgccggacggctgcaccggggcatcgtcggccatgccggtcatccaactgtcgtcgatgcgatgtacgtcctcgcggtcaccggcctcgtgcagcaaatcggcaatctctcccccgtgcgggcccgcgagccgggcggccggatcaagagccagccacggtgccaaaacgaacgcccgctgccacgcacgcggatgcggcaaagtcacattcgggtcctcgctgacgaggccatcgacatcgatgatgtcaagatccagtgtgcgcgacgcccaatgttgttcccgcgtgcgtccatgagcaacttcgatatgctgcaggcggccaagcagactcgccgcgtccagctcggtcgtgacctcgatgacagcgttgagaaaatccggggtaccatccggcatgccccatgcggcggtgcggtacaacggcgatatcccagtcacctgtgtgccttcaaggccgtcgatatccgcgatcgcggaccgcatcgacgccgcgacgtcgcccttgttgccaccgagtgcgatcacggcgtggtgcatgggcgtgacacggccttcatcagctcgaccagttttgccgtccgtattccgtccgctccgccatcgctcgatggtgacgctcacgtcggcgaacggcacggtgatcggagctttgggcttatgcacggtgacggttacgccttggactgcgggatggtcggctatcacggcgtcagcgatgagagccgccagccgctcaatcaagtcgacatgctcgccttcgatgacggatacgatccgtttggcgacgcgcccgtaatcaaccgtgtcatgcaggtcatcgctggaaccggcacgtgacaggtcgagatgcagcacggcatcgacgatgaagggctgcgcgcgctggtgctcgtagtccagcacgccgtgcgtgcccatgccttgaacgccggtgaggcgaatcgtgtccacggttgcgtcctttcgtttaggttggtggtgggtgaccaccccagtcagcttcgccgacggccctccggctgagggagaagggttagttttggtattgtcgccagagggagccgattgtcagggcggcgcggctgcggcgcacgtcatgcacgcggaccgcccaggcgccgtgttccgcgcacagggccgacaatgcggcggtggcattgtcacggtcgtccatcgtcggctcgccgatgccggcatcgttcaacgccgccgaaacgaaccgctttcgggaggctccgatcagcaccggatatcccgaccgcttgaacagatccagtccgacgagcagcggcagattatgctcgataccgggcttggagaatcccagaccagggtcgatgatgacccgctccggggcgacaccggccttgagcaccgcatcaacctgagacatcagctcgtcatacacgtccttgagcacgtcgtgttcgtagtgcgaggtgtcggcgtccggcgccgcgccgcctttcgacccggccagccagccacgccaatgctgtacgatgtacaggcagtcatggtcggccaccacgtgcggcagatctcggtccagtcgtccgccggacacgtcgttgatgatctgcgcgccctcatccagcgcggcctgcgccacggcagagcgtgtggtgtcgatggagacgaccgctccgtgggcgatcagcgccttcgcggcaccggtcacacggtcgagctcgtccttctcgctgacgcgcttggcgccggggcgcgtcgattccgcgccgatgtcgatgatgtcggctcccgcatgcagcatgtcgtcgccgtggtctcgggccttgcccggatccagccacaggccaccatccgaaaacgagtcctcggtgatgttgagcacacccatcagcagtgtgcagtcggtatcatgcaaccgctgcagttcagtcatgaattctcctctccgtcaatcgccgaaacggcggcgatgccgaccagtcacggcgatgagccggatcagtgcttggccatgatcagactcattgcctcggcacgggtggccggggtgcgcatcacgccgcggaccgccgatgtgatggttcgcgacgcgggcttgttcacgccccgcatcgccatgcacatgtgctcgcattcggtcacgacgatgacgcccttggcgtccgcgtattccatcagcgcgtccgcgacctgctgggtgatgcgttcctgcacctgcgggcgacgcgcgtacagctccaccagtcgggcgagcttgctcaatccgacgacctgcccgttggacgggatgtagccgacatgcgcgacgccgtggaacggcagcagatgatgctcgcacaccgagaacagctcgatgtcgcgcaccagcaccatttcatcggtctcgaccgggaaacgcttggacagcacctcctgcgggctgcgtccgagccctgagaaaatctcctcgcaggcacgtgcgatacggtcaggcgtctccagcagaccctcgcgatcgggattctcgccgatcgaagtcaggaacagccgtacggccttgcgcacgccctcttcgtcaatcgccatatatcctccagcttccctcaccacttatatagtcgtcatgcccgccgaaccggggcaggcacaccgtttgccgtcaaacggcaaacgcccgtgcgcccggcgagcccctttgcgggacagtcgggcgcacgggcacgaaatcaccgctcccccggcttcatgccgacggaacgtttgagcgactccggaatctccaccggaggcttgtcggaatcgggacggcgctggtcggacagccacaccggacgttccggagccttcctgatgttcgcgaagatcgcggccagttccttctcattcagcgtctccttgacgagcagctggcgaaccagctcatcgagcacatcgcggttgtcgttgatgatgttccatgcctcggtgtgcgcggtctcgacaaggccgagcacctcctcgtcgatgacctcggcggtgcgctcggagtacttgtgcggcgcaagaccatcgaaatcggcgctctggtcgtcggtgtcggcccacttaatggcgccgagcttcgaggagaagccgtattccacgaccatggtgcgggcgatcttcgtcgccttctcgatgtcgttcgacgcgcccgtggtcggatcgtggaacacgacctcctccgcggtgcgtccgcccatcgcgtacgccatctggtcgagcagctcgttgcgcgactgcgagtaacggtcggtggtcggcatgaccgcggtgtagccgagcgcacggccacgcggcagaatcgtcaccttggtcaccggatcggtgttgtgcagtgcggcggcgaccagtgcatggccgccctcgtggtatgcggtgttgcgcagctcattgagggccatgcccttcgactgacgcttcgggccggcctggacgcggtcgatggcctcgtcgatggcacggttgtcgatcagctgtgcgccggcacgggcgcacagcagcgcggcctcgttgagcacgttggccagatcggcgccggtgaagcccggcgtgcgcacggcgaccatgtgcagatcgacgtccggcacgaacggcttgcctttggcatgcaccttgaggatggcctcgcggccttcgaggtccggcgcctccaccgacacctgacggtcgaagcggccggggcgcagcaatgccgggtcgagcacgtcggggcgattggtcgcggcgatgatgatcaggttggtgtcgctgtcgaagccatccatctcgacgagcagctggttcagcgtctgctcgcgctcgtcgtgaccaccactcatgccggaaccacgcttgcgtccgacggcgtcgatctcgtcgatgaagatgatggccggggcgtttttcttcgcctcatcgaacaggtcacggacgcgggaggcgccaaggccgacgaacatctcgacgaagtcggagcccgccatcgcatagaacggcacacccgcctcgcctgcgatcgcacgggcgagcagcgtcttaccggttccgggaggaccgtacagcagcacgccgcgcgggatgcgggcgcccagggccttgtacttcgacggatccttgaggaagtccttgatctcctcgacctcctgcacggcggagtcctcgccagccacgtcggagaacttggtggacggcgtctggccttcgagcagcttgccgttgttcttcttgccgcccatgccgaacatgccggacgcgccgcccatgcggctcatcaggaaccagaacacggcgatcatgatgatgaacggcaatatcgagctgatcaggtagctgaccatgctggtctgctgcatgttagaggtccaccccttggaggggtcggccttctcgaccgcctgcacgacctgcgcgccctgcgcgaacgtgtagtagaactgcaccttcttgccgtagttgtgcggcttgttcgtgtccggatcggtcttcgtgaagttgctcttcagctcaagctgcaccagctgcttgttgtcgatgatcttggcatacgcgacgttctcggtcttgagcagggcgaagccgtccttggtgtcgatggtctgcgtgccggcgccggcgaacagctggaagccggcgaccgccatgaccaccagcagcacgccccacagccacggggacttccagaacggctgcgggccgcctgagttgtttcccttctggttgccgttggggtcgttgggcgaattgcgtttgaacgggttgccgttgccgcggttgccattgccactcggcggcatctgctgagggccttgaggatagctcatacctgattattctccttgatacacttcgggcttcaacacggcgatggagtcaagattgcggaatcgctcgtcatagtccaggccgaacccgaccacgaactcatcgggaatctcatagccgcgataccgcacgtcgacgtccacttcgcggcgcgacggcttctccagcagcgcgaatatctccaccgacgccgcgccgcggcgcttgagttcctcgacgagccatgccaaggtacgccctgaatcaacgatatcctcgacgataagaatgtgccgaccgcggacatcgcaggacaggtcctgccgtatggcgatcgtcccgctcgattcggtgcccgacccgtagctcgaaagactcatgaaatccatctgcacgggaatgctcagcgcctgcgagaacgcggcgatggtgttcacggcacccttgagcaccgcgatcagcagcaggtcacgcccctgatagtccttgcttacctgcgccgccacctcgtgtatcttgcttgcgatctgagccttggtgatcagctcatggtcgatctcgtcttgaacatcagcgatttgcatggagaccatcttggcacacgcgaatgacgtgtttccgacgaaatgctgaatgaccgctgggaagtgccacggcaccctgaccgtgccactgcgagatcagccggtcgacggcgtcgacgtgacggaacccggcctcgatgccgaccgccgcgagcgcgtgcgcgatcacgcgcaatctgatcgcccgcggctcccgcgccaacgctttcgcgtcgatccgcagcagctcgcagtctccgtcgacgctcccgcacgaatccccggcgaacgtcaccgcgtgcgccgcaaccgattccgcgataccgtcgagatacgacttctcgatggatgcgagttcggcaccgtcacagaacctgctcacgatatcgccgccggcgaacgcgttcagatagggaatcagcgtgtggcggacgcgcgagcgcagcgggaaatcgtccggcaacggttcgtccgcagccatatggtcgccgttggtcgggtcatcccaccatgtgatcccgaggtcctcgcagatgccggtcgtgtccgcgcgggtcagacgcaggaacgggcgggcgaaccgcacgccgtcacgctcgacgatccgcggcatccccgcgagcgcatccagtccggaggaccgcagcacatccatcagcacggtttcggcctggtcgtcgccggtgtgggcgagcagcacgcattcggccgattcccgtcgggccgtatcggccagcgcacggtatcgcgcgtcgcgggccgcggcctcgacgccgtgaccgtcccccgacacttcgaccggcaccaccgcgaccgggtcgagccccagcccgcagcatcgccgtgccgccgactgagccacctcatccgaatgctcctgcagccgatgatcgaccacgacggccccgcatctgatgccccacgacgcacacacgatgccggccaccgccgccaacgccatcgaatcgcgaccgcccgagcaggccaccagcaccagcggggcatcgggcgcgggggtatggtcgccgtgctcggcgaagcgcggatcctgcctgggtagtcccagatcgaccagcatggatcgcatccggccgatcgcggcacgcatcacagcggtatatggcatgggtcgaaacctttacagcttggccagtttggcggccatcacgtttatcgccttgatggccgaccactggttctccgggtcgttgacgatcacggcgaacgacagcacgccgcccttgacgcgggacacgttgccggcgagcgaggtcacggcgtcgaggctgccggtcttcacgcggaacaggccgttgtccgggccggtgacgatacggttcctcgccgtgccgaccaggccggggatggacagtccctccgccgccgcggtggcgatgccggcggtgagattgcgctcctgtacctcgatcagcgtggtcacgctgaccttcgatcctggcgtcagaccggaacagtcggccatctgcaggccggacgtgtcgatgccctgctcggcgagcgtgtcggcgacggcctgcgtgtcggtcttgatgctgttgccggcctgacgcttgagcgccgtcagacggccgaatagctgggctagcgtattgtcggaatgcctcagcatgaacgccatgacctcgttaagcggcgccgagctgaccgaggccagcgctgaagtgccgcttggcgccgcgcccgcggtcggcccggacgtcacggtgatgccgttgtcggcgagccgcttcgcgaaggtcgtcgccgcgtccagcgcaggctgttgggacagcaccgggtattggctggaatcgtcgggattggccggcttgaccatatcggtccaggtgcgtccgccgtcgacggccatcgtggagatcgccgtatagtaccggtgctccgcgttgttttccgtgacgccagccggcgtacgatcctgcccgaacagcgaatcgtcgtacagcaggtcgacctgcgtgatgccgcgctgcttcaacgcctcggcggtgcgctgcgccagcgtgcccagcccggcatggccgttgatgtgcgagggatcgctctccccgtccgacagcagcatgtcgccctcaccctgcagcaccacggtcttgcggttgtcgtcgccctggatgagataggtcttggtgtcgagcgtggagcccatgtccagcgtggtcgccgccgcgaacgcggtcagtgtcttcagggtcgatgcgggctggcggggaatcatggcgtcatgctcggctacgatgttgcccttgccgtccgcgatggccagcgagaaggatttgcccacgccctcgctggcggagaactcgtcgaggatggtcttcgcggcctgggcgtcgacgggcatggacgcgtcgacgccggcggcgaccgtgccgcccgtgagcgcgtcctgcgggtcgggaatcgcgacgctgtccactccccgcaacgtcaggatgccgggtgccacgtcatagatgtcagccacgaaataccccgccatcaccgcaacggcgacgacggcggacaccgcgacggtgacggtacgccgcgtcatcggcagatgccgaatcatatgatgtcgggccgcagcctttgatgccacgagcgaactccttagacagacgttacatcatcgccgcaagggcgccgcccgaaccggctcagcgctgcagcgacgcgaacgaatccaacgtctggacgacacggatcgcgcgcgcatccaacagcttaccgccaagccatgaaccgatgaccatggccgccacgccattggcgagaccgaccggcgccatgacccatagccaaccgcccatatcggccacaacgagcacgatcgcgacgagaatcgtcggcagcatcggaatcagacagccgaaaagctgcacgaacgggaacaatccctgggcgacggcacggccctgcggtgtggagaacggcttgtccatcgacggcaccggatacatcagcgagcagttggtgatctccgcgacgccgatgctgctgaacgagacacccaacgccagacagatgaacgtcacgcccaggagcaggccgtcagccgtgcgccaatcgccggtcaacacgaagcaggccagaccgagcaccaccatatatatcacgttgatggacgcgaacacccgcatgcgggaccgacggtcgtcccagccgcgcacgccggccagcacctccatcgtgaaaccgcggccgtcgtatgccaggccgttgccctcggtcatctgcatcatccatccgccccagatcagaccctgccagatcacgatcgtgacgccacgcgactggagcgcgaacaacgccacgaacaggacgggcatcacgaacagcaggatctgacgcgggtcgcggcgcagatacgtcagcagacgggcggacatcgcgccggacgtgctgtccggcatccagccgaacgcgccgatgccgcggaccttcgcggcacgctcgggcgcacccgcggtcacgcggtcatgacgcaggcaccagacacagccgacgaagcacaccacccacgtgacggccaggatcgccagacgagccacgaacaggagcgggttaccggtcaataggtcgtacggcaactggaacgcggctccgaacggggtccagctcagagcgtcggccacgctcagatccgtcaatgacggaaaatcatacagactgccggaatcggcggggttgtcgatgatgttcggcagctggcacagcacaatgaacacgatcatcgcgatgaggtagaacgcgttcttgccacgtttcgagcgcaccagcgtcgtcgatgccgaaatgaccagcttggccagcgacatcatcgtgatgatggccagcggggcggcgatgagctgcatgacgaccatgcccacactcatccaccggtatgcgagggaccacagcatcagtgccagcgtgccacagatcgcaggcagaccgctcaggccgccgagcagcatgccgagctgcagtttccggtcgggaatgccgtacagcgcgaaccggtgcggagccatggtcgagccgtcgccgacgagcatcaactgaatgaacaggatgatgaagccggcgaacgtcgacccgtacatcaccgcgacgtgcagcaccccgtacatccaccccgcagggatgtgatgacccgccatatcgaatacggggccgccgaggaaccacgcgagagcgccgactcccacaagggcgccgatgccgaatacgatgccgagcacatagccgatggtctgccacgtcgacttgcgcagggtggcaagggtgagcgcccagcgcagacgcaccatggtcaaagcgacttccatcatgactcctcgggcgatgggaacggggcggtgggcgcagacgagtcggcaggggcgacgccgttcgccgcgtatccgccgtcgagccacgacagcttggccgcggcatgccggccgccgaccagctgtaggaaccgctcctcaaggtcctcgccggccgacacctgctctatcgtgcccgccgcgcggacctgcccggcgttgatgacggcgacgtgcgtgcacatcttctccaccagcgacatcacgtgcgaggagatgatgaccgtgccgccggtggacgcgtactcggcgaggatgtccttgaggttcgcgctggacaccgggtcgaccgactcgaacggctcatcaagcaccaggatgcgcgggctgtgaatcatcgcggacgccaggcagatcttcttggtcatgcccgcggaataatcggacaccatcgtgtccgcggcggaaaccagatcgaaggcgttcagcaggtcgccggcgcgactgtgcgccacatcgcgcttcatgccgcgcagcatgcccgaatagatcagcagctgcattccggtgagccggtcgaatatctggtcgggctgcggcatgacgccgatctcacgtttggcggcgttgacgtcctgccacacgtcctgcccgaggatcatcgcggtaccggcgtcgggaaccagcaggccggtcaccatgttgagcgtggtcgtcttgcccgcgccgttcgggccgacgaggccgaaaaacgagccgaccgggatgtcgagggacagtccgttgaccgcaatcttgcggtcgaagcgcttgtacaggccgcgaatggagaccgccgcgcgcgggtcgggcggcggcagtgtcgcaaccgcgggacgggaggggacggatgacgatgccgtacgcgcgggaaaaccgccaatctgcggctgattgtctatactcatgactcaagcatagaccatgcagcggtatagaccaatcatcccgcagatcgatgacgggccggcggcagccagcatcggcccggccggcggagccagacatcgctgccgaacgccggtcgaagcacggtccaaaaccgctcagcccttatgcacgattggcttccactgagccttggagaagatggcctggaacgaaatcggcatgtaactgagcatgtagatggggaaactcagcacataggcgaacagctccttgttggtggcgccgatgtggtcgcgttccgcgacgatcgtcaatgcggccagcgccatcatcgtcacgaccgccagcacgatgtcaaaggcccatcccgcaatcgcactgagctggctctgccacgtcacgaatccgaacgccacgaacagcaggcccagtacgatgcggatgacgcccagcaccgtgaacgggcatagcagcagggtgaaatcgacggacgaaaaatcacgctcacgcacggcccgcttgatcagcgccatgccgtaataccggaacacctgcaggaatcccttgctccagcgcagtcgctgacgccagctctgctggaacgtgaccggctgctcgtcgtacagcatggcggtgccgcagtatccgatgcggtcgccgtgcaggatggagtccatcgtgaattccagatcctcggtcagcagatggaatttccatcccctgttgcgccgcatcacctcgcgagaaaacatgaatccggtgccgcccacatgacagctggagccgaggatcatgcgcgaattgttcaggaatcgcgactcgcggatgaaccacagggccgaaccggacgacacccagttgtcggccagattgaccgaattgcggtagctggtcaggatgcggaaaccggactggaaggccttgttcatctcctcgacgtaatgacggtcgagccggttgtcggcgtcgaacacgaaataggcatcgtagtcgtcggccacacccgagtcaatcatggtgctcaacaggtacgacagcgcgtatcccttgccgatcagctccgtgtcgtggcgttcgacgacatggcatcccatctcgcggacgacttcggcggtgcgatcggtacagttgtcggccaccagccagatatcgatcagcttgctcggataggtctggttgtgcagcgagtcgatgaggttgccgatgacgttctcctcgttgcgcgcggagatcaacacggcgtagcgcttgtccatcggcgcgtccgggaagtgcaccggcttggagaacagagacatgatgacgcagatggcctggtagatgatgccgacgccgcccaccaccatcataagcacgtcgattacggtcagcaatgccatcagcgccacctgcttcgcggattgtcggtagacccgtcaccacggcgtgggcgggcggtctttgcgggacggtcggctgccggcttcgcggcggtgccggatgattcgctgtcggacagtctatcgaaggaggtcttcgcggcgccgggctctgcagagccgtcgctgctaccatcatcgccatgcgcctgtgcggtaccgtcaccgactccgcgcaatttcacggcgttgcccgacttcgccccctcgcgcacgctgcgcgacagcacgtccttcggtatggcaatcgtttcggaatcctcggtctcgttggcctcgtcaaggtcatatatctggtcgcgcagcgcacgtagctcgtcgctgatcggcacatgggcgctcgatcctttggcggcgcgcggcatatggtcgctcatcggcttgatcacgcgctcactgaacgcctcggcgccctccacgaccttggacttcttccccggcatcggatcgctcatcagcggcgactccaccagcgcatagcgcttcgtgtacaccttgaagatggcctgcatgctcgccgtgaccggcagtgcgaggaacgcgcccagagcgccgaacaacgcgcccatcaccagtacggcgaggaacgcgacgcatgggttgaggtccatcgtgcgctgcgagaccttcggcgagagaatcaggttctcgatctgctggtacacgatgatgaacaccagcacaccgaccccgtaccacaggccattcgacccccaggcgaacagcaccggcagcgcgccgccgatatacgtgccgaccgtcggcacgaactgcgacacgatgccgcagaacaacgccagcggcagccaatatggcacgtggataatctccaggaaaacggccgtgcaggtggcgttgatggcggccaggatggagcgggagaacaggaagccggaaatctgctcctgcaccaccgtccagccgagcaggaaacggcgctgcgtgttcggtccgagccactggcacaggctgcggcgcatcttcgggcccgcggccgaaatatagtacgtcaccatcaacacggtcagcagattcaacaggaagctgaacacgcccatcgtggtggtcaacgcctgaccggcgaaatcggtgatccacgacgtctgcacgttcttgaatatctccatgccgaggttctctatcttcggcatgtcgaacgacgtgtactgcttcaccgcgtccacgatctccgtgtatatcgacgggagccccttcaccatggagatcagctgctgcacgaacatgttgccgaacagcgtgagcaaagccatgacgatcacggcgaggccgatcaggctcaccgccgacgcgaggccacgcttccagccgtgtcgcaccatcgagaccaccagcggctcgaccgccagcgcgatgaatatcgagatgacgacatccagcacgatggtcgatatcttgccccacgatgtccacacgaaaatcgcggcgaacaccgcgatgaccgtgtacaacagcgcgcgcccccaccaatccggcggtcgacgcgaatcccctttggcggggaacaccgacgccaaatccagtttctgatcatccgtttcactcatgagaccctattgtagccagcgggagtgtacgcacaggtgcttatcctataagtatgctcaacgtttcgattatcatccccgcgtggaatgaggaggagcgcatcgccgactgcctgatgaacgccacgcgccagaccgtcgcaccacatgaagtgatcgtcgtcaacaaccgttccacggaccgcacctgcgacatcgtcgaacagttccagcgcgaccatcccgaagctccggtcatcctgctgcagcagaacgaggatcaaggactgatcccgacccgcaacttcggtctgaacgccgcaaccggcgacgtgttgggacgcatcgacgccgactgcatgctcaaacccgactgggtggaggtcgtgtccggcatcttcaccgaggatccggacgccatgggcgcgaccggaccggtggtgtattacgacatgcccgcgaagggtgccgggctcgccggcgacgaccacatccgccggcacacgtaccgggcggacaacgatcaggtgctgctgttcggttcgaacatggcgattcgcgcctcagcatggcacgccatctcgggcgaggtctgccgcgacccggaggacgtgatgcacgaggacatcgacgtgtcgctgcatctgctcaaccatggtttcaagacggtgtactcacagtgcatgatctgcggcatctccgcacggcgcatggacacgtccttcgcgtcgttccaccggtacatgcaacggttcaagaacacattcgccgcacatcccgaccattggcgcgagcaccacaccgagcggcgcctgtatgcgctctacccgtggctgcacatgctgtacccgatttatcagcagcatctggccgcgaaggacatcaacccggccgagaagatctggttcgacgagcagatcaagctcgtcaagagccatttcgacaatcccgagcaggtggacgccgtcgaatgacgtcggctgacgccagccgacagatgatggtggggttccaacacggtatgtgccggaaccccaccatcatctgttagccgcatccgttgcggattatcgcggctttctcccgctcacggggccggccggcggatggacgcgccgccgcggaccggtcccgtgtcgctctatcacatcagcgaggtgtagatcttcaggatgtcctcttcggtggccttgcgcgggttgcccggcgtgcacacgtcgttgaaggcgtcgtgggcgagcggtgccaagtcggcctcggtggcacccacctcggaaatcgtggtcgggttcttgagatccacggtcagctggtggacggcctgcacggcctcctcgcgcaccttctcaaggtcgccggtgtaggcgtcctcgataccgaacgcgtcggcgatgtcacggtacttttcgccggtgaagtccttgttgtattccatgaccggggccagcaggatgccgttggccacgccgtgggccacgccgagacggccgcccagcgggtgggccatgccgtgcacgagacccaggccgacgttggagtaggccatgccggtgatgtaggaggcgtaggccatctgctcgccggccggcacgtcgccgtcggcggacttggccaagttcttggcaatcatgcggatggtctgcatgctcaggcagtcagacaggctccatgcgcccggggtgatgtagccctcgatggcgtgggtcagggcgtccaggccggtggcgaccttcaggccgcgcggcatcgtgtcggtcaggtcggggtcgacgaatgcgacgatcgggatgtcgtgggggtcgacagccacgaacttgcgcttgttggcggtatcggtgaccacgtagttgatggtggtctcagaggcggtgccggcggtggtgggcacgccgaagatcgggacggacgggttcttggtgtcggccacgccctcaagggacagtacgtcggcgaactccgggttggcggtgatgatgccgatgcccttgcaggtatcctgcggggagccgccgcccaggccgatcaggaagtcggcgccggattcggcgaacttcttgacgccgtcctggatgcattcgaccggcgggttcggcttgacgttgtcgaacacctcatacggcaggccggcctcgtccagcacatcggtgaccttcttgacagttccggtcttcagcaggatcggatcggttacgatgaacgccttggtgaagccatgggacttcgcgaccgccggaatctccttgatggctccacggccaaaatacgcggtctgattgaagatcatgcgatataccatgctggctctcctttgaatgacgcgcgggcgttgcgctcggcgtatctgctatgacgattcctatcgtacctcgaaaactggaaacatgctgggaaggtaacgcaaacacagcagagaacagttgcggtatagcgctgtagcatacaatcgcccccgcggccttacccctacgaaaaatcccatttgtcaccgcgtaagtttcttcatcgcaagtcccacaaagcagtacatgccgtaccacattatgagctgccccgcatcccgccgccctcattcatcccgccaaagtcccatccgcacgggctgaaacgggacttcgctcggactagacactcggacgacacccccatccggccaaaatccgtttggcgcggcgcggatgcgaccatacacggatgacgtggccagaatgctcatgctggggacgatgcaaagaggcgatttcatgcctgcgcatcaatcagacgcccggctgcgctccgctcaggaatgatgcacggcactcgtcaccttgatggcggtccatgcgccgcgtacggccagcaatgcaagccatgcggcgaacagcagcgagccgacacgcggcgaaatcagcccggcgatcaacgtgcccaacggcgccgtctgacatttccgcccgcgccacgcttgctcttgccttcttcaatcatgctcacgggtttactctagcgcgggtaacgcctccaaccagcaccgggtgcaaattacgggttgaaatcgccgttctgggcaattccccgtgccaaatcgccgttttaaggtccaaaaacggcgatttggcacggggaatcacggattgcggcgatttcaacccgtaatttcgggaagagtggggaaaaaagagaccgggaggagggagggcgctgggggcatgcaggaccgagacgcatgctggccctagctcacgcaatcaggtaagacccatgacccgcccgacttctcgaccagatgcaagaaacccgccatcccaatgtttccaaagggtgacgggttttccgtggtggctccgagcggcatcgatccgctgacctagcgattttcagtcgctcgctctaccaactgagctacagagccagtgaacataaaaacccggcgaaaaccgggtcttcacattccagcgaccccggccggacttgaaccggtgacctccgccgtgacagggcggcgctctaaccaactgagctacggggccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccggtgacctccgccgtgacagggcggcgctctaaccaactgagctacggggccatatgcttgtttgcaagcaacgagtagatatattacagagttctgggcgatatgcaacttcggcgtgtcgcagcgcccgcagagcctcccaggcaggcccgaacaccaccgaggatgaacctgaatcccagtatttccagcacttcccgcacctaccctatcagcgccgccaacggcatgatcgcaagactggtgaaggcggagtcgccgtaatccttgtagacacaatcgccgttgatgcagtacgacccgttccaggtttccggatgattcaccatgtatacccccaccgcgatcgcaaaaatgatggtgatgataacgatcacgatggcaatcgcactgatgacgatgcccgctatggcgaacgccttgccgcgctcctgcgtgcggttgatctgccgcagggcgatgatcgagagaatcagtccggccgggcagaacacgaacgacaggacgaacccgacaatcgacatcgtgttccatcgatcgttcggcgcatagtacgccggcacgccataggggttcgcgccatacggaggatacggaggatattgcgcagcgccatagggagccccgtactgtggctgctgggcgccataccccggtgctccatagctgccggtctggctgtgctgaggctggccataccctggctggcccgagtacccggcctgaccataatccggccggccatatccggtctgaccatactcaccctgaccatacggcggcacctgaccatccgcggcaccggcacccggagcccacgaaccatcgcccgcctgctcatacccggcctgcgtcggcacctgcccgtcattaccgtcagtcggcatggcacttggcgtattcgatgacatctcaggactccttcggtcgctatcgttcccgccgccgctcaccgcccggcgctacgccagtatatcctgtcaacgccttcatctcaacgccaaggcatcacagcgccatccccgaaccggcgcaatacgatcggacagaccagggccggccgcaccgccccatccgcagacgaagcgacgcgaaccggccccgtattcggtcgagtcaccattcagacggcggtacgtccggccataagccgaccgtcaacgcccagcagcccgaccggtcacccagacacccggccacccgttcagccgacctgcttccaggtggcgacgtcgatgtggtgctcggggttggcctgccacgcatcccacgcggacttgacgatgtcctccacgtcgtacttggcgtgccagcccagctcctcgttgatgcgcttcggagagccgatcaggtgtggcgggtcgcctgcgcgacgggccatcacggcctcggtgaacggcaggcccgtgaccttcttgacctcgtcgacgatctggcgcacggaggtgccctcgccggtacccacattgaaggcgtcgtacttgcgctcgtcgcggtcaaggtacttcagcgcggcgatgtgagcgtcggccaggtcggagacgtgaatgtagtcgcgcacgcaggtgccgtccggggtcgggtagtcgtcgccgaagatggccggcgccttgcccttcttcaggcggtcgaacagcatcgggatgagattgaggatcgcggggtcctccagctccaccggaccgcatccggccacgttgaagtagcgcagcgcgcagaagcggatgccgaacggctgctcgcaggcgcgggccatccactcgccgaacagcttggtctggccgtaggggttgatcggcagcatagggacgacgtcctcgggcaccacgtcgaccggcggcacgccgtaggtggcggcggaggacgagaagacgagcttcttggcgttcttggactgggtcatgccggtgagcacgttgagcatgccgttgatgttctgctggtagtaccacagcggcttctcgacggattcgccgacctgcttgcgcgcggcgaagtggatgacggaatcgacgtcttcggcgtcgaggatctcggcgaggcggtcgccggcgcccggcgcggcgatatccatgccatacaaccgcgcgccttcgatgcgggcgggctttccgtagctcagatcgtcgacgacgacaacgcgttcgccggcttgatggagcgcatggacgacgtgggcaccgatgtatccgcacccaccggtaacgagaactgtcatgtctgtcctttcgtgaccgtgagcataaccatcggcatccgcgacgactgaccataaccaatggttaacgatagttgaatgtttgattatgctcgcttttgttattttttcgaacagttttatcgtagcacatgaacataagagaacaaaatatgttcattgaaacattaccgacattccagaccatgcacagatgacaggcgagacggcccctcgaagcacggcggccacgaaggaggtcaacggccccgggataatatggcacataccacgaccgaccagaaacgaggaaaccgtgccagagcagatcgaacagccgactttcaccccgcgtccggtactgtcgttcgtgcggcgatccggccgtctggacgcgcggctgcaacgcgcgtgggacaactacgccgacacgtatctgctggacatcaacgccggcgaggggtcgctggacgtgcgcgacgacttcacgctcgaccgcgacaccatcgccgtgacctggggcaacgccaatccgctgatcgtcgaaatcggcaccggacaaggcgagaacatcgtcgccgccgcggccgcgcaccccgacgtcaacttcctcgcgctggaggtgtacgaccccggcgtcgcgcacacgctgctgctcgccggcaagcagcggctcggcaaccttcgcatcgcgcaggtgaacgcgcccgaactactcgccgcgaccgcccccggctccatcgccgaggtctggacgttcttccccgacccttggccgaagatgaagcaccacaagcgccgcatcgtgcagccgcagctcgcgcagtccatccacggcgcgctagccgacggcggggcgtggcgcatcgcgaccgacatcgaagactacgccctgcacgtgcacgaggtgatggacgggcgcacggacttccgcaacgccggcacaatcgccgtcagcctgcccaccgggcacgtcggcaagggcaacgctgagctcgccgacgacatgccgcacgccgatttcaccgaatcggagcgattcgacgaccgggtgctcaccaatttcgaaaagaagggactcgccgcgggccgggtcatccacgacctcacctatatcgcggtgtgacgccgattacggcgtgtcgcggatttgcattatcgtcgcagctcacgtaatgtatatcgagttgtcagcccccatcgtctaacggttaggacaccagactttcaatctgacaacgagagttcgactctctctgggggtacccaccggctccggtttccacgaggtatcgtggcccggagccttttgtttccaacggtttcaggccgtcagcttggccttcagctgctcgaacaggaaatcgtgcggtggtcgctgccaccaaagatgcacctaagttcccctctcccagcatctgacgcatgagcgtgtcgtccagcagggacgtcacgggcacgccgaagtagtcggccagcgccgcgatgtcggggatgctccacgtgttcttgttcttcatcttcgcgctgacgccgcccctggtcatcttcaggggttccgtgagcgccgtctgggacaggccgtgcgcggtgagggacgcggagcagaggacaaattgtcccggaatcttggacagaaagtcacccaatagacaagtgataaacaattctcccctcatccccttcggggatgctcccctcaacgccgaatcagcctccacgaagccggtcgctgatccgaagcccgaacccattccggcgaccatggccgatcgcaaggccgtccactcgctgctgatcgacaggccgtacggcgagatcgtcgcgacgatggactgggcgtgccgatctacagggcgacgctgctgcgcacctcgttgtgtcaggaacacatcgaaggcgtcatctcgcaggaggcgtgcccggtatgcgcatacgacaaacgcaaccacgccacccacggcgtcgccggacggcgcaaggcgaaagccggcgcgcaggcagaggcggtgcagccatgagcggggacaggcagcatcttgaggcgtggaagaaggccagcgaatgccgcgacttcccgcaaccatggtccgactacctgtggtcgctggagttcgagcaccgtcccggcgacgcgaaggcgttcatcgggcgctttgcggctgtttgcttatcttggtcgaaaatatcctacccaaaaagcgctcttctcttactccctcaacaacccaacggagaaacccacccacgagaacagcaatagcgcccaattttctcaccttctatttccttcaaataagaacggcgggctcctttgacaaggagcccgccataatccttttatcagccgccaccaacgcggtatgcggtgcagatatcgggatcattgacttcggaaatcatgaacgcttcatcctgcatgattcacctcagctcgaccctactgcttgtcggcttcctcggaggcgagtcgtccttcgagctgttcgacgatgtgggcgtgcatgttctcgtcgatcttgacggtcaggaggaagacgacgaggctggcgacgatgccggcgagcggcaggtagtaggcgcaggtcttgaacgtgcggatgttcgcggcggtcatgtcggcggctttggcgttgccgaccattccggcggcgacgaccacgaagcccacgatgccgttggacagggcgccggcgatcttgtcgagcatcgggcgcacggagagggtgacggcctcgttgcgcttgccggtcttgagctgtccgtattcgatggagtcggtcatgctcaggatggcggtcatctggatggtctgcgcaggcaggtagaagaggacgagcgcgacgatgacgacgggcaggttcatgggcgcgatgatgaacagcgtgtagccggcgatcatgagcgccatgccggcggtgtacagccagcggcgcgggatgcggcggttgagcaccgggtagaggggcgtggtgcccagtccggtgatgaccgggatgatgccggcgatggagaagctgtccggagctccgagcacgtacttgaactgataaaaaagcacgccggtggtggcgacgttggccacggagtacagcagatagctgagggccacccacaggagctggtcgttctgggcgatggccttgaacgcctcgatggggttgccgttggcctcggccttggcgcgcagcccgccttggttctctcgggtgccgaacgcgacgctccacgcggtgagcaagccgagcacggcgatgatgatggcgaacgccgcccagccggtgcggccctgctcccactggccggtgaacttccaggtgaaccagctgacgacgggcacgacgatgacggtgacgccgttgtagccgatggatccggtgaacgcgccgagcgcggtgtacgtgctgcgctcgtgcgagtcggaggagatcgcggggatcatgccccagtaggagatgtcgcgcagcgagtagatcacgtcgagcaggatgaacacgatgacgaacaggaccatgaacacgccggtgttcacgtccacgaggccgaacaggccggtgaacaccatgatcagcaggatgccgggcacgatgccgccgatgaactgccacgggcggaaccggccccagcgggtgttcgtgttgtccacgaggttgccgagcagcgggtcgaggaagatctccgcgatgcggatgaccaccacgagtccggtgatcaccgcgatgaggcgtttggcaagcgtcttgtccacgtcgatgaacagcgcggtggtcacgaacgtgatgaagaacgtgctcatcgtgttgtagaacgcggcctggcccaggttaccgaatgcgtatgcgatcttctgacccgtgttccgcgtgggctgcggccttccggtcgtttccgtgtgttgtgtggtggatccgctcatggtgtggtggcctccttgcgacctgtaaagaatccgtgcgcgcgaaccgctccgatcccgcaaagcgtgagtatagaactatcttgaaaaataaaaaaactttaccgcgtgtcgcaaatcatgccaacgttctgcaaccggcacttcgtgtggatgagtagtgtttgaagcctgcttgatgtgcttgaatcttaagaaatccacgtattctgcatgttacaggccttgtgccgcgaaatgctggaaagaatttgcgcaatcaagtaacaatatttatccttgttgtacaaggaacccgattcaacgaggttccctcactgcggcggcaacgacgcgacgcaatccgatgcgaaagcgaggacatcatgaacacaaccgacgatcagcggaagaacggcgatccgatcgtctccccgtccataccgacgacggcatggctcgccgacccgcgcgtgtacgcggttcaccggctcgacgcccattccgatcatgcgtgctggtctcgctccccagtcgacggcgagggcacggatctcaggcagagccttgacggcgaatggcgggtccgcgtcgagacggcgccgacgggccgtttccccgatgggacgagcgacgggccggactggagcagcgacatgtcgcctctgttcgccgcgcccggattcgacgattcgtcgttctcacgcgtgcaggtgccctcgcatctggagactgcggggctgcttgccccgcagtacgtgaacgtgcagtacccgtgggacggacatgaggacccgaaggccccggccatccccgagcacggccatgtggcggtctaccggcgcgagttcgacgcggatggcgaagtcgcccaggccgtgcgcgaagggcgcccggtgacgcttaccttccagggcgcggccacagccatctacgtgtggctcaacggctcgttcgttggctacgccgaggactccttcacgcccagcgagttcgacgtgacggacgcgatcaaggtggacggcaacgtgctggcggtcgcctgctacgagtattcgagcgcgagctggttggaggatcaggacttctggcgtctgcacggcctgttccgctccgtcgaactcaacgcgaggcccgccgcccacgtcgccgacctccatgccgacgccgactgggatctcgccacatcaaggggttcgctctcgctggatgtgctgatcgacggtgccgcgaacgccgcgacggccgacttcgcactgtgggacaagaacggcaccatcgtctggcgcaccaccacgaaagcggacggaacgctgcacgccgaggccgagatcgatgacgcggcgccatggagcgccgaacgtcccgacctgtacgagctatccgtcactctgctcgacgcggacggcaaggtcctggagaccgctcgcactcgcatcggcttccggcatgtggccatcgaggacggcatcctcaagctcaacggcaagcgcctcgtgttccgcggcgtcaaccgccacgagttcgactgccggcgcggccgggccatcaccgaagaggacatgctgtgggacatccgcttcatgaagcgccacaacatcaacgcggtgcgcacctcgcactatccgaaccagtcacgctggtacgagctgtgcgacgaatacggcatctacctgatcgacgagaccaatctggagacccatggcagctggaacagccccggcgacatccccgtgggaacctccgtccccggtgacgacgaggcctggctgggcgcgtgcatcgaccggctggacagcatgatcctgcgcgaccgcaaccatcccagcgtgctcgtctggtcgctgggcaacgaatcctacgcgggcgaagtcctcaaggccatgagcgcgcacgcgcaccggcttgatccgggtcgtcccgtccactacgaaggtgtcaactggaaccatgcctacgacgggatcagcgacttcgaaagccgtatgtacgccaagccggccgagatccaagactggctcgaacacggcgacgaacggggcgaggcgagcaagccgttcgtcagctgtgagtacatgcatgccatgggcaactcgtgcggcggtctgagcgagttcatcgacctcgaacggtacgagcgctactccggcgggttcatctgggattacatcgaccaggggctcgtccagcgtctgcccgacgggagcgaacgcctcagcgtcggcggagaatggggcgaccgtccaaccgactacgaattcgtgggcaacggcatcgtgttcgccgaccgcatgcccagccccaaggcgcaggaggtcaagcagctgtattcgccggtcaagctcgcccccgacgggcacggcgtgaccatcgagaaccgcaacctgttcgccggcaccgacggctacgtgttcgccgcacggctcctcgaagacgggcatgagatctggcatgccgactaccgtttcgacgtggccgcaggagatacccaacaccatgacatcgccttcccggacatcgacgcggacggggatacgcgcgaagtcacctacgaggtcgatctcctgctcgccgaagccaccgcatgggcgccggccggctacgagctcgcgttcggccaactcaccggcacgctcaaccccgaacgggacatcaccgagaccagccatgacgacgacggccgcgcaactcgcacgctcagccgatggaacgccggcatccgccgcgacgacgaggaaatcctcctgtcacgcactcagggaggcatcgtctcctggaagcgcgacgaccgggaaatggtcatccgtcgccccgaactcgtcacgttccgcccattgaccgacaacgatcgcggtaaccattccggtttcgaccgtgccgcatggttcgcggccggccgatacgccatcgtaaccgaaacgaaaatccatgaaagcgatgacggtctcgtagcggaataccagtacgagcttgccgatccgaaccacacgcccgtgtccgtcacttaccatgtcaactccgatatgcgtatgcaactgaccgtcgaataccccgggaacgccactgacatggccagtctgcccgcgttcggtatcgaatgggagctgcccggcgaatacgatcgtctgcgctactacggccccggccccgaggagacctaccgcgaccgtaagcagggcggcaagctcggcatctgggacgccaccgcgaaggcgagcatggcgccgtatctcatggtgcaggaaaccggcagccacgaggacgtccgctggctcgaagccaccgacatccaaggccacggattgcgcgtcacccaacgcggcgaccgtcacttcacggccagcctgctgccctggaacacctacatgatcgaggccgcacgccgccacgaggacctgcccgaaccgcgccacaactacctgcgcctgctcgcggcccagatgggcgtcggcggagacgactcctggggagcccccgtccacacggcctaccagctgcccgccggcaggccgctcaccctcgacgtgaacctcgaactcatctgaccggcaacgggcggcggcatgcaccaccatgccgccgccggccccgcctacgacgcggcgatcgaggccacgggcgctgcggccgcggacggcaccggcgaggaggcgttcgagcgcgccggccacgcggtccacggcaccacccgccaggtcctctcgctcatcaccaacccgatggacgtgatctgccgcaacatccgcaccgtgcgcgagaagatggcaacccgccccgacatcctcggctgccacctcgaaggcccgttcctcgccctcaagcgcaagggcgcgcacgagccgaactgcctcaaggacccggtgcccgaactcgtggaccgcatgctcgacacctcgggcgccaacctcgccgccggcaagctcggctgcatccgccagatcaccatctcgaccccaccgactggaccgcccaacacgtctggtgcgccggccgccaggtggagtaaactccttccagcaaaatcgacgccggtgccgcccgtcttcgagacgacgtcttacgcctgaggaacgaagcttgcgcgcggcaccagttcggtcgtcagcaggatgtgacgatgcacccgccgctcatgcttcaacccatcgatcagggtggagaacgccatgcgggccaactccctttgatcgatcgcatacgaactcagcggcggcgacgtgtaccgggcgatcgactggttgttcacactcaccacggccaactcgtcgggaacctccacgcgcagtgcgttcaacgcctgcaacgcccccaccgcaagcacgtcggcggccacgatcaaaccatcgggcatgctgccggcctcacgatggtcagccaccaactgctccgcgagacgatagccgttctccacggtgaacgtgccggacgaatacaccaatccgtccgtttccaatcccagatgcgcggcccactgacggaacgacagctcgcgaatgtcctcgggatagtcatgcatgcccatgatgctgcccacgccgccgagaaacgcgatacgactgcggcccgccgcgatcatcgcgtccaaggcgtccagcatcgtctgcgacagatcgggacgcacggagtcgaacaggcgcggcgccggattcgtgtcgatgcacacgccatgcgggagcaccatatgcagggcgcgcaggtccgcttcgggaaacaccgtggctcccacggtgatgaacccatcaaactccgttgcgcgttccgtcaactcgcgtatggaccggatgaacgtgagctggtccaattccaacgactccgcacgctccgcaagaaccttccgcagatcggcgaagtacgcgtcctgcaattcctccccggacggaggcgcatccaacaccgcgatcgcgggacggaacacgttgcgataccccatctcctcgcacacgcgcaacacacgccgacgcgtctcctccttgatggagaacgacgggtcgttcaacaagcgtgacaccgtgctctgcgacaccccggcccgtcccgcgacttccttgagcgtggccatgacatcctccccgcaaactttagtaaagggttttactacagcataacccgggaaggcggggttagcggcattggcggcgtggaagtttacccatgactggtagactgcacatgtcccggcaataggggcaatgcatagggggtggcgggcatgtgcagcaacattcccgtcaccttacgattcttatagcgtgtcaggtaaaagaattaggattctcaatccaccttccggccgcgcctgcagactcaaatggccaatgatgcatagcgacaatctcttgcactatggataaacccaatccgtgatgaggtgatgcagatcccacatgcgtatttatcctattatcctcccctctgttaaaaggtgacaggaaatcatctatcctcgtatcggaaagatccatgccggtattggatatgtctatcgcaatgcaggactcgccttcgtattgcctgtcgttggctaagtttatccatacatgtggttgagccgcacgattatgctgaatggcattcgtaataaggtttgcaatcatctgtctaattagcagaccatcggctaggatatatgcattctccagattggtatgtacttgaactctatctccgataagttccatattttcctgaagaacattgcgaatgatctcagctacattaactcggctaaggtcagctcggtttaattgctgaactttcgacaattcgagcagatgattgacgatttcaaccccagcatgatttgaagccaaagccttttcgacgaaaggtctgcaacgctcatcgaaaagctggttgtgcagcggaatctccaatgcggccgaagtggccgcaagtggattttttaactcatgtgacgcatcggcgataaattccttttcccgactgattgcgctgttgagatcctttaacatgaggttgtatgcggatgcaatagtgtacgcctcgtcgttttcatatggaataacgataggttgcctttccaatccagcgtcggacgcgataatctgagaggccacactattgattcttcgttgtgtcctagtggcgataatccaagttattcctccagataatatgccgaaaacaatgatgggggctatgcttaccgccaatatcagatcccgggattttatgtctccttgttccatagttagcgttaaagcatccttaccggagtcatacccggcagaaacgtaatccttaccggagtcaggaggaatggcttgcgaattcaaactatgttgttcatcggcatcttctgcctgagtaaaagatttatttacggtcactgtttccagttgccggttcacgacataatatgtcatggcggtcaccactccggtaagcatgaagaacacgatgacgatcgtggtgaccaatcttcttcttgtagaccactgaaacggtaaacgcagtttcggatggctggaatggctcccattcgacgaaggatattcaggctttttcatgatatgcgatatccttgtccgggaacggtttcaatgaaatcagtgattccgattttcgtgcgaatcgcatagattgtggtcttgacgatccctctcgtatgagcgtgatcatcctgccaaatctcacgatatagacattccgcactaatcaccgcacctcgcgcctcaatcagcgtcctcaatacggcaagttctcgtttcccaaactttagttctgcaccgcgaaccgtgatggatcccgttctgaagtccgcagaaaagtcatcccggttgtagaccatgtcattcaccatgctcaaacgccgacgcaccgcattaactctggccagcagttcggcgtattcaaatggtttcgttaaatagtcatctgccccaagatcaagcccgcggactatgtcctcggtctgagatgccgcggtcaacatgagaatgtgtatgggatcacgccgttcgcttaacctcttagcgatttcgtcaccatgcagtccgggaagatcgcgatcaagtatcagcatgttccactccccggaattcagttcctccagggcatcccggccatcgtaaacagcttttgcctccatgccttccatggagagtcccatccgtaccacatcagcgagattggcgttgtcttcgacaatcagaaccttcatccgtccagctcccttcgcgaaacaatgcgcacaccatagcattcgcgtccaacctggtcaggaatcggtcaggttcagtcagcggcaggtcaaaacccgccttgccagccgtgcacgtcgtagctttgactccggctggacggacttccccgtcgcggcctctttcacagaagaaaggaaacaacatgatgaacatgaagaaaggaatacatatgtcaaaagatgcgttgcgcgtggttgcggctgccggtgtgttgtcagtggtgttgggtttgggggcgtgttcgatgccgggttccgggaatgccggtgcatcagatgggggctcctcctcgtcttcgtcgtcttccggatcgtcgtcgtatgaggcggagttgaagcaggcattgcagtcggcgtcgagtgatttcgagcgcggggtgttggagcgcgcggtcaaggccggcaggatcagcgagtcggattaccgcgaggcgaacgagaagtaccaggagtgcatggccgccaagggcgacgacgtggagttcgacacggaccagtccaccgggttgatgcaggaacacatgaacacggacgataattacgattcggccaaggcgaacgaggacagcatggcgtgcgcgaagggcacgaacctgcagatccgcgacctgtacgagcgaatggtgcagaacccgtcgaacgcggacgagatcgaactggtcgtgggttgcctgaaacgacgcaagctggtgcctgattcgttcacgaagcaggattacctgaccgagatgggcaagcccgaggggtcgtcgaagctggacacgtcgtcggacgcgttctcccagtgcctggcgaacccgagcaagtagaggaagtgttgctcgtgtttcgacagggaagaatagtgcccgcacgcgtcggcgggtgaacggcgtggggttcgtggcggcgtgcatggccgcgtgtctggcggcgggcatgggcctggccgtggggctggagcggacgatgacgccgccgtccctgtcggattcctcggatgcgggaaatctcgcgttggggtcggaggagttcgacgacgtgcgttccctaaacgtggacgtgacggcgtcgccggccggtggggtcgcgttcccggtgtcgggccgggccacgttcgcgtcgtaccccgcggacggcgtggtgcgttcgggctcacgcgagtacggcgtggatggcacgcctctggtgagcctgcacacggacactcccctgtaccgcgatctggcgtacggggacaagggcgacgacgtgacagcgttgcagaacgagctggccgcgctcggctacggcggctcccggtcgggcgtgttcgactgggccacgtgggacgcgtggcggcgcctgtacgcggcgaacgccggcacggccacggcggcggcccgagtccagcagggcgcgttctcccgcgcgttggcggtgtggctgcccgcgcagacgatgagcgtgtcatgcgcggcgtcgctgggttcgaccgtgaccggcgattcgacggattcgctcgcgttccgcagtctggccggggtcgcgtcggtcaaggccgcgtccctgccggacggccgcatccaaggcgatcgcgtggtcgaaatcaacggcagggactatcccatcggcgacgacggcatcgtatcggacacggccgcgttgcaggcgatggcgggatggtccacgtacacgggcgcgcacaaggacggcgaggacgtcacgagcgtgaccgtgacctacaagctcaaaaagccgatcggcgtgtactcggtgccagcgtccgcgctcaccgggctcaagggcagcgacggatgcgtagtggcgaccgacggcacaagcgtcaaggcgcacgtggccggcagctcattgggccgcacgctggtcacgatcgacggcaaggcgcccgcgagcatcaaggccgatccgggacaggcggtgtgcgatgcgcgttgacctcgaccacgtcggccaccggtacgccgacggtccgctcctgttccacgatctgaccgcgagcctcatgcccgggcacgtgtacgcgctgaccgggccgagcggcgcgggcaagtccacgctgctcggcatcatcgccggctggaccacgcccgccgaaggccaagtgacccggcagggaatcgactcgatgcgctggattttccagaacccgcacggcgtggcccaacgcaccgcgatcgaccacgtcagcctgcccctgctcgccaaggggctcccgcgccgcgaggccgaggaacaggcgcgcacgctcatggaccggttcaacctgacccgggtcaccgaccgcaggttcgcggaactgtccggcggagaggcccagcgcctcatgctcgcccgcgcgttcgcggcccagccctcgctcatgctcgtggacgagcccaccgcccagctcgacatgcacactgcggccacggtcagcgaatccctctcccgtatcgcccgcaacgacacgatcgtcgtggtctccacccacgacccgaacacgcgcgacgcgtgcaccgacatcatcgatttgaagaactaccaatgaaccacaccacgatgaaagcaaccgccgtcatctccgaggcatggcgctccatcaccagcggcgcagcccgcctcgccccggccgtcctcgccctggccctgaccgccgccggcatgggcgtcatggacatcgccgccggctcaaccatcctcgaccaggcaagcgcataccggcaatccggagctgacatcctcgtactcaacgcgcccgacggcatcgacgcggcatcctgcgaacgcctcaccagcctcacgaacgtccaggccgccggagcgatccgcactacggacccgctcaccctcgcggccctgcccgacaccaccacgcccctctaccagatcacccccggcctggccaaactcctcgacaccaaacaggacccgaacacgaccgggctgatcgcatcccaacaagtcgccgaaacgctcggcacctccaccggcggcacgatcggcctcgccgacgggcgcaccgcgcgcgtcaaaggcatctaccaataccccgacgacggacgcacccccggatacgcgtacgcgctcatggaggaaacacccgccaccggcacgttcgacgcctgctgggccaagacctggccgcaaaccgaccggacccgcaacgccctatggtccaccctcaccccgaacgcgaaaaccaccggcgacgatgcacccaccctcggccagctcaacaccaccaaaggcgacggcttcgacggacaaaccctctaccggcaacgctccacacgcatcctgcccgcctgcggcgcactcatcgccctcgccatcggatacctgctcatacgcggccgacggctcgaaatcgcctccgcactgcattgcggcgtacccaaacccgcactcgccacgcagatcatcatcgaaaccggcatcaccatcctgctcgccaccgccatcagcctgcccatcgacatgaccgccgccagactcctcatcgacaccaccgaccgaaccgccatcaccctcaacgccatacaaaccaccatcaccaccaacaccgcctacctactcgccaccaccatcaccgccctccacatcaaagaacgacatctcttcacctacttcaaagaacgataaagcgcagaaaatcattaaaattacgtgatccgtatattccgaaatcctcatcatcgtcggcggacactatcagcacggcatcctactcgattcataggctgccgttttcatttatcaatgctctcacgaagggagcgtaagacatttagcggccacatcgaggtagggggctggccatgctgatcggctcctcgttggtctgcatgacgcgcgggaggacggtatgccgtggcggtgcgaatggcgcatcgtccgacgggctggcgcacggtgtttgtgtcgccgacgttgctgatgttgccgggggtaatattgatgatggcgttgccggcgcgtgttcgggcgaatccgacgtctggcacaagaccgtcatctgctggctcgtcctggtcgcatacctgtacatccaatgcgagaactatgcgttcgccgcctcgaaggcgaggcgcgagcgctgattcctcgcgggccgacgcatcgacgcgccccgagatggaccaaaatccagaataaccgacattcgccgctgttccgtctttcgcccaaggcgtatatctacccgtatcttgaggtgcatcatgtattgtcgcggctaactaaccggcgaaacgcggcatgtttcgcattttgggcgaaaagcccaaggcccacaggaggtattgatgacgttcgttgcacggtcggtgcgctatgttctcagaaaacgagtgcgaaccatagtgctcctcatagtattgaccatcataacagcgagcatgctatccacgatcgcggtttctcgagcagctcaacaggccgccggacgaatcgagaaggaagcggtcggcggattcgtgctggccagcaatctgcagggcagcatgctcacgcctcgcggaggcggcatggtgcgtcccgccgacgtgcgcaggatcgcccaactgcccggggtcgattcgtatatggtccgtcagaacgccaccgccgacctcgtgggggcgaatgtggcgaaggtccccggcggcgatgattacgatgcgaccaaggagcagcagttcggcaacgccgccaacgtcataggcacgaatgattcgtcgaaactcaacgtgttcacgtcgcgcacgctcggcatggccgaaggacggcatctgaaggcctccgacaagtacacgtcgatgatccatgaggatctcgccaaagccaacgggctcaaagtcggagacacgctcacgctcaaggccaacgcctacgacgccgacaacgaatcacattcgacggcgaccgtcaagaccaccatcgtgggcatattcaagggcgacagcgccagaaaggtatccagccgagcggaactgaccgccaacaccatctacaccgatctggataccacacgcgatctgtaccagtacaaggacggcaaggaaatataccaggacgccaccttcgtgctgtccaagggcgttgacgtggagaagaccatggacgccgcaaagaaactcccggtggattggaacaattatcagatcacgcgcaacgaccagtattcatcgagcatgctgcatgccgcccgcggcgtgcgctccatgatgcgcggcgccctgatcggcgtgaccgtctcggccgtgctcgtgctcagtctcatgctgctgctgtggatgaacgaccgccgtcaggagatgggcatactggtgtcccttggcgtcggcaagccctccctggtcgcccaatacctcaccgagatggtgctgatcggtctgccgtcccttgccctcggctggctgtgcgcgcagggaatggcccaatggctcggcaccacggcgctccattccgtgaacgcctccgcggcgaaggagctgagcagcatgggacaggtcggcggcgaccttgaatccagcatgtcggtgcgcaccctggattcgctcacggtgtcggtcgacgggaccgccatgctgtacgtggcgctcggattgttggcggtgatgctggtgtgcgtcgcggtggcgtgcataccgatgctgcgcaaatcgccgcgagacctgtcggagattcgatgatgagcatgaatgtgtggaagcgtgccacgttggcgatcgtacgcaagccggtacgcagcggcatcatcggtctgctgatgctgatggtcttcacgagcctggtggcgcaggtcggagtctcgacggccctgcgtaccatgtccgacagcatcggcgcgggcatgggcatagggtttaccgtcagcgccggcgagaatcccatcagcgccgaggaggcgagccggttctcgcgtatccccggtgtgacgaagaccgcctatgcgacgaagaccttggcgcaggtggatggcgcgcgcccggtcatgccccggcagggcccccgattggactccgatctggccatgcaggtcagcgtgctgggcaccaccgattcctcattgtccgaggaattccagagcggcctgtaccgtctggagcagggccgccatatctcgggcgacggcgacaatgtgctggtccaccgcgacttcgcgctgcagaacggcctatcggtcggctcgacattccgtctccggcaggaggggcgcaacgccacggtgcgtgtggccgggatcttctccggcaacgtgcaggcccaaagccccttgccctcggacacttccgagaacctcatctattcgggtaggcgagtgacctccgctctgaccggaaacgaccagatcggcatgatccgatgcctgtcggataatccgcaggacctgtccgcggcggtcagtcaggccaagaccatggccggcggcaagtacgacgtcaccgacgattcggcccggctctccggcgtcctgcaatccgtgcagacggtgcgtgatctggtgcgcatggtgctgctgtccgtctgcctcgcggacgtactggtgctggcgatggcgctggtcttctggattcgctcacgcatccatgagataggcacgcttctggccctcggcatcggcaagatgcggatcgtcgcacaactcgccatcgaaaccggactcatggcggtggtcgccgccctgtgttcgctgggcaccggcgccatgctgtcgggatacgtgtcttcccgactgttgcgcgattcgggcgtcgcgccgttggaatcgttgcacgtggaggccttgccgcctgagcagacgctgctcatcctgctgctcggatgcgcggtcatcgccgtggcccttgccgtgtcatgcgccgccgtgctgtccaaatccccgaaatccattctttcctctatgcgttaggagtcaccaattatgtctaactgtctgcaactggaccatgtcgattacgcctacggcgcggcgaagatccttgttctttcggatgtcagcgcggatttcgaatccgggaagatgtatgcgatcaccggcccgtccggcgccggcaagagcacgctgctgtcgctgctggccggcctggacgccccctcccggggagtggtccgcttcgaaggggaggacatcgccacatcgggctatgcgaagcaccgtcgagagcacgtgtccctggtgttccaggaccataacctgatcgactacctcacccccgaagagaacctgcggctggtcagcaccaaggccgatatgaagatcctcgaggaactgggtttgagccgtgaggaatccaagcgcaacatcatgcacctgtcgggcggccagcgtcaacgggtggcggtcggccgcgcgctggtcgccccgggccgcgcgatcctcgcggacgagccgacgggcagcctcgacccgaagatgaccgacgaggtgattcatctgctgcagcacgccgcccatcagctcggcaaatgcgtgatcgtggtgacgcattccaagcgcgtcgccgactccgccgatgtcgtgctgcgtctcaggagcaagaaactgacccgggtgtgacccacctgggccgggcggcacccatacaccgcttcggcattctggcaccccgcaccccggcaccccggcgacccactcgcgttgccggggtgccgtattcgttctgcgacataatgtcgtgctaatggaaccatgccagtaatgaatgatgaagtgcccggcgagggcgatttcgacgcggggcgtcgacgtggcgagttcgacgatatcacttggcggattctagcggtggttgcaacacctggtgtttttttggtgttgcaaccaccgctagaatccgcctttctggtgttccccgaatccaagcagccacccaagctcgtcgaatacttcggcaaggtgctcccctatgccatgaccggcctgctggtggtatacgcgctacgcaacacgccgatcctgaccggttcgcacggtattccggaactcatcgcctgtgccgtcatcacattgctgcatctgtggaagcgcaacatgctgctttcgaccgccggcggcaccgcggtgtatatgctgctgatacagctggtgttctaggagcatgcctggcggcgagtcccgtcaaggatggatgaggaacccgccgcccaacctgccgcagaaccgtcactcgaacggatacttcagcccccacttcgcccgcagctcgtccatgagctcgacgatgcgcagcgaatcggcgtgcggcatctcggcgcactcctcgcgcccgtcgagaatcgcgttcgccgcggcggcgacctgatactcgtaaccggtcagctgcgccggcacatcgtaatgctccgccacggcatggtcggcgccgtacacgtcgatcgcttcgatgttgttgatgttgcggcacaccacgtaccccttgtcgccccaaatgcagcccgcacggtcggagcaggcgagcatcgacgacgtgggcaccgccatcacgccattggcgtaatacagcgtggtcgagttctgcgcgtccacgccggtcggggcgtatggcgtcatcgacgtctcgacgcgctcgaccggcacctcgccgtggccgcccatcaccatgtcgatgaaattgagcgggtacacgccgacgtcgagcagcgcccctccagccatcgcgggatcgctcatacgcgccttgcccgacaccggatagcacaggttcgccgaaatcgaccgcagctcgccgatcgcgccggaggccacgatccggtcgacgatggcccgcgacggcatgtagcgcgtccagatagcctccgtgcacagcagaccgctgccgtcggccgcatcgagcagcgcacgggcctgcgcggcgttcgcggtgaacgacttttcgaccaggatgttcttgccggccttcaggcaggcgatgccctgctcggcgtgcaggctgtgcggcgtggcgatatacaccagatccacgtccgggtcggccagcagctcgtcatacgagccatacgacaccgggaacccgtattcggccgcgaacgccgcggccctgcccccgtcacgcgcggcgaccgcatacggcgctaccagaccggcataccgcgggtccgccgccatcgccaccagtgttcgcgccatcgaatgcgcgatgcgcccagcgcccagaatcgccacgttgacgcgcaacccctgcgcttcggcctcggcacgtctgccgttcagtctgctcatcattcctcctcgaacgttccgatacatgttccgatggaatacgcgggtatccccgcgaaaccggctgtcaatgcaccagaataatccggtgaacgatatccgcccggctcgccgcggcgcaatccggcgaatatgacgcgacgcgcccggcagtcatgccaaggcgcgtcgcgtttcatcgcatctcgtcgcgtgccgccacgctccggcggccggccgcatgccgtcatccgatctgccgttccacccaatcgacgatgtacggcgcgacctcctgaatctggccgatggccacctggaactcgtggggcccgccataccagggatccaccaggtcgatggaatcctcgcggccggccgccggcttgggcaggttcgggtcgaaactgcggtacatgtgcacttcggcgcgcttggaggacggcagctgccgcagcagcgcgcgcatatgcgaggccgtcatcggcaggaacaggtcggtttcctcgatctcctcgcgcgtgacgcgatgggcgaaatgatgcgtggggatctcatacccgtcggctcgcagcacgcgcacggcgcgcgggtcgataggatggccgtactcctcgtcgctcacgccgctggacaggacgcgcacgcggtcctcccctatcccacgcgactcgaattcggcgcgaaggatgatctccgccatgggcgaacggcagatgttgcccgtgcacacggtcatcacggtgtatgggtgctgctgtgtcatgatggctcctgatggtttccgatgggcgcctgtgcgtaaggcacccggtgaacttgcgcgcgcggcgattcagccgatcttgcgataggtgacgaagcggtaccgcttgattccgctgtcgtccttctgcgttctcttccaatggccggggtcggcgacctcccacaggccggcgtcgaccagagcgtccatatcgggcgcatacgtgtctgcgtccactgaggtctggatcttcgtcacgaacgccttgctggcgaaaggcagcgcctcctggaagacctgcgctccaccgatcacccagatctcgctgcggtcaagcccgtcgtcgggaatggcctcctgccgcgcgatgtcgagcgccgcatccagatcggtgacgaccgtggcgcccagcgccagatactggggattgtgcgataccacgatgttgtcacgattgggcagcggacggtacttcacgttcagtgactcccatgtcctgcgtcccatgatcaccgggtgagagacggtgagctccttgaaacgtttcatatcctccggcagatgccaaggcatgccgccgtcgaacccgatggcaccgggacggccgtctttgtcgtcagcttcggcccaaatcaggttcactgaaaacgtcttgggaaagtcatcaccccaatcatcggctttctcctgcccggcgaacccgggctccggttcgtgatagccgttgcggctactatcatgctccatttcattcactccttgaatcggactgggacaatagtgtaacggtcggttcagaccgcgaccggcgccttgatggtgggatggtgccggtagtcgacgatcgtaaaatcctcgtactggtagtcgaacagcgaatcggccttgcggatctcgatcttcggatacgggtacggctcgcgcgacagctgctccagcacctggtcgacgtggttgtcgtagacgtggcagtcgccgccggtccagacgaattcgcccggttccaagccggtctgctgcgcgatcatcatcgtcagcagcgaatacgaagcgatgttgaacggcaccccgatgaacatgtcgcacgaacgctggtacagctggcagctgagccgcccgtcggccacgtagaactggaacagggcgtggcagggcggcagcgccatgttctcgacctcggccgggttccatgcgctgaccaccatgcgacgggagtcggggtggttgcggatcaggtcgagaacattgccgatctggtcgatggtgcgattcgggtcttcgggggtcggcgcgggccagctgcgccactgcacaccgtacacgggaccgaggtcgccattctcgtccgcccagtcatcccagatgtgcacgttgtgctcctgcagccagcgcacgttgctgctgcccttgaggaaccacagcagctcgtatgccagtcccttgaagaacacggtcttggtggtgagcagcgggaatccttctgacaggtcgaaacgcatctgctgcccgaacagggatatcgttcccgtgccggtgcgatcggacttgagcgtgccttcgagcatgatccggcgcaccaaatcctcgtacggcgtggggacgtcactgtgaggacgggcggggatacgggtgcggatatctgcgagttgttccggtgtcaaagccatgccacccagtgtaacgacagcggctaacagcccgaggcgagtggcggagacgacggacggcagcgtgcgatggatgcggtagcgtcacgctgtgcgggtaccgtcactgtgtgcgccctcgcacacagtgacggtaccacaaaccccagtgtttccagcggtttccaagaaaccgtcacgccacgaacccgcacagcgtgacggtacccgcacagcgtgacgccgaaacatggcatgcacaggcgatttcggagatgaaacgccggacgagacgggggtagacaccccaaaccagacccagatcagaccaaagtacccatcgagcagacgtgctcgggccggaggggcgtccagccgaacgcgtatcacgacccatggcgaacgattgtggtctacattagaggtatgtgtgacgcggcaggcgcgtcatgacgactacacgaggagatacgcatgggcaagcgactttgggtcgagcgcaacaaggatggttcatgggatgcgttcagcgatgacggcgctcacatcaagttcggcaagggccgcggagtgttcacccccggagacctgatgaagatcgcgctggcgggctgtgccgcgctgtccagccagttcgccatcgagcacacactcggtgacggcaagggcgcgaagatcgtcgtggacggcacatatgacgccgacagcgatgcctacatcaacttcaacgagcaggtcgtagtggatgccactgacgcgaagctgagcgaagaggatgcgaacaagctcaaggagcgtgtcacgcgccacatcgaaaagggctgcaccgtcaagcacacctatgtgcaggagacgccggtgcgcatggacgtgacggttcgccactgaggcatcgcggggctcctcccctgtcatataacggcacggaggagttcatgctgccgcgtccgcggcacgagcgccggcacaacaacatcgtggccccgccgggcatcgagtccggcggggccactgcatgcatcagagccgaatcaggccttgtgctcggggtcgatggccgaatcgatctgctcgacgacctccggctgcgcggccggcaccggcagctcctcaacaccgccgatggactccaagggcttcggctcgacatcggccggcgagctcggaaccgtgtcaagacgggattccgcggcttcgacgtacttgcggggtacgacatacaccgggccgacggcgtgctggatcagtccctggctggtggagcccagcagcaggccggtgaacccgccgcggccgcgggagccgacgacgaccacgtcatggtcatagctggctttggtcagcgcctgcacggcgttgcccggcaccacggtgcgggtgatcttcagatcggggtaggactcctcgatcggcttgatacgcacctcaagatcctccatgaaggattccatcacggccttgtcgccgtccgatccctgcaccttcggcgcggcggagatcacgtcgagttcggcaccccacatgttggcgaacgaggcggcgatgtccagcgccttcagaccccacttcgactcgtcggagccgaccgccaccttggtgatcgtgttgttcaggtgcatcaggttgccgtcgtcgtcggtatagggcacgacgacgatcgggcagtacgcgtacgcgggcagcgacgagctggtggtgccgagcaggcgctcggccagtccgcccttgccgcgattgccgatgacgatgagattgtagttgcgcgacagctcgacgaacacggacgctgggtcaccggtgacgatcagcgtcgccgcctcgacgccctgctcgtcggcgatggccttggccttggaaagaatctcctgtgcgtcgctgtgcgccgcgttgtcatcacccatcgcggtgtacgtggcgtcgaacgacactgcggcgtagctgggcaacgaatacgcgcatacgatctgcagcgtcaatcccgcatgcttggcaaaattggcggcccaccacgtggccttgtaactggcatgagaaccgtccaccccaaccagaatcgccttttcgttgatcatggcaacctccttaaggtaacaccgatgcagcggcgcatcgggtcatagttcctagaataccgcgtacgcgtcaggatgcgggatgaacatcagtcattttgccgattgagaacaatgccacattcctggcgtcggtgtgtcataacgcgcggcagcgcagcggaagcgggcacggcatcgtcgccgcatcacctgtcgaaaaagcacgacagcgccccaatggaggcgctgtgcagtgcgaaatatcgttcgaagactcttcgaccggaagcaaccggcttagatgattcggtagtactcgaaggaagcgtatacgggcacgatggacacgctcttgccggggcgcggcgcgtgaatcatcagaccgttgccgacgtagatgcccacatggccggatctccacatcaggtcgcccggctggggatcgttgaccttcgtgccgtgggcctgagcccacacacgctgctgatagtcgatacgcggcaggctgatgccgaacttggcgtacacatactgcgtgaagcccgagcagtcgaatcccgacggcgtggtgccgccgtacacatagggcacgccctggaactgggaggcgtaggcgaccacgccggcgccattggcgctgaccggggcatcgaccgcaccgtcattggagacggacgacgagctggtgctgctggtcgcggccgatgcgcgggaacggctgacctccgccgcctgcaggcgggcggcttcggcggcggccttctcggcggccttgcgctcctcttcggccttcttggcctcttcctcggcctttttctcggccgtggacttggtctcgggcacgttcagggattccacaccgccccagctttcgctgtcatcggagctgaccgatacggtctccttgagcaggtccttacgcgcggtgttcatcttcgggaacgagcgagaagaggtaatcgccttcctgctcgcattatcggaaccggccaaggcgacaggcaccgataccgtgaacaaccccaccgcagctgctgcggcggtgatagtcgaaataatcttcttgcaaatcatcatcgaggcatgattgtagcacacaggcatgcatcttcgcctgaaaacactcacgctaggaaatcacgccatatcggcaacatcacgggaaaaccggcaatcttcacacgaccggcgcgacactcccgggagaataatagagatgaatctcactggcggggaccgaagacccgccgaaaatcagtagtggatgtactggaagtcgttcacgttggaaagggtgcgggatgccggcttgccgttcagcgaagcaccgcactccgagacggtgaccgtgccgtcagcgttgatgctctccacgatggcgacatggccatacacggaactcgcgccttcctgacccgcgcggaacaccatgacgtcgcccttgtggcgaggcgtgttgtccacccagtagccgtgcgcacgagcggagttcgcccagtcctgaccattgccgaaatatgatccgacgggcaggccgagctgatggcgacgcaggtatgcccaccacgtgcactggctgaacgcataggcgagaccgctgtcgcccgtggcatggttcgggttgaatccttcgggcagcttgccggcatcctggtcgaccagcaccgcgacctgcgggttgttcgccagggagcgggacagctggctcacgtcgatggcggagttcttgtcgttcagctcccagttgccgttattggtggtctgcacggatttggcgtcggcgatcgtgttgctcgtcttcgcgtcggccgcgccgctcgtggccgcggctgcggtctggtcggaggcgatggggccgagctcggtacgggattcggaacgcgagaccgtcgaaccggtcacgcgggccagctgagtggtcgtcgtggcgggatcgtcggccagcagacgagagttggacgactgctggatattggaaaaggccaaggcggtggccgcagtgccgaccagagccgcaagggatgcggatgacatcatgtacgacttgcgctgcgcggccttcgcggtctcgcggatggcccggcgggtcatcggggcgacctcgttcagcttggctgcaagaacggggtcgatggcgagcgccacggcatcgccgttggccgcctgcacggcacgcacggccctggccgtgtgggaaccccgggaggagcggaataacgccgaagggctggtgcgctgaacggaatccttattggccttatgcgcagcatgcctcatactttttgctcctttaataccatcgcgatgcggccttccgaagacgccgcacgttcatcacggttgaccagcttaccgcggggtgcggccatcggcaacccgaccgcatccgacacatgaacgccgacccccatcaatccgcatcattggctagtgttgaacatatggacaatatcgtgaacatcccgtcctcaatgaagcccgaagacggacgattcggctccggccccagcaagatccgccccgagcaggtggacgcgctcgaacgcggcggcaagacgctcctcggcacctcacaccggcagacgccggtgaaatccctggtcgcctccatccgtgaaggactcggctcgttcttctccctgcccgacggatatgagatcgcgctcggcaacggcggcgcaagcgccttctgggacatcgcctgcgcgtcgctcatcgtcggcaaggccgcattcggcacatacggctcattcagcacgaagttcgccaagtcggcgcagagcgcgcccttcctcgacgaccccgtcatcttcgcgggagagccgggcacctatcggctccccgagcgcaccgacggcgtggacacctacgcgtgggcgcacaacgagacctccaccggcgtgtcggcaccggtgcggcgcgtggaaggcagcgacgagcagaacgcgatcgtcgtggtcgatggcaccagcgctgccggcgcgttgccggtggatgtcagccagaccgacgcgtactacttctccccgcagaaggcgttcggctccgacggcggcctgtggatcgcggtgctgtcgccgcgcgccatcgcacgtgcgcagcaggtcgagggcgaagccaagctcgaaggctcccgccgttgggttccgccgttcctctcgctgacctccgcgctcgacaacgcacgcaaggatcagaccctgaacacgccgtcggtcgccacgctaatcatgctggagaatcaggtgcgctggctcaacgagaatggcggcatggcctggtccacggcacgttgcgcgcagtccgccgcgctgctgtacgagtgggcggagcgcagcgaatacgcccggccgttcgtcgccgacccgggctcgcgctccaatgcggtcgtcaccgtcgacctggatgacgcggtcagcgccaaacaggtcatcgccgcgctgcgcgagaacggcatcgtagacacgtccggataccgcaagctcgggcgcaaccagctgcgcatcggcgtgttcccctcggtggagccgtcggacgtggccgcgctcaccgcgtgcatcgattacgtcgtcgagcacctgtgacggacgcggcagcaagagccgcccgatcatcaaggactgaacgctcgggcgggtgccggtgtatgtaccgccacccgcccgattcatcccatgcgctaaggtatataggtatgaaattcgcagccatcatcaatcctgaagtacgcaagccagcaccgaaaccggtgcgtgtcgacctgcgcaagacgttcctcatcggctgcgtgctgtggtcggtcgcgctgatcgtcagcgcgatactgctcgcgtgcgggctggatgtgctgcaattgctcatcatgtgcgcggccggactggtcatcggcgtcatgatgctggtatgggagcatttcgaccgctgggattaccggcgtctcggcaactgagccgtatcagtcccccaccggcagcgacagcgtgaacgtgctgccctgcccgggagcgctccacaccgtcacatcgccgtgatgggcgagcgccgcatgcttgacgatcgccaatcccagaccgatgccgtcggtcgtgcgctcgttctggttggaaccgcggtagaaccgttcgaagatacggggcagatcggccttcggcacgccctcgccatgatcgatgacacgcaccacggcgttcttcccgtccgaagacagggcgacggagacgccgaccgccccgcctgggtgtgaatacacgatcgcattctccaccatcttgcgcacggccatgcgaatctgatcggcctccccgtgaatcatcacggggctcttgccgccgacccgcacctgcaccccggcatcccgcgcagcgccggcaagatcatccacggccccggaaacctgcgagaacaggtcgcaacggttcgcctccgaagccgtcaccggctcctgagccttaatcagcatcagcaggtcagagatcatgcggtcgagccgcacacaggaatgccgcacctgccgcgcgtggttcgacagctgctcgtagctcacgtccgcgctctccaacgaatcggccagccgctccagcgcgcgggtcggttgcagcagctgttcggagacgttcgatatgaacgagtctcgaatctgagcgaaccggatcgactcgctgacatcgttgatcagcacgagcaccagatggtcgccgatgcgtcccaccgtcaccttcagccagttcggccgagacgaggcctctgcggtcaggccgtcatcggcagccgcggcgccgaatccgttcatcgtcatgaactgctccggcgtctgagtctccaggtcgaacgagcaccgggaaccgtccttcatcaccttgtgcaccgcgtcaagcaacgtaggttcgatcagcgtgtcatcacgcaccaagccgagtctataggccgcaggattggcacggaccacctcgtcctgatcgtctaccacgaccgacgccagcgagagcatcgacagcaccagctgggtggagtcatccagatcatcggccggctcgtcatcctcctgacggcggcgcgcgccgcgacgccgagactgcaacgacggcaagcggtcattgctgcgcagcgcgttcatgatgacgggctgcagccggtccgcgatgaaaaagccgattcccgccaatgcggccagcgccaatagcgcgaaaactacaaaaatccataccgacggctgaaactgaggcatggttccattgtctcacaccgagaggcgacatgcggcgaacgtgaattccgggtgaactagccaatgaattttgagacaatttcaagaacctgaccgccacgcactaggcaaacacagcttatgcggcttacacttgatagaggttccatcaagagcaactacatagcatgaaaggctacaacaatgcgcgttatttttgacgaggagctcaaggccgttgccgatgacctcgatcgcatggtgcaagacgtgcgcaaggccatcaacggggccggagacgccttgctgaagcaggatgtcgaagccgcccagagcgtcatcgacggcgacatcgagatcgatgccctcgaatccagcgtcatcgaccagtgcatccgtctgctcgccaagcagaacccggtggcgaccgacctgcgagtcgttgtatcgacgctgcggctcgccgcgaccttcgagcgcatgggcgatttggcgaagcacatcgccgaagctgcacgccgcatctaccccgaaccggcgctgccggccgaggccacggagctgttcaccgagatgcagcagttcctgtcgatgaccgccgaccgcatcgtcgtcatgctgcaggaccgcgacgccaaaaccgccgaggagatcatcctcgacgacgacaagctcgacgcgctgcaccacaagaccttcgacctggctctgtccgacaagtggaccggcagccgtcagcagctgatcgacgtcgtgctgctcggccgcttcatggagcgtctcggcgaccacgccgtgtcggcctcccgccgcgtcgtgtacatcgtgtccggcttcgatccgagcaaggagccgtcgcgcgacgaggacggcgccgtcgagtgacgacgaccgcggcgatgccgtcaccggcattccgccataactgaacttctctccacggagagtcccatgaacggcgagacggccacggctgctcgccgtttttgtatgccccggcgggcggtgcgcggctttggaacccggatcatagactccatcgcgacgtcaccgtgcgtgagttgcgtcaccgcgcgcgccctcgcagcgtggcaccccgcacgagtcacgcttcgctgcgctcccagtcagcggaagcgggaatggtgcgaatcggcgagaagacggccacgaccatgcccgccgtggccagtgcgcacaccacggcggcgatcagcgtgaacccgcccggcacgaaccgcagcatgccgccgaccacgaccggtgccacggcgccgaatacgccgagcagcgtttcgcataccgaggagacgcccccctcggcctgcatcatacacgtcggctcgtggccggatacgcaaaagggccgctcccatgagggaacggccctatgcatcaggctaatgccgggtcagagaatcacttctggccctgagcggcgacggcggcggcaccggcggcggcggcctccgggtccaggtactcgccacgcggcttgaccggcttgaagttctcgtccagctcgtagagcagcgggatggcggtcgggatgttgaccttggcgatctcgtcctcggacaggttgtcgagcatcttgacgatggcacgcagcgagttgccgtgggcggcgatcagcacggtcttgccggcgcgcagctcaggctcgatggcggactcgaagtagggcttgacacgctcgacgacgttggccaggcactcggcttccggaaccgggtcaccggcgtaacgcgggtcgtggttctgcgcgtactggtcgttcgggtcgatctcgggcggcggggtcgcgtaggagcgacgccacagcatgaacttctcgtcaccgtactcctgacgaatctcggtcttgttcttgccctgcagagcgccgtagtgacgctcgttgagacgccagtcacgctgaaccggaatccacaggcgatcggcggcatccagtgcgatgttggcggtgttgatggcacgacgcagcagggaggtgaagacgatgtccggcaggacgttcttctccttgagcagctcgccaccacgcttggcttcggcttcgccctgctcggtcagcgggacgtccacccagccggtgaactgattggtcttgttccatgcgctctgtccgtgacggagcagtactagtttgtaagtcataactcgcagtctaccgctcagcccggccaaattcgagcctttgtccaccgtttcgccgagcgcttgcgcaggaatactcacaccatcagcgaaatcagcaggatgacggcgaagaacgggggctggaagcaggcgtccgacagcgctttgcggaattccttacggcccgtgctggtcaccatgcgccacggcacgccgatgccggacaacatgaggatgccgccccacggcgtccacagcagcatcaccacccacactccgatcgcccatgcgacgacgcagcagacgcccagcatcacgcgggcgccgcgctcccccatgcgcactgcgagtgtgcgcttgccatgccggcgatcctcgttgatgtcacgcaggttgttcaccatcagtatctggcatgacaacagccccgcgacgaccgcgcacaacacgccgagcacgctgaccgaaccgctcagcacatactgcgtgccaagcacggcggccaaaccgaagaacaggaacaccgagagttcgccgaatcccgcatatccgtacggatgcttgcctccggtgtagaaccagccggccagcaggcaaagcacgccgaccagcagcagccaccacgcctgtgacaggacgacggcgacgaggccgcacacgcaggccagcagagcgctcaccacggcggcgacgagcacatgcttcgccggaaccaggccggacgcggtcagccgcatgggcttcttggtcttcttctcactgccaccgcggccctcatcgacaccgcggatgccatcggaatagtcattggcgtagttcaccgcgatctgcagtaacacgcccacgcacacgcacagcagcgtgacgagccagaaccgagacatcatcgcctgcgcatcggcggtgaccgccgcgcattgcgacgtgtcggaccgggtctgcgcgcagttgagatcgcccacgatcaccggatacgcgcagcatgcgcccaccgccacggaggacagggaggtcgtcaaggttttcgggcgtgcgccggatatccacagtttcacagtcatgtagtccagtgtacgtgcctttcacggattccgtggatatgtcgtcatgatcatccgccgacatcagcacgccccgctggcgggggctgtcggcacagcatcgatacataaacaggcggggctccacgcacacacgcgtggagccccgccatatcgtttcaatcggtcatcgcccgcagtccgcacgcaaggccggcagcggcccgccgcacgtttactgcaacgccagcggcttgaccagagggaaggtgatggtctcgcggatcgtggcaccggtcagggcgatgagcagtcggtcgatgcccatgcccatgccgcccgccgggggcatgcccacgccgagggcctccaagaagtcctcgtcgatgtcgcaggcctcctcgtcgccggccagcgcgtccttggcctgggccacgaaacgctcgcgctgcacgatcgggtcgttgagctcggagtagccggtggccagctcgaagccgcgcacgtagaggtcccacttctccaccacgccggccttgttgcggtggcccttgaccagcggggaggtctcgaccgggaagtcgcgcacgaaggtcggctcgtatagcttgtcctcgtagaagtgctcccacaggtgctcgacgagcttgccgtggttctcaacgtcgtcacgctccacgccgagcttgtcggcgatctcgcccagatgctccacggaagtgccggggttgtccggcccgccgttcggcacgatctcttcgccgagcgcctcggagagcgaatcatacatgctgatggtcttccagttgccgccgaaatcgtattcggtgccgtcgagcagcgtgaccttatgggagccgaacacgtccatcgcggtcttctgcacgagctccttgaccagctgaccgatggtgtcgtaggtgccgtacgcctggtaggcctcgaccatcgtgaactcgggggcgtgcgtggcgtcgacgccctcgttgcggaagtcgcggttgatctcgaacacgcggtcgatgccgcccacgaggcagcgcttgaggaacagttccggcgcgatgcgcagataaaggtccaggtcgaaggcgttcatgtgcgtggtgaacggacgggcggcggcaccgccgtggatagtctgcagcatcggcgtctcgacctcgatgaagtcgtggtcatcgaacgtgcggcgcagcgaggcgacggccttggaccggttgcgcaccatgttgcgcaccttctcatcggcgatcatgccgatgtacggcttgcgcgtgcgcgtgtcgtcgttcaggtccttgtgcagggcgggcagcggctgcagcgccttggacgcgatggcccattcggtggcgaacaccgacagctcgccggtcttggacgcgatcacgcggccgcgcaggtacaggtggtcgccgaggtccacgagctgcttgaactgcttgagcgagtcagcgccgatctccttcttggagatcatgccctggatcttcgtgccgtcgccggccgacagctgcacgaagcacaggccgccgccgttgcgcagaaacaggacgcgcccggcgatgccgaccacgtcctcggtctcctgaccggcttcaagcttgccgtcatacttggcgcgcacggcctcgatggtgtcggtcacgtcgaggtgcaccgggtagggctgcatgccggcctcaagcatcatcgcgcgcttggcgacgcgcatctgcacctgctcggggtgcgcgagcgggccgaactccttgttggagggatcgacggcctcgtccaaagttgcgccggcgccgatgcggtcgcggatggctgcgtcctgtcgcagcagcatctcggcacgttcgaccgtggtcatgacgggaacagcgggcgccgtctcgtcgtcgttcagggattcgggggtttcttgcgtctgactcataatgtcacagtgtaatgagatggcgatacacgccgagagtccgttgatattccgcggttttcaggatgccacgccacgccggtttggcttgtccgggatttcgttgtattatagcctgcgttgccaaaacgggctgtagcgcagcttggtagcgcgcttcgttcgggacgaagaggccgcgggttcaaatcccgccagcccgacaacatgaaggccagatcgcatcagcggtctggccttcttcttactggtggcttggcagctcccgcagtttcacactgcgggaccaccacaaccatcagcgacaatcacaacaaacgacacccacgcgcgggcacgcccgcgagatgtgatgaagagggaaccatgaagaaaagcctgcttgccttggcttccggcgcgttcatcctcggcgcggccgaattcgtgatgatgggcatcctgccccagaccgccgaggcgatgcacgtcgatatcccgaccgccggccatttcatttccgcctatgcgatcggcgtgtgcatcggcacgctgatcctggtgttcgggcgcaagatcccgccgaagcagctgatcatcatgttcatggtgatcgccttcgtcggcaacgtcctgtcggcgttctccgtcaatgcgcccatgctgctggctgcccgtttcatctcgggactgcctcacggcgcgttcttcggcactgccacgctgatcgccaagaccgtggccgacaagggcaaggaggcgcaggccgtctccgccatggtcaccggtcagaccgtcgccaacatgatcggcgtgccggccggcacgctgatgtcggagttcctgtcatggaggcttgcgttcatcgtgctcagcgcctgggccgcgatgaccgtgttcctcgcgcttgcctgggttcccgccatcgcgccggtgaaggacgtcggtctggccggccagttcaggttcctccgaaagcctggaccgtggctgattctgggcgcggtgttcaccggcaacgccggcgtgttctgctggtggagctacgtgtcgccgtggctgcagaagaccggcggatacgacagcgacatggtgccgttcctgatgatgctcgccggattcggcatggtggtcggcggcatcatcggcgggcgtatcaccgacaactggcgtcacgcgggaaccgcagccctcgggcaggcgatctccggcgtcggtctgctgctggtgttcctggtgcccggcaaccatgtgagcgccgccatcttcacgttctggatcgcgttcggcctgttcttcatctccgccccacagcagctgctgatgaccgaatccggcaagggcggcggcgagctgctggccggcgcggccgtgcaggtggcgttcaacttcggcaacgcggtcggctcgatggtcggcggcggcatgctgaacttgtcaggcatgaactaccacttcaccgcattgggcggcgtgccgttggcggtcatcgcggtggcgctgctgaccatatactccatgcgtcacgagacgcacaccgacgcgctggagcgtatgcgcgagatcacggtgtgagtttcgcgggatatagctctcaaaactcgcagatacaagtggaatttcgctgaatcaccggtatatctgcgagttttgagagcggggtttgttatataactcacatcacacgccgaaaacgtcatcaccaaggcttcctagactggtagaaaccggtttcatggcaaggagatgacatgaacgatgatgcactgatggcgaagctgatggccgcgttcgacgatgacgcggcaccggaccaagccggggacgagccccgaccttccgagcagccttttgacacgcaacggttcctcgccgggctcgacgcgatcttcgacgcgcacgccgctgccaaggcagggccgtacctggagcaggccatgatcgacgcggagaacgccggcgatgacgccgggctgctcaccgtgctgaacgagacgatggggttctaccgctcgcaaggccgacacaaggagaaccagtggatcgtgcaacgggcgctggagctcgcgacccgtatgggcatcacgggcaccgaggcatggacgaccaccctgatcaatgcggccaccgccatgcgggcggccggccagtacgaccagtccgaggatctgtacaagcaggcgcaggcgtccagcgagcgcacgctcgcccccagcgaccggcgactcgccgccctgcacaacaacctgtcgatgctgtacagcgagaccgggaaaacgcatcaggccgaggtggagctgggcgaagccctgcgcatactggaatcgtcgagcccggatgccgaaaccgacctcgacgtggcctcgacgcacacgaatctggcgttgacgctgctcgccgaagacaagctgtccgccgcgagctggcatgcggcgaaggcgttggagatctaccgcaacggtcatcttgagcacagcgcccattacgcttcggcgctggccggctacgcgcaggtgcgtttccaccagcatgattacgggcaggcggtgaacctgtactgccaggccctgcaggtcatcgaggaatgctacggcaaggacactgattattaccgcatcaccgagaacaacctgcggcaggccgaacacgaggcctccgagcatgcccccgcgaatgtttcacaggatgtttcacaggatgcgagcgcaggtgggaatggttccggcacgcccggcgcagcacccgccggcaccccatccgccgccgttccgtccgctaccgcctcacacaccggcacctcacccatatgcggcctcaagctggcacgcgaatgctggaacgcctatggcaaaccactcatcgccgacaaatacccggaatatcaggggcgcatcgcggcgggactggtgggccacggatcggaatgctacgggttcgatgacgatctctcgcgcgaccatgatttcggcccacgcttctgtctatggctcaccgacgaggattatgcggcgatcggcgagcgccttcaggccgattacgaggcgctcccccaatcgttcatgggatacggcccgcgcgagtccaccgccagggctcagggtgcaggcaggcgcgacggagtgttccgcatcggcgatttcttcgagtcgatcaccggataccgtcaggcgccaagcaccaacaacccgcacgagtggctgatgctggatgaggcgacgcttgccgccgccaccaacggcgaggtgttcgccgacccgttgggcaagttcctcgacacccggcaggggttcaagaccatgccggaggacgtgcggctggcgctgatatccaagcgtctgggcatgatggcgcaggccgggcaatacaatgtgccgcgcatgctcgcgcgcggcgacggtgcggccgcctggctgtcgatcggcgagttcgtgcaggcggcggcatcactggtgttcctgctcaacaatccgatcaccgtgggatacctgccgtattacaagtggcggttcgccgcgcttcggcggctgtcgtcccgcatggcgacgaggctcgccgatgtgtgcgggcagctggagacgctgctgcggctgagctccgccgcctgctatggcggtgccggtttcggcgagggcggcaaggggtcggcaccggtcgccgagaagatatcccagaccatcgagcacgtctgcgccgaggtcgtggccgagctgcgccgagaaggactaaccggcagcgacgagacgttcctggagtggcaacggccatatgtcgaggagcacatcgccagcgacgcggcttgtctgcattccctgtgacagggcgtgaccggcacgggagatgacggcggcaacgacgataacggacaacgggaaagagacggcggatgagcgaccagctgatcgagcggatagtgcgtcatgaatgggatcagttccagcgcacgaacaacgagggcgggcgggccgcctgccaaggcaattggccggtgttccggcagatgcgcacgagccagttcatgacatggcccgatccgctgctggacagttatctggccgatctggtcgaagccgagcgcgtcgggcgcaatctggtcacggagaagtacggtcgcatgatggagtccacggcaccgcaggatttccatgacaacatcgaaccgtacataccccggttgagcgacgaacgtatcgcgacgcaggagcatgtcatcgcgacgcaggtggcgtgggccgaggacttccgcgcccgctacccgaaactcggccgggccatgcgcgtgctgcgcaccgcggaggacaccgcgcaatccacgtcgttcgaaacatatctgcgcggggagctcggcacctactcggaacgcacgatggccctgtaccggcgtttcgtcgacgatctactccggaagggtcggaacctgaccgaggagacgatcgcccacaccgtcgccctcgcaggtttcgccgatctcgccgaagcggaggccgcacagggctgacgcgggaatcggtgccttgccggcagggcaccggcaaggcaccgatcgatatgtcactcgtcatggggcgttcgtgcgttgcgcgctatctttgccagagaccagatgatggcgatcaggatcagtgccccgccgaccaccgcgcacccgatggcgaacatcacgcggggatccatatcgaaccatgcgagcacgccattggggaacctcactccgaacaggatcgccaccgcgccgaccagcagcatgaacacacccaatgtcagtgtggcggcgctcggccctgtcttgcggatgaccggacgcatcggcacgtcccgcggcacttgcacgtaatttgagcccgcgcccggctgggcccagggaccggccggagcggcgtatgcaggacccgcatccgggcggttcggtccgtatccgtcatgctctcgcgggggctgcgtgctgtacagcggaatctgctgaggtgccggaccgggctgctctgtatcacccgcggcgaaggccgtggcggcatcaggctgttgcgtggcgcccgcgcctgtggatggcgcggcggcaagaggctgccctttgtcaggaacatcgccggccgttgtggctccggccggaacatcgccggttcgctgatcggaagcggcggcgggactcccgaatgcgtcggcggcaggctcggtctcggtctggccgtcatccacgggggccgccgattcgtccgaaaccgccccggccgcaagtggttcggcagacaacttctcggtcgacgcggagtcaaccggcaacgacttggtctcggtctgcggcaccgcgaccttttctaccggcatcgcctctgtctcggcaaccggcagcgtctgtgtcggctcgaccggcaacgcctgtgtgacggcagaagcctgttcggacacgccgtcgaccagtgtcggcaaagcctcggtctgctcgaaatccgcaggcatcgcctcggcattcggaagatgccgtgtcatatcgtgatcgtcattcatgatgtgctccttgtatcattcgcccgcagtgctcacagggcgtcatcggatgagcatccgccgctgtcatcgacataacggacggccactttcccctcgatggtgtacggcacgttgatgatcagttcgggcccgccttcgggaatggtgctgtaatcgaggttggatgcgccgccgtcgcacgccggcttctcaccggaacggcccgagaacgtgttgtccagacgcaggaaatcgtatccccactggtttctggtgatcgtataccggcctccgatagaaccgacgagccgatacccgtcgctgcgcttgccgaacgcaaagctgcatccttgcggcaaagtcagaatcacccgggcccgataggccgagatgcgcaggtccccgaccggacacgtcgattgcctgacctttccgtcgacatccgtcaccttgtgggggctgatgccgggcacgccatctcgcgtcagatcaatgctgacgcggtcgtcgccgtaattcgtgccgacgaaccgcacgccctgttgcaatcgggcgatctgctgatcggtggcgccatatttcgtgactccgcgaacattgaccagcgtgccgccttcggactgcatggcatccaccgtatagctgtaagcgacgttgacgcccagtacgcagaccgcgacgaacgcggcggtccaggcgagcggaatcaggcctccggagcggcgtcccatcaggccaagcaccgttatgacagcacccagagccaggcagacgccgccaatccacagcgtgagcacacgggtcatcgattcgatggatgagttgtcgtttgccagcatcagaaccgcaccggagacgagcatcagcccgatcatgccgatgacgatggcgaaaccggccggcttgcggcgctcgtatttcggtggaagaggccccgccgatgggcgatacggagacgactggtacggcatgggaggacgtgcgggccgatcggcggtatggggctggccgaagccgtatcccggagcgggctgctggaacggctgacgcaccgacgctacggaggactccgctgcacttcccgcggtttccggcgcggtgggccctgatgagccagccgtgccggcatcggccgcctgctctcccgtgtccgcaccgtcataggcgtatgacgaggccggccatccgcgccggtatgagccgttctcagaatcgccggtaccgctggcatcgctgacgccgctgcccgacccgtatccgccatgccgccggttggcgttctgcaccagggcccacagcaccagcgccgcgcacagggccgccgcgagaccggcaccggggacggcgaccgccagcatcatcatgattatcacgccaagcatgttccaatcccagcgcccgtcgatcagctcctcgccgaggatacggccatcccgcgcatcgggcagcagcgcccatgcgatggcgtacagcgccaaaccgaatccgcatagcaccacgctcgccagcaccagtgcccgcaccagagtcgggctccatcccacgcgctgcgcgatggcgctgcacacgccggcgatccaccggtcgtcgccgcgctccatcgcgctgccgcggatccacgagaagaaccggtcgctctgccgcttcggcttcggctggggtccgggcgcaggagaaccgtacggatttgaaccgtacgaatccgaaccattcgtgccggggccggcggcgccacccgcgtcataggcatacgttgtatcgttcatgcttccattacagcagcaaccggccgccgcacgcatcgggggacaccctgattgttccctgaaccggggcgttatgccccatgtcgtcttccccggaggcgcacaatggaaccatgacccagccgaacaacccgtaccggcagccgcacgcgccccgtcggacgcaatggcaggcccgccgcgcccaaccgccgtccgccacgccgagcctaccattgatgcgcccgcggaacgggcgcgtcctcgtcggcgtgtgccgtggcgtgagcctacatctgggagcgcccgtatggctggtgcgactcgcgttcgccgcggccgctctcgcgttcggggccggcgtcatcgcatacgtgttcctgtggatgttcatgccggtcggcgatcccgtcgccgccgcgcaggccatgtcggatgcggcctcgacaggtttcgccgagccgctctcccgcggtaatgcggcatacgccggcaccgcgggtgacagtggacgcagcgacgccgacgactcctcggagggactggcggcggctctgcgccgcgccccgaaaccttcactggtggcattggccggtctggtgttcatcgccataagcgtgctgctgtcgtttgccggcggacgggagctgatcgtgccgctggccgtcgccgtcggcggcctcggactggcatggtcgcggttcgacgcggacgagggcaaactgccatcgatgcttggcggcatcgtgcttctgttcgtcggctatgcgatcttcgtgttcaccagcacggttccggggtggggcgcgtcccctcgccgcatcatcatcggcgggttcgtactgctggccggcacggctctggcgatcgtgccttgggtgagcacgctcatccgctccctatccaccgagcgcgcactcaaggagcgtgaagaggaacgtgccgacatgaccgcgcacctgcacgatggcgtgctgcagacgctcgccctgatccagctgcacagcgacgacccgcagaccgtgttctcgctcgcccggcagcaggagcgcgaactgcgcgaatggctgtatcaggaacgcaccacatcggaccgttcggtcagcgccgggctgaaggccatcgccgcgcagacggaagacgagcacggcaaaccgatcgaagtggtgaccgtgggcgacgcgaggcccagtgcccagaccgacgcgctgctcgatgccacgcagcaggcgctcatcaacgccgtgacgcatggcggcgagcccatctccgtgtattgcgaggccggcgccgacaaggttgaggtcttcgtgcgcgatcatggcgatgggttcgacgtgaacgcgattcccgagggccggctcggcatccgcgagtcgatcatcgggcggatccgacgacggggcggtacagtggagatcgtatcgaggccgcattggggcaccgaggtgcgcatgcacatgccgatctcaggcggacggcaaccgaaccagcggggcgatgccacgaacgccggcgggcagcatggacgaccgccatccggcgcggcatcatacacacgcacgcagaaggaaacatgattcgacaggtgaagcatatgggtcaggcagacagcacaagcatcggaccgacatcaggagcggatgtgaggcaaggggcggccggtgagttcggcagcgtggagtgcaacgacgtggagtccggcagagccactgatacggataccactccccgcgaagctgcggcgacgccgattcgcgtggccgtcgtcgacgaccatgagatgttccgcgccggtgtcatcgccacgctgcagccgtacttccacatcgtcgggcaggccgccgacgtggaaggctcgatcgcgatgatcgccgacatcagaccggacgtggtgctgctcgacgtgcacgtacccggcggcgagggaggaggaggcgcggagatcctcgccaaatcgcagccgctctcccccgcttccgcgttcctggcgctgtcggtgtcggattcgccgcaggacgtcggctcggtgattcgtgccggcgcacgcggatacgttaccaaaaccatcaccggcgacgatctgatctcatccatcaagcaggtgcacgaagggtatgcggtgttctcgccgaaactggccggattcgtgctgtccgccttccagggggcaccgatggacggggccggcggcgcacggggccgcgacgaggagctggacctgctgtcaggccgcgagcaggaggtcatgcgcctgatcgcccgcggatacacatacaaggaggtcgccgccgaattgttcatctccatcaagaccgtggagacccacatgtcaaacgtgctgcgcaaattgcagctgtccaaccgcactgaactgacccgctgggcagccgaccgccgcatcgtatgaggcaaggcacgaccggcgcggcgacattcccatgccgacggtgaaacggacgccacccacgtagagcgttcttcatacactggtaacgaacacaaccctatcctcgtcggaaggaaacagcatgaccgctgaagcaaacgtcggtgtcgtcggactggccgcaatgggagcgagcctcgcccgcaatctcgcccgtcacggcaacaaggtggcggtgttcaaccgtcactattcgcgtaccgagaaactcatcaccgagcatggcagcgagggcgagttcttccccgcgaagacgatggaggaattcgtggcgtcgctgaagaagccgcgcaccgcgatcatcatggtcaaggcgggcgagccgaccgacgcgatgatcgaccagctggccgatctgatggagccgggcgacatcatcgtcgacgccggcaacgcgcacttccccgatacgatccgccgcgagaaggcgatcagcgcccgcggactgcacttcgtcggctgcggcgtgtccggcggcgaggaaggcgccctgctcggaccctcgatgatgcccggcggcagcgaggagtcctggaagacgctcaagccgatcttcgagtccatcgcggcgaaggccgagggtgagccgtgcgtgacgcatatcggcgagaacggcgctggccatttcgtgaagatggtgcacaacggcatcgaatactccgacatgcagctcatctccgagagctacgacctgatgcgtcgcgcgctcggtatgacgccggccgagatcggcgacgtgttcgaggagtggaacaagaccgagctggagtcctacctgatcgagatcaccgccgacgtgctgcatcaagtcgacaagaagaccggcaagccgctggtcgacgtgatcgtggatcacgcgggcatgaagggcaccggcacgtggaccgtgcagtcggcgcttgatctggccgtgccggtgaccggtatcgccgaggccgtgttcgcgcgaggactgtccgggcaggccgagcttcgcgccgaagcccagaagcaggacttcgagggaccgtccggcgtggtgccgatggccgaggaagacaaggtcgcgttcatcaatgacatccgcgaggcgctgtacgcttcgaagatcgtcgcgtacgcccagggcttcaacgagatcaccgaagccgccaaggtgtatgactggaagatcgatctggctgcggtggcgcgcatctggcgcggtggctgcatcatccgtgcaaagttcctgaaccgcatctccgacgcgttcgagaacggcgaagccaacgtgtctctgctgttcgccccgtacttcaaggacgcgatcgagaccgccgagcgctcgtggcgacgcgtggtctcccgtgcgattacattcggcatcccggtgccggtgttcgcctcctcgctggagtacttcgacggcctgcgctccccgcgcctgcccgccgccctgatccagggccagcgcgactacttcggcgcccacacctaccagcgcaccgacatgcccggtgctttccacacgttgtgggctgagcctggccgtgaggaaatcattgcgtgatttccggtgacagccgcgaggagacaccgagcctcgcgaagcgagaccacaatcgtaggggccgaaggcgagcctggtcataagcaaacaccgagcctcaccacaagcccctccctaccgctcgcagatcgaacgcgaaccatacgaatgatggcgcaggctcccctaggggcgtctgcgccatcgtgtttcatcggcacaccattcatatcgtgtggttcccatttttcacacaacgtttttcgcgcacagtaatcgcaaccagccgcatcccaacatcaccaatcaacgcccagtcaccgccggcggtgcatatcctcctgtacaacgcgcacattgtaggcaaacgcagcagttgtacatacaccgtcccgagagacctcgcacgccattcctcatttcgttggaattccaacgttttcaggaacttcgtcggtgtacaacagtgggcgcaatcgttttcaacggctgttgtacagattccgccccgtacaacgcgcgcattatgccatttcgcgggagttgtacacgcatcggcgtcgcaaccctgcgcgcttcttgcgctgcatcccattcgcatgccggaccgcaccgggcacgcaatgagccctcgggcggagtgaacgaaattcgcaatacgaccggatcgtccagtatgatcgtcggaccgcatcgccatgattgacagaccggcctcaatcccatgccatgatgaacaccaatcagatcttatttcacgacgggagacgcggcacgaaacggcaaaaccatgcatctttgccgcttcgtgccacggaatcctcgaattgtctcgttatccgaaataacaagcttcaaataccgaactatccgatagccgagacaaacctcacagcttgctggcggcgtcctggtcgatgtaccagatgagttcctcgccgtcggcgaaggagctcggggcctgcggattgcgcggctgggcgaaggcggcggcgaccgcatccgccttgcgctccccggacgcgaacacccacgtgcgccgcgaacgggcgatcatgggaacggtgagcgtcacgcgcagcggcggcggcttcggcgaatcgcgcacgccggcgaccagcacatgcgggtcgtcgatcagcacttcaggccggccgggaaacagcgacgcgaaatgcgcatccgggccgacgccgaacaacgcgatgtccagcgtgggctcctcccccagctgctcgatcagctccttttggtaggcggcggccgcatcggccagcaccgcatcgttctcctcgtcggtggctgcggcgatccgtgcggcatcgcgcgtgtcagcgggcatctcgtggatgttctcctccggcatcagcccgcgctccaccaggatgttcaggaaccgccgcgcctgcttggcgttgcggtcgtcgctgtcctcgggcacgaaccgctcgtcgccccaccagatgtgcacgcgcgaggcgtccagatcatcggccagcgggtcggtgccgatcgcgcgcagcacgcgattgccgtcggtcccgccggtcagcgctatatccacgcggctgcgccccggttcggcgagcaggttcctgatcgtggtcagcacgcgcacggccacagcctgcgccagaacatcggggttcgggcatgttacggtttttctttgcgacatcagttacagctcctttgtcgttctgattcggtcttcgcgcgtccgaaacccgcgcccgggcatgggccgcgtgacggttccgtgacgctcacgcatcgccgttcattcgttgattcaccgcttgtcgtcggaccggcgccttgcagccggtccgacagtgcttattcggcaggatgaatcagattccatccctgggtgatgacttcagcatacacttcatccgggtcgagccgacgcagctcttcgctcaggcattcctcaagcgtcctcgtgggcacgctgatggattgcggcgactgaccaggcgtgctgatgacggcgatgccctccttcgcgtccggccgctccagactgagcgtcccgtccgcgcgcgtcaggtatacgccggtcacggcggccgcgccgggcacctcctccatgatgacgggcacgttgagcttcagccgcagccaggccgccagcaaatccatgggcaggaagtccttcggaccggagaccttcaccgtgctgatcggcaggtgcggcggctggtcgagcatggtggcgagcatcgcacgccacaccgtcagacgcgtccatgccatgtccacgttcttcggcgaccagttgcggcgcagatcctcgatggtgcggtaggggttcgacgagtgcatggcgtcggtgatgcgactcctcgccatcgcgccgagcaggtccttggacgggttggccggcgcctcgttcggccaccacgccacgaccggcgcgtcgggcacgagcagtgggatgaccaacgtgtcgggatgatggaccagcccaccacgcgggtgcagcacgatgatctcacccgcaccggcgtccgcgccgaagcgcacctgggcgtccagattggaattgtcgtacgccgcatccgcgtcctcggcgggcttgggcgcaccctcgacaggcttgcgcacgccatttccacgccgcggggagatggcgatgacacggcacgggtgctcgcggctggcggcgttggccagttccagcgcctgctccagctcgtcctcggtggtggagatcagcagcgtcagcacgcggccggtcgccgactcgccgcgctcctcgtgcaactcgtcgatcttctgcgatatctcgcgggtgcgggtgttcggcatttcgataatcatggcatcctccagtggcgtccgtcgcgtgcgagcatttcatcggcctccgtcggcccccatgtgccggcacgatacggctgcggctgaccgagcgtggaccagaattcctcgatcgggtcgaggatcttccacgacaggttgacctcttcggtggtcgggaacagcggtgggtcgccgagcagcacgtcgagaatcagtcgctcgtatgcctccggcgagctctccgtgaacgaacggccgtagctgaagtccatcgagacgtcacgtacctccatcgccgtgccgccaggcaccttggagccaaagcggatcgtcacgccctcgtcgggctgtacgcggatcacgatcgcgttcttgccgagctcgcgtgtcgcggtcgactcgaacggcaggtgcggcgcgcgtttgaacacgacggcgatctcggtgacacgcttgccgagacgcttgccggtacgaagatagaacggcacaccggcccagcggcgggtgtcgatgtcaagccggatcgccgcataggtctcggtggtagacgccgggtcaatgcccttctcctccaggtatccgacgacgtcatgcgagccctgccagccggcggcgtactgtccgcgagcggtgtgtgcggcgaggtccttcggcagacgcaccgcggagaggatcttcgtcttctcggcggtcaggtcggaggcggtgaacgagaccggctcctccatggcggtcagggccagcagctgcagcagatgattctggatgatgtcgcgggctgcgccgatgccgtcatagtatccggcgcggccggccacgccgatgtcctcggccatcgtgatctgcacgtggtcgacgtagttggcgttccagatcggctcgtacatcgcgttggcgaaacgcagcgccagcatgttctgcacggtttccttgccgagataatggtcgatgcggaacacgctcgacgggtcgaacacctcggagaccacacggtcgagctccttggcgctggccagatcgtggccgaacggcttctcgatgatcacgcgtcgccatgcgccctcggacgagcgggccagtccgcagtcggcgagctgacgcgccaccacggggaacgcccgcggcggcaccgacatgtagaaggcatggttgccgcgcgtgccccggtcgcggtccagttcagcgaccgtgtcgctcaaccgcgcgaacgccgcggagtcatcgaacgtcccctgcacgaaacggatgccctttgcgagctgcttccacgtcgattcgcggaacggggtgcggcaatgctgctgcacgtgctcgcggacgaaatccctgaaatggtcttcggtccagtcgcggcgtgcgaagccggtcagtccgaagctcggcggcaacaggccgcggttggcgaggtcatagatcgcgggcagcagtttcttgcgcgacaaatcgccggtcacgccgaagatcacgatgctgcacgggcctgcgatgcgcggcaggcgcaaatcgcgcggatcgcgcagtggattggtccacgcggttggcgtggcggaaacggaatcagtcatacgcaccatagtagtgatgcgcgtgcatctcatggcccattcctctcagaaagaaccatgcaatgcatcatatcgcgggattctggcgcggcgagaaccgctccgggaccaccccagtcgctacgcgacagtcctccgggccctgcaatcaaggacggccttgcagccgcatctctctgatgcgcctgccggctcatactcgcctatagacagcccaccgggctgtctactgtacggctcgtcccgccagcgggggcgaaagctggcgtcagagcgtgggctggtccgtctccccgctctgctcgccggtctcgccctcatcctcccgcagtccggattcgagtctccggttgtgttcgcggagcctgtcgttctccgcggtcagctcgtggatgtaccggatctgctgcgctatgagcatatcgcgcaggtccttggccgccgatccgccgaaattctcgcggatcgtggccgcgcgaatcggcgccggcggaatcagcggattgccggtacgcgggaatttgtcagcggatatcggctcggcgtcgtcatcagccggttccatcatcttccaacgcgcgatgcaccgttcgatgcgcttgtatccgataagcgacgggtcaagcccgacgtcgcggaatatacccgtcggcgagtcccccgcacgataccgctgcatgcagtattcgcggaactggtcggtgtatcggatgcggttccgtccgacgctgttcacggcaggcagtgaacgcaggtagtcaatctcgtcgtcgtcaaactctctgtctttcatgatggtgccctccagcactcttctcatcgatagagacgaacatgaaacggaggttcgccgggattcactgcactgtcttccccgcagtatcctccgaatcgggacgcccgccctgcctcgtgaaaggcaggcggatggccgagtcagccgccgatatacgattcgcggcgtgcacgggtcatcatcggcgacgtgcctggcagccgtgtctcgcccaaaacagtcgcgacggatgtcaccgcggcgtaggtctccgacttcacagggacttccgagggttcgggggtgttcggcgcgtcgggggtggaggttttcagcacgggcttggcatcggccatggaatcgatcatgtgaccatcgacttcgccggtcaggatgacgtcgacgccattggcgatgtcaagcgttgcggccagagcgatgttggcggccggagcggcggatccggccttggcggcggtcagcggggcctcatcacccacgcgcatgactggggattgcgccttgtgcaccgcgtttgcggcggcggcatcgcctgtatatttgctggatgatattgataatcgttgcctgaacctgacgacgaaacgtcgattttcccgaaacatgatacatccttcacttcttgcttcgggagggttcatcctacgcaaaaagcgcaaaacaagccccccccccccgtgatttcgaagtgtagcgccggcgggaaaatatttgggggactatgtttctaaggggttatgacggggagttacgggggtgtctttggcggcgcgatatggtcatgcaggagaccatgtgtgcgcgagcacgtcggtatggccggtcaccccatacaggtgcccggccataccgcagccggtcaccggcgacgggagcgcgccgtcgtgatggagaatcccgcggcaagcatgatgcacgccgtcactgcgagcagcagcgtctgggcgcccgtcttcgagagggtctccgtgcccgccgtgccaggtttggaggtatcggcgttgccgccggcgccgggcttgacgccaccgggacgctcggtctgcccgccgctgccaggctgctcgggatcctcgccacctcctggttcctcaccgccgccgggctgcttgcgctccagcccgtcgcgagcctgagtcagggcctttacggccttgtccagatcgccctgcgtggtggatcgccgtccgcactcctcctgcgcggcggccaacgcctcggcgaacgccttccacgattcggcagtgtaatcgccttccctgagagcctgagccgacacgatggcgtcggacaacgggccacggtccagacgcgcgtcggacagcgcggcgatggcatcattcagccgtgccgcaagggcgtccacgtcggactgggagatgtgcgccatgtcggtggctacggcggcggcaagagcctcgcgcatcgtcgcccacgcagccctgtcgtactgcgattcgaccagaccggtcgccgcccgcttcgccgcatccaacgcggccgcatcgatgtgcacgattgactcgttgaacgcggtcgtcgcctggcgcagcgcgtccgccgcggcgtccaccttatcggcgtctccggcggccgcaccgtgtgcggccttggcgtcgtcgatggcctggcgcagagcgtccgcggcgctttgcggatgctgcccctcgtattcgccgacgctgcccgccgtctgcgcgtcctccagcgtcttgaccgccgcatccagcacgacctgatagcgctcctgcgcgtcaagctgcgcgagcgccgtgtcggccgaccgccgcaacgcagccgcggcgttatcgagatcctgttgtgtcaccgtgccgtaggcgtcggagacctgcttggcgcttgccctcgcctcggccaatgcggccgacgacgcgggcaggccatgcgcgtccagagacgcgatcagcgtcgcggcgtcatcgatcgccacatacagcgcgttgcggtcgagcgacacgtagccggtgcggtagaactcggacaccgcgtcttcgacggtcgtcgtccaccggccggcctcgcgcgaggtcagtccggcgtccagcgccgcccgcgcctgctccagcacgacttcgagcttggtcttcgccgcccgggtgacgttgccggcgtattcgccgacggtgagcttgccgagcacggtctcgacggacgagaggtagctttccagagacgcccctgcatccgcctgatacaggtacaactcgttgatggcgacggggttctcgttgagcacggtgatgcgtaccgcgtcggtgtagacgggccgtgcaaggcgggccacgatctccggcttcatctgcgcattgccggaatagtcggtcagcgtcttccactggtcggctgcaccatcgcccgcaccgtcgccgtcctgcggcaccacgcggtattcggccttgaaccgcaccggctcgctgttaccggaggccagcaggccgagcatgttgatgtccgcggccttcgcgagcgtgaatgtcagggtcttgtcagccgtggccgtcaaggtggccgcgctgtcgcggtctccgtccgtcagcttggcgaggtcggcggccgtgagcgtcgagccgtccgaggccgtcgtcttggcgtcgcgagccacgttgccgggcgtcgcgtagacctcgatctcggacaccagcggccatgcgggcgagccgctggaggggatgcgggcgtcggcgatgtccatgcggatgcgtgtgatgctcatgccgaccggcacgtccatcacgatgccctgctgtttgctcaggtcggcttcggttcgttcggcgaccgtatgttcgtcgccgttcgcgtcgatcaccttcaacgtgaactgcatgctgcggtcgggctggccttcctcgaacttgagccgtatgctgtcgacctcacgggccttggcgtagtcgagctggaaccatgccggcgtggcgccgtcgcgggacacccatgcggtcgccttgccgtccaccagcgcgcctgcgttctcgggcgcgtccttggtgggcgacgacgtgatggcggccgaggtggcgatgttcacgctttcgatggtgtcgccggcctcctgcagcagttcgagttcggcgagcgccggccatgcggtgccgccgaccgaccccgtgaactccacggtgacgtgttcgacctcctcgccaagattcgccgcatacacctgatcgagggcgccctggttctgcgtctcgtcgatcagtgtccgctcggtaccgtcagcgagccccgcgacgaccctgaactggaacaggcggccggccgtctcgaacacgagccgcacgcggtccacacgctgcgccgacgccaggtcgatccgataccagttcgggtcggacccgttgccgacccacagcgtaccgtcgtcgccgtcgttgccgttcgacgcgggccgctcgctggggccggcgcttgcggcgccgctgagcgccaggttcgtgtactcgggctgcggttgcgcggctccccagacggacagctcgtagatgccggtcaggtcccgcccgttcgtcgaatgcaacttccaacgcaccttggagccgagtatgtcggcggcgacctcgttcttggagctgacggcatcggcttcgctgcggcctatctcgacccatcccgagccgttccagacctcgatctcgtagcgcagcgggaagtcggccgcgatctgctgcagggtgatgccggcgccggtgatcgaatacgtgccgtcgaggtcgaccaccagcgtggcgtcggtcttgcccgtctgcgtccagccggtgtcggtgttgccgtcggtcacgtccgggacgacggtgccggtgtcctcgtcggtcacgtcatgtcccagcgccaggttcgtgcgttcgaccgcggtgccaccgtcggtgacgtcgtccatcgcggtgaccgaatactggtcgaggatgatcttgccgagcgctttctggtcgacgtcatccgcggcttcggtcgcgaaaccatacccgtcctcgtcgcttttgcggttcgcccactgccagccgtagtcgaaccagtccgggtcggtgaagtcggtgccgtgctccagtttgttcagccggttgtccatgtacgtcttccaccgccgatagtagtagtcgccggtcagcccggcccactggcggttggaatagtcgatgagcgagccgttcttgttcagaccccacgtggtgacgagcgcacgcgcgttgagctcgaacaggtcggcggtccaatcgtccgcgccgtcgagcatcgtgcgggcatcgtcgatccatgcgcccacgaggaagtcgtccgagctggaaagcagcttgtcctgcgccttgatgatgtccagcatccgggacgacagtgtccggaacgtctccagatcgcccgacttgtacgcctgcccggcgagcggctggtattcctggaagctgttggccagcacctgccgcatcacgtcgacgtaatcgtagcggaagccggccgagtccttgtacgagtcatacgcctgctcgaacagggccgcggccttctcgaactgccgcttgtcgtaatctatgtcgctgtggccccacgtggacgccgagccgatgatgttgtcggacgggcgtgcgttgatgatggattcgctcgcaccctgatagtattcgccgtccgtgtgcttgtaggcggtgtcaagcaggatgtcccacgccttctcgatcgtcccgtcggctccgccgtaccggcgctcggcatactcctgcgtccaggagcgatagtcgaccggatcctgctcccaagtcatgtcgaacagcagctcgtagacgatcggcgaattgtcgatggcttcgggcgtgatgccgatgccgcgcatgtaaccgctggagttgtaggctttcgtgatgtcctgggagatcacctccggcactccgtcaaggcccatgcgtccgccgaagttgtgcaacatgttccacacccacggcacgccctggttctccatcgggctggcctgcgagcgcaggtcgctctgcaggtcgagcacgagcgcccggcccttgtccgcgagcccggagagcttcgtctcgtcgatgccccactgccactgctgcatcacccacacggccgccgggtcatggtcgagcatcttgcgctgcacggtgcggtagatgtcgacgatgtcgaagccgtctggaatcgtgccgccctcatggaacggatcgaccgcgtagtagttcgacaccttgccgaacacgttctcctgagctttgtagaacgtgtcgccgaccttctggaagtagtcctccttgccggccgccttgtcggcgtcggtcagatacgtcttgatcatgtacgggcggtcgaaaccggaccatgtgccggacgacgcggccaccgacgtcgggttcttctcctggaagtcggccggcacctgaccgccgaagccctggatgaccggcgtgatgccgtacgcctgcatgcggtcgtggatcctgcggccgagctcgacgcgctgctcgaaccatgcggcgggcagggggcctccgaccgagtacaggttctgcatgtagaaccatgcgtagtatcccggcccggacaggtattcgcgcacctcgtcgtcgctgtagccgtatttggtgagcgtctcgcgcagcacctcctcctgtccgacgatgtcgagcatgaggttcacgccgttcatcgccgcccagtcgaggaacggctcgtaatcatcccagttccagaacgccatcgtgtacgagtaggtgcagaagttgagcgcgtaccggtactcgtagttcgtgtatttgaggattttccggccgactgcaggcaggctctccggcatggacagctgggagccgaacagcgggttgtagtcgaccttgcaccagtggcgcagataataattgaggccggacgcgagcgagacgccgttgttgccgcggatggagatccggtcgtcgccggcgtctgagatttcgaacacgtccttgccgtcggccttgccgcgcagctggaagtcgaacttgtcgaccgaccgctcgccgatcacgcggccgacgaggtttctgacctcggtgacggtcttctcggcggcatagtcggagtcggtctctacgcgggcccactcccggccccacgagcttgagtcgaagtcggtgacggagatggccttggggctggcctgctcgtcggagaccttggtgccgtggaaagcgacttcggcgaggttgacctgctgggcggcggagttgtagctgacgctgatgcgcgcgtatgcggcttcggtggcatcgatgggatgcgtgtcggcggcaccggtcgcgggggcgtcatcgctcttgtaggccaccttgccgtagtcggcgccgtccttggacagatagacctcgtagtggtagtacgatccggcgaggttggtgatgtcgatctgcgagatgctgtatgcgccgtgcaggtcgaagtcgaggaagcggcggtagtcctgcatcgacgagtctgcgggtgactgccagtaggtcgccggatcgccgtcgactgcggcggccgcagcatggccgtccgcggcggcaccgctcgccgtgacgccggcgatcgccggttccacggcgcgcgcgaggcgtccggatgtgatcaggccgcacatgagtgtcgccatggcgataagcagggccgtcgcgcgacgccgccatgatcggtggcaggtcggaggatgttcgggcgagtgcccacgacgatgacgagcggatgaaaccatcattggttgcccttgccttctcttgattttcagtaagaaccgcaccggcgaacattgccggattttgttaacaatatatacaaagaatgggacatggcgcgcccgcgtcacgccgcgcgacgccgctttcaaccgcccctgtaccacacaatgcgatttttggcggtttttgtgctggtgtggtacagcgccgattcaggacaattcgggcgaattcctcagatcattggaaaatggcggttcctgattttttgttcgttgccataccagctcaaaaacgcgtcgaaatcgcattgtgtggcaaacgctgtgccacacaatgcgattttgaccacaaattgacgtggtgtggcacaatccccagatgccggaccgcggatatgccggcaatagacaaaaagggttccaggcgatgcacccggaaccccgatatgcggacagggcgagattcgaactcgcggtggcttgcaccacaacggttttcaagaccgtctctttaggccgctcagacacctgtccttatgtgcgccatgaagcgcacaagattcaattatacatccggcgcggatgttctccgccaccggatgcggtcgacgccgaagcgatcaggcttcccacttggtcggctcgatgacttccttgccgcccatgtaggggcgcatggcctgcggaatctcgatggagccatccttctgctgatgattctccaggatcgcgacgagccagcgcgtggtggccagcgtgccgttgagcgtggagaccgcgcgggtggaaccgtcctcgttgcgctcgcggatgttcaggcggcgggcctggtactcggtgcagttcgaggtggaggtgagctcgcggtagcggccctgggtcgggatccacgcctcggtgtcgaacttgcgagctgcggaggagccgagatcgccggcggcggtgtcgatgacgcggtacggcacctcgaccttggcgagcatctcctcctccatgctcagcaggtgctggtgctccttgtaggagtcctcctgcttggtgtagacgaacatctccaccttgtcgaactggtgcacgcggatgatgccggacgtatccttgcctgcggcgccggcctcgcggcggtagcaggagctccagccgcagtagcgcagcgggccgttggacaggtcgaggatctcgttctcgtgcatgccggcgagcgccacctcggaggtgccgaccaggtactgctcgtcaggctcgcgcagacggtagatctcgtcggcgtgggagttgaggaagccggtgccggccatgacttcgggacgcaccagcgtcggggtgatggcgagcacgaagccgtgcttctcggcctgatcgacggccatggtcagcatggcgatctgcatgcgggcgaccgcgccgcgcaggaagtagaagcgggagccgccgaccttgacgccgcggcgcatgtcgatgccggccacgccggtgccgagggtcaggtggtctttcggctcgaagccttcggccgcgaagtcgcggggctggccgaccttcttgacgacaacgtaatcgtcctcgccgccttccggggcctcgggttcgacgacgttcgacagcttccacatggcggtggtgtattcctcggcggcggcgtccgcggtggccttgtattcggcgaccttggcggacagctccttggtctgcgcgatcagcgcggccttctcgtcggcgggcgcggcggcaaccttcttgccgatctccttctgctgggcgcgggcctcctcgaactccttgagcgcgaagcgacgggtctcgtcggagcgcagcacctcgtcgactagttcgacggattcgccgcgcttgcgctgggattccttgacaatgtcagcatgttcgcgaatgaattgaatatcaagcatgtgcctaacactaccgccgtaagccgacacggacaatacccctcgaccggcccttgaacggcccgccgcacacatcacggctgctccctcccctcggccggcgcggccgttgcatcgccgcatccgactacggagccggagaacagagttccgagcggattcacatgacgttcattgcggctccatgtgccgtctcttcgggcttcctacgctggcgttgcacatcggctcccgtgcgacgaacgttcgcgccctgcgacgcgtcgctcgggaatcttcagcaagaaggagtaccatgcgtatttcaacacgcattcaaagcctgctggtctcagcagcgctgctggtgccgctggtggcgacgccagtcaccgcagcctacgcgcagccgaccgaggaaaagaccgcggcgtcctggtcgggcgtcgtcatcaacgaggcgtatctgtccggcggcagcaagggcgccgcatacaagaacaaattcatcgaactgtacaacaccaccgacaatgacgtgacgctcgacggcacctcgctgcagtaccgtccggcgagcggcacgggcgcgagcaacgccgccgccgacctgaccggcgtcatcaaggccaagggccactatctgatcaaggcgggctcgaacggctccgacggtgccgagctgccgcaagcggacgccaccgccaccagcctcaacgccagcggcaccaaaggcacgctgttcctcgccgccacgacaagcaagctcagcccggccgtcggcgacaccacggcgaacgccgacatcatcgacgcgctcggctacggcgacaccaacacgttcgagaaggcggctgccaccgcgccgacgaacaacaccgacgtgaagtcgctgaaccgcacgaacggcgtggacacaaacgacaacagcgccgacttcacgctgagcgccgacatcacccccgaaggcaccggcgaagaatcccagccgacaccgaaaccagacccgacgcccggcgactgcccgaccggcgaggccgaaatcgcgcagatccagggcaccagcgacaccagcccgtgcgtcggcaagaccgtgaccaccacaggcgtggtgaccgcagcctacccggacggcggattcaacggctacaccatccagacgccggcaaccggaggcgcggtcaacctcgccgagcacaaggcgtccgacggcctgttcgtatacgattcgaagaacgtcaaggatcttcagatcggcgactatgtcaaggtcaacggcacgatcagcgaatactacggcctgaccgagctcaacgcgagctccgtcacgaagctctccgacaaggtcgaggccccgaaggcctccaccgtggcgttcccgaagaccgacaccgagcgcgaaagcctggaaagcatgctgatcgcgccgcagggcgactacaccgtttcggacgtgtacaacacgaacaagtacggcgagatcggactcgcggcatcgaacaagccgttcctcaaccccaccgtcaagggcctcaagggcgacgccgaaaccggtgccgcataccaggccgaactcggccgcatcgaagccgagggcgtgtacctggacgacggctccagccgcaacttcctcgacacgaagtacccggacaacgccgacacgccgctgccgtacctgtcgaacgaccagccggtgcgcgtgggcgagaaggtcacgttcaccaagcccgtcgtgctcgactaccgcaacagcgcgtggcgcttccagccggccgaacgcctgaccggagacaacgccgatgcgcagccggtgacattcaccagcacccgcaccgacacgcccgatctggccgcggtcggaggcgatatcaggctcgccacgttcaacgtgctcaactacttctccaccaccgccgacgagaccggctgctccacgagcaacgcctacaccgaccgtgacggcaacccggtcaccgcgaagaactgcgacgtgcgcggcgcatgggacaaggccaacatggaacgccagcgggcgaagatcgtcaaggccatcaacaacctcggcgccgacgtggtctcgctggaggagatcgagaactctgccaaggccgccagctccgtgccggcatcattcaagggcgagcgccgcgactacgcgctctccacgctggtcgacgcgctcaacgagcaggccggcgaaggcacctgggcctacgtgcccagcccgcagaccgtccccgacctcgacgtggaggacgtgatccgcaccgcgttcatctacaagcccgccaaggtcgcgaccgtcggcgcaacccgaatcctcaccgactccgacgcgttcaacggcaagaacggctacgagcacggccgccagcccgacgcccaggcgttcaaggccaagggcgccgccgactccgacgcgttcctcgtcgtcgccaaccacttcaagtccaagggctcggcgagcaacgcgctcaaccaggatcccggcgacggctccggcaacgccgactacacccgtcaagcgcaagccgacgcgctgctcgcgttcaccgatgaggtgaagagcgatctcaagctggagaaggtcttcctcgtcggcgacttcaacgcctactacgccgaaaaaccgatccagaagatcgtggcggccggatacaccgacctgagcgagcaggtgagcgaaaagaccggcaagtacacctacgcctacaccgtcaaggacgaatccggcaacacgaacggaggggtcggctcgctcgaccacatcttcgccaacgaggctgcgatgcggtccgtgaccggcgcggacatctggaacatcaactccgtcgaatccgtggcgctggaatactcgcgctacaactacaatgcgaagaacctgtaccaggccgatcagttccgcgcctccgaccatgatccggtgatcatcggaatctcggcctccggcacgaccggcggcacggccacgctgaatctgctgaacttcaacgatttccatggccgcatcggcaagaacctgacggtgccgttcgccgctaccatcgagcagctgcgcgccgagcacccggattcgtcgctgctgctggcggccggcgacagcatcggcgcctcgctgttcaattcgtcggcgcagaaggaccagccgaccatcgacgtgctcaacgcgctggggctcaaggcctccgcggtcggcaaccacgagttcgaccaggggtacgacgacctgaccggccgcgtgatcggcaccgacggcaagcgcaacgcgcagtgggattatctcggtgcgaacgtgtacaagaagggcaccggtacgccggcgcttcaggaatacagcatccagaacgtcaatggcgtgcgggtcggtgtgatcggcgtggtcacgcaggagacctccacgctcgtctcccccggcggcatcaaaggcatcgagttcggcgacccggtcgaggccgtgaaccgcgtggcccgtcagctcaccgacggcgacgagtcgaacggcgaggccgacgtgatcgtggccgaataccacgagggcgccgcctccaacgaggatgacgccaccgccaagccgaccatcgacgagcagaaggccgccagcccggtgttcaagaagatcgtcgacgacaccgacccggcggtcgacgtgatcttcaccgcgcacacgcacatgaagtactcgtacaccgatccggcccacaacggacgcccggtcatccagaccggcagctacgccgcgaacatcggccaggtcgtgctcgactacgacaaggccaccggcaccgtcacctaccgcaagtccggcaacgtggcggtcgacaccagcaagagcgacgacgagctcgcggccgccggcgacgacaccgtcaggaacgtgaagagcatcgtcgacgccgccgtggccaagggccaggaggaaggcgacaagccagtcggctccatcgccgccgacatcaccaccgccttcaaggacggcgcgcgcgacgaccgtgcctccgaatccacgatgggtaacctcgtcgccgactcgctgctcgactcactgtcgtccgaggaccgcggcggcgccgaaatcggcgtggtgaaccccggcggcctgcgcgccgaattctgcaagaccggcgacaacgagaagtgcacgatcgccgccgacggcaccatcacctatgcccaggccaacgccgtgctgccgttcctcaacaacctgtggaccaccacgctcaccggcgcccagttcaaggaagccctcgaacagcagtggcagaccgacgccgacggcaacgtgccctcccgcccgtacctgcagctcggcctgtcgcacaacgtctcctacacctatgatccgaacgcggcgcagggcaatcacatcacttcggtgaccgtgaacggcaagccgctcgacctcaagcgcgagtaccgcatcggctccttctcgttcctgctgcagggcggcgacaacttccgcgccttcgccgccggcaaggacacgaaggacaccggtctggtcgaccgtgacgcatggatcgactacatctccaagaactcgccgctcaagccgcgctacgaccgtcgcgcggtggccgtcaccggcatcccggccgatggcaaggtcacggccggtacctcgttcgatctgcagttctcgaagctcacgctcacctcgctgggcgtgcccgccgagaccaagctggtcgccacgatcgacggcaccgaggtcggctccgcggccgtcaaggacggcgacaccgccacattgcaggtcgcggttcccgccgggctgccggctggcgcggcgacgctcaccgtcaaggccgtgaccaacggcacaaccgtgacgctgccgctgaccgtcgccgccggcacctcgaccaagccgcagcccggcaagcccggcaagcccgagcagcctggtcagacgaagcccggtacgggcgatgaacggcacgacggcgcgaacaacgcagccggcaatggcggcaacgccggcgccgtcgagcagctgtcgcagaccggcgcacccgtggtggcggtggtcgtcgccatgatggcgttgctggccgccggtctcaccgcggtccgcacgtcgaagcgagccgatcgcatacgctgaccggccagctgaactggccacagtcctccgcgtggtgggacgcgccccaacgggtgcctcccgccacgcggtttttttatgcgcgcagcgagaccgagggtggtcgccaacacaccaagccaccgtcagactcgctacgcgagccagctcccaccagcaggagcaagacgacgcacctcccaatgacaacacaagaccgaggccggtcgccgtggcatccgcttcgttcctctccccacgcatgcccccgcccgtgaatatcgtgtgggaatcgtcgaatttcggcagggcgaaaccattacaagccacttgaacgttcacaatgggaggtatgccgctagccgccatcatcaccatagccgtcatcgccggcgtcatcgtcctcatcgtcgccgtgacgttcgcccttcgcgcccgccgccacaagcgcctgtcgcagcagctcgtcaaacgcaacgacgatcaggtgcattacgtcttcgtcgtgaacccgtccaagccgcaggccgcccagcggcgcgcgcacatcgaacagttctgccgtgacaagggactgaccgacgtggaattcatcgacacgcagctcgacaaggacggccgcgcatgcgccaaggaggcgctcgccaacggcgccgacgtagtggtcgcggtcggcggcgacggcactgtccgcacggtcgcgagcgccatgtccggcaccggccatgccatgggcatcatcccgatcggcaccggcaacctgttcgcccgcaacatgggtattccgatcgacgacatcgacgcggcgctcaccgtcgccacatcgcacgggtcgcggcacgtggacgtcggccgtctctcgctgctggacgatccgaaggccgatcacggccacgcattcctgatcatcgccggagtcggtttcgatgccgccatgatcgacgacaccgacccgcagctgaagaagaacatcagctggctggcgtatttcgtcggcggcgtgaagaacctgttcaccccgaaataccggggcgacgtgaccatcaccagcacggacggcagcatgcacacccgtcatggcgtggcattccgcacgttcatggccggcaactgcgggcagatccccgtgttctcgctgatgcccaacgcctcatacgacgatggcatcctcgatttcgagatcatcgacacgtcgggcggcattttcggctgggcgaacctgtttggcgatgtagtgcaccagaccatcaccggcaagcccggatcgaacccactgtcgacgaattcgacgatggaccagattcagggagtgagcgcggagatcacgctggagaagccggtgctggcccaggtcgacggcgacatgctcggccgcacgcggcatctgcgattcaccgtcgaccgcgaggcgctgtgcgtgcgcgtgccggaggtcgcacccgacatgtcagcgacgggaatcatcccgccgattcgcgattgatacgaaaccgacgctctcaaaacttgcagatagaggccatttttcatgaaaaatggcctctatctgcaagtttaccgcaaacaccttggactggccgtctaaccgtccaaaaaaacatccgcacccccgtacgcgcacataacgacgcaaaaacctgccgttcacggcagagccgacaagagtgggcagtctatatgaaccacccccagtcgcttctcgacagccccccgctggcgggggctgtcgagaagcgactgggggtggtcaaacaggatggccgaccgccaatcaccatctatcagtcgtcgctaccttgcgggtgggtcggctgggtctcgtgaccccgcgaatcaccgatctgcgaatccgtgctgccgttcaggtcgttgccattgtcgttctggtcgtcctgttgttgctgttgttgctgttgctggcgctgctgctcctgctggcgctgctgctccagatacttctgctgggcggtgtactcgttcatcgacacggtcaccgcgtctccggcgtccttcacatcggtgatagactgctgcatctcgttcagatcggcgtcatcctgctgcagcaacgcgttcgcctgatcgatggcggactgcagcgtggtcctggtcgagtcgtccagcacaacgcccttgctgtcgtcgtaaatcttctgcgcgccggtgacggccgtctgcagttcatgcttgataaactcgaccttctccgcctttccgtcgttcacagccttggtggccttggcgacgttcgtcttcgccttggtgctggcgcgcgcgatctgcttgttcttgctggcattggcgttcagcgtctcggtgcccaacgccacgtcgcacgagaccggctcgctggccgaggacgcctttgtgaccgcgctgttcagcgtctccaggacggtcggatcggacacatcgccttgcggaatctgctgcgcaggcttggcttcgctgagcgcggactgcaattcggaaaacgccttgtcggccttggtcttcgaggtcttgcacaggctagccgcctgatcgagctcgttctggttctgcatgtggcgccaccacaggaatccgcccgtagcggcgagcgccacgacgacgaccgcgacgacggcgatgatgatagcgcggcggtggccatgttgctttcgagaactgccgtccgccttgccgcccggctctccgctcccatgaggaggcaccgccgcgcccgcctcaggcggcagtggcacggtctgcggcgtcattccggctgtaggtggcacgctctgcgtgggcgtagggaaagcactcaacggctgtatcaccatagtgacgtcgttgttgccttgcggctcttcctcctccggcacggcggggatatcggacacgtcctccagccccagcggatcggaggcagagccatgcaccggccgcacggtgtcctccggttcaggcaggggaacgtagggactgggagcaccatacgatgggccgctccccgatgaagcgtccttgacaccgcccatcgaggggaacatcacgtcggggatgtcccacgcgggattgtcgaggaactgcatgccctcatcatctgcggcctgctgtccggcagcgccggcggcatcagcagccacggcatcgtcagcaacgtcagtgccgggaacatcgccactggcaccggcggcagaaccgatcacggcatcgcccagcgctacggccttatattcggccgcatgccgctcggcgcccggttcaatgccctgcacagcgtcacgctcccctgtttcgggcagtcccgcgccgtcgccggcatcgtcccattgcatatcacgctcatgcgcttcatgctcgttcatcatccgcccccgattcatgtccgctttccgggattcgcccggccttctgttccctattatggccgtttcaccggcatattcaacgttcacgccattatatacggtaccgtcctgaccatgtcatgcgccgatacgcccaggtagcatgtcatcgcttccacaggccatgagcatcgtcaccgcgtcaccatcacaaccgcgttgtcgccatggaagggccacaaaacgcacggtcgctggcgagagccgcgcaacctgcataaactgtccaatcattgcgtaagtttatgatggtggaggagattcgcgggggatggtattcagtcttcccgcgagttggaacaaacgtgttccgccgcgggcgcagacttgcgcggcgagggcctagatggaagagcagatgactgcaaacaggccaaatacacctgttgacaagatgaccgacgatcttcagcatttttccgcaagatggccgaggaagaggcggaagccggggaatcggccgacggcgacactgccggggagtccacggacaatgacgcggatatgctcgcgaacgtggcggatccggcccccgcggccggtccgattctgggtcaggaaggccacgagggcggcgaagcgcatcgcagcggcggcagtggccacagcggtggatcctcccgttcccattcgcgcggttcgcgcagcggcagccgaaagaagaagcgccgtcgcctggcagtgcttctggtcgtcctcgccctggtgctggtcctggtcgtcttccccgtgatcgcaatctggtggtacgcgcacatggtcgacgagaacatcgcgatgcgcaacgcggaggccgaagcggcactgtccgggcccgagccgaactcgggcagcgcgttctacgcgctgctcatgggctccgacaggcgcagcaacaaggagaacggccgcagcgacagcatcatgctggtccgcgtcgacccgaaacgtgcgcaggccgatgtcatctctattccgcgagacatgatggtcaacatcggcggtggtgtcagcaagatcaacgccgcatactcatatgacggcgcggctggcgccatccgcgcggtatctaagtttgcgggagtgccgatcacgcactacatggaggtcgatttcagtcagatggtggcactggtggacgagttgggcggcatcacggtgaacgtgccggaatcgttctccggcggcaacggcggcgggtccctgaaggccggtacgcagacgctgaacggcgagcagacactcgtcttcacgcgtgaacgccacaaggtccagggcggcgatttctcgagagcccaggcgcagcgcatcgtgctgacggccatcatcaacaaaatcctggatcagccggtcaccaagtggcctgatttggtacgtcagttctcgaagggcctgtcgaccgatatgtccgtgacggacttcctgtccatcgggcagaagttctatggcaagagcgtgacgctgaacaccgccggctgcccctcgtacgcattcgagcaggacggcgtgagctacgtcggcgtggaatacgaggagtggcaggacatgatgcgccgcacggatgccggcctcgggccgaagagcaccatcgacattcccgagccgcaggcatccaacaagaaactgggtgccgcgtccaacgccgagtcaccgaaggactacaaggagctggtgaacaagtcgctgaactcaaacagtgtcatcggcaacgagtgacgcccccccccccgaagaaatcagcccctcgaaaccgctatctgcatttcgaggggttgatttttgcgtcaccggacatctatctgcgtttcgagggggtgccgaaacgcgatattcgaagtatgacgacccgatggccattggaatcatgcggttctcatgccccggctactttgccaccagccccttgaaacgcagatagatgtctggaacccgccgaatcaacctcacgaagcacagataccgccttctgcgacccggcccacgcgaaggacggccagctgccatcgactacgaaccagctggagggaggggccgacaccgcggtcaaacgcatgctcgactgaccaacacaggagcctatccgaagagcacatgaaacgatgctgcgaatgagcgatctgcatgctcaccgatcaccccgaccctgtgtcgtccgtcatccccaatcattggaggatgaggagggaaaggagcggcgaggccacggagccggagccaatgtgtttatggtcaaataacgtgtacggcgtcaccaccaaatctgaacggcgtaagcgttcatattggacgcggacggcggctggaaacggcatcggcggaagaaaagcgccggtgccgtatggttcctgatggattcccgagtgccagaaaccagcacatggtcctcgggaggaaaggaatgacgacgccggtgcgtgtccggcaaagtatcaggcagctcgagacgaaaggctggattggcaacggcgtgttggacaattccttaggggacgagtccttgttgtgtgaattcgttggggctccggtatgcgagggtggagtggagtctttggttgtcggaccgccacacatagtcgtcggggtcggagcgtagttgttccaggctggtgtagtggttccggtatatgagctccttcttcaggagcctgtcggtggattcgaccacggcgttgtcgtacgggtcgcccttccctgacggcgatcttccgatgtcgaacacgtcgagcagctcgtcgatcctcgcgttgtcgaacccgccgccccggtccgtgcggaacacctccaccccggtcagagggaagccgagcgtggcgaacgcggccatgaccaggccggcggcgcggcccgtgtcggcgccgtggccggcgatgcccctgttcgccaggccgatgagcgggcacgcgtacgcccactcgccgccgacgcgcacgtacgtcaggtcactggccaggtgggcgcgcggcccgtagccgtcgaactcgcggtcgaggatgttcgcgagcccggcctcgtcggcccgcgtcttgtgcggttcggacgttctgcgcgcgtacgcgcccgccatgccccgccgtttcatgatgttgacgatgcgccttccggaggcggtgacgcccctccgctccagcgcggccttgatcttcccggcgccgcagcgctcatggccgtcgcgccggaccgcgcgcacgtcgccggcgatcggatccacccgcccggcttcgggatgttcgatcatccagcagcagacggagcggggaacgcccggtatcctgcactgcgccgatatcggacagcgggaggcgttggcccgtatcactgctactttcgtgcgaataccggcgccgcctgttctgaaacgtccacctccatctccgactgtccgttgcgcttgcacagctcgaccggctcgttccgctcaggggtgcggttgtcgtcggctttcgcggagccgctgtcgcggatgccctggacccaacggtgcagcgtggaacgcgagatgtcgtactcgtccctgatctcgcgcgccggcttgccgttctcgtaaagccgcacgatccgccgcttgaacgactcctcgcagtggcggggatgcctcgggccggccatcgtcggcctccaacctcatgtcaatcgacccccatcggactgtctaatacaatgtagccaatccagaagccggaccggagtgggatggggaatccgcctgcacgaccgattccgcgccggcgcctcctccgcctttgggatgccagtaggaaatgcctgcaggaggatgggacgcgctgaacgagcgcgtggcgaccttgccccaccctgtcccgccttcgctcgtgtggaccgtgtccccgttcacctgttccacgacgaccacatgaccgtacacgctgctggaaccgccggcgcccggattgaacacgataatgccacccgcctgtgcgccctgctcccagccagcgttcctggcgctcgtgtcccattcgccgccattaccccaatactggccgatgtcatgtcccaatgacttctgtcgtatgcacgcccaccaggtgcattggaacccataatcgtatggtgcgcagaaactcacctgcccaggccacatctgcttgatctgatcctggtgcctgcccaccaggcccgtccattcgcctgatgcctgtgacacctgtaccgtgctggaaccgcccgtgttcttgcacccgcccaggaaggcgagcatatccaacggggaacatgctgtcaacgtgaccagcatgcatgcaacggatccaggagctgccggaagtcgtccccacgcgcggcgtctcatcggtagtccccatccacagcggcccagaacggtttctgcccgccgactgtgacctccaccgtctggcagggatgctgcttggtgccgacaccgacatgggaggcaggattccaatacgcctcgtcgccaggtttcatcctggtgatgtcgatctcattgccgtcccgatccaccacaggccggctcagcgtggccggacagtacacggtcacatgccaatcaccgtcatccatcggaatcagcaccgcgtcatacgcacggctcacgatttcctgcgggttcacgcgggaatccaactgcaacccgtccgggatcgggaacccggtggcgtccgtgtaccagtagacgttgttcgtgatcgcgtccgtggccttcctcgtccatgcgccgtcaggagaacacccgtcatccagtttcgccgccagatagttgctgtccgcctggccagagcacaagctgtcaggttggaaccgtcgttgcgcccaccaccaacgcgacgcgtcagagaacggatgctccacaccgcccccgtccacagccagaccattgcggatcacatcattccactcgtcatcgcttgattcgggatcaagcagatggttcacggttgccaacgccgtgtcaatggctccatacaatccggccaccggatgatccgccgaataatcagtcttgccatccttcgttccataatcaatcttgccgtcccgtatcgcggcaagggacatgcgttgccgtgaccacgctccgggcttggggatccccgccgtctccagaccacgccacgacccgtccgcgtcgttcccgtcggatgacgaaccttcctcggtcatggaagcatccgtctggatcgaggactcgttctcgtcgccgcccctcgtccaatcagtgaccgcgatcccaaggcgagcaccagcagtatcgcaacccccatgcacgcgcccttcgcccatttcgacatcggcttgggcgccggcctcgacaccatcacatgccgccttccataccatcagacggccagtcgccgccggcagctgccatgacgggctcgtcatccgcagaagacgcagcctgcatctctttgcgcatgtctgaagcagccccccctccgatgattcagatacggccggctcccggctgtccttccaactgttttcaatcagttcttcgatggcgagcagttcggcaaccgtgtttccggccttccttgcacgttcacggaccgtctgcgcctcatgctccgctacttgcagacgggcgcgcaggcttcgaaggttcaccagcgtggatgcgtactcgtccgccgctttctcgcgttcctcacgcaacccgcgcacacgcgtcagtacctggcgtttgaaattacgcatctcgttgttcggctgcgtcagcatctccgttcctcatggctctttgccttgtcatccgtcatgctcctaccttcgacgcgcagtgacggagcggccccctctacacctttcagccgttgggagacgtgtagaggggccgctccggcatgacgcgagaaccgatggatgctgggagacgaccattggaccgctcatccagaaaaagggacaacatctcatgggacaatcaatggaacatctgctcgggatgatcgccgacatagcgtcatcggtctggcagttcgctctgaacctgccgggagcactacaaatcgtgttcaccctggtcgcattgatcgtggcaggcgtctgtcgcatggtcgcgatgcggctcagccaccccgtcttcacggaaacggacggttccgcggtcggcaaaaaatcatccaggtcatcgcctacatcctcatggtcgtgtgtctgcttgcctgtctgctcggactggcagccgtgttcgcgccactcatcggccttgcttgatcagccaatccacgaccaggggtcggaaccatatgacctgccgtatgattccggcccttgcctcgttctatcagacacgatccttcgacaaaggacccatcggtcatgacccgactcatcatcgcggaaaagcattccgtcgctcaagccatcgcccaggcactcgacacgtctgccatcaggaaggacgggtatctgcaatgcgcggacacgctcgtcacctgggcgcaaggccacctcgtcaacctcgctaccccggaccagtaccaggaccacgattgggggcgctggcggatggatacgctgccccttgacccgtcacctgactggaaacttgtcgtcaaccggcagaaaggcgccgacaggcaattcaagaccgtccaacagctcatccaacgagatgacgtgaccacgctcatcaacgcatgtgacccggatcgggaaggcgagtcgatcttccgtcgcgttatccaatacctccgtcaccatgccggcgtggacaagccggccatgcgtctgtgggtcgccagcctggaagaacccgccatccgacaggccctgagcgagatgaaaccggaatccgcatacgacggactcggcacagccgccgaacttcgttccaaggccgactggctcatcggcatgaacgccagccgcgcttacacgctcgtctacggccggcgcttgactgtcggccgggtccagacgccgacccttggcatgatcgtccgacgtgaccggcagattgagagccaccggcccactccgttctggaaaatcatcctcgacatgggcggctggcatttgaccagccagcgcatcgaccaggagccccgggcacggcatctgctcgacatcatggacatgcctggcatgcgcgtgaccatcaccaaagtcgagcgtaagcgacaggataggaaaccaccacgcctgtatgatctgaccggcttgcagaaagacatgtcccgcatgcatggggctcaccggcgatcaaagccctttccgcattgcagagcctgtacgagcggaagctggccacctacccgcgcaccgacagccagtacatcacgcacgacgatttggaaaccctcgtccgactcacccagagagacgaccgtgtcaccgaattcatcaccccagacacgcgccccgaccagcctcgcctgggcctgaccgtcaacgacaagaaagtcgccggccacaccgcgatcctgcccactctccgggtcaaccagacatgcctggcagacttgaacgaacaggaacggctcgttctcacacgaatcgtacgtcgcatgtgggaagccgtcagcgacgaccaaatcgtggaaatcaccactgtgcaagcccgcatcagccctgaatgcggcaccacagccaccggaatcaccgacgaggatctagagacaggtttcaccacacgccaggagcaagccctgcaagacgggtggaaagccatcgaaccatcatgccagcaagcagaggacacaagcgacgacgaaccggacaatgtcagccgacatgacacgatcccgcccaaccttgtcgaagacgtgacgctcaccccggtctgtccggcggagcttcacaagggagagaccaagcctccggcacgattcaccgacgcgaccctgctcaatgcgatggaacacgccagccgttggctcgacatgaagacgaagaacgcggacgagttgaaagccgcattggaggacgacagcacgcacgccagcggcatcggaacgccagccacgcgggccgagatcatcgaacgacttgcctgttcgtgtcggttcttactctcatgacagacggcgttgccgccaccacacactggtggcaagccatcgccaccgcggccatcgcctggctgctcagcagatacaccagtcgcagccaaacccatagcgcacgagcccaaccagtcttggaaacttttcaggccaaattgacaatccattggaaagcattttccaagtcgccggcacaatacggtggaaaacgctttccgctggcacgcagatagaaaggaacaagccatgagctacgaaaacacgaattatcacaagcgaagcgtgctcatgaggatgtctttgcatgtcggaaacatgctcgaccaggccagcaaagacaaccatgtcacggaagcattgatcatcagactagccgcgaccatggtggaacccggggagctggcagcaaagaacaagaaacctttccgagcaccccgcttccgcacaggtcacaccgactggaaggatgacaaacagtaccgttccgtcctggcgaagctgtccgatgcggagtatgagctggtatcccgcgccgccgtcggcatggacatggcccgcggcccttggctggccttgaaagtcgaacagctcctgagcagccctagactgagggagctgcttgaagacgcaacctacatagaagccaacgagaaggcacagaacatcctccagcagtcaaaaggcagcagataacgacccatggaaacccttttccactcctagatgccttaatctgcaccgcaggtgcatcatcgaagaataactaaatatctttattcgtgcagcgcggcgttaaaccagctggtcacacgcctcggatgagtgatggcggtacccaccaccaccgcccaggctccgatgtcacgtgcacgccgcgcttgccggggtgtatgaatgcgtccctcgcaaatgactggcacgtttgggagtctgtccaccatggactccagcaggtcccagtccggctcgtcggacatcggccggccgccggtgtaaccggccaatgtcgtggagatgaagtcaaagccaagatcggctgcctgcaaggcgtcgtccagacagctgcagtcagccatgagcacggcgccttcctccttcagaacatccaccgtctgccggagagtcctgccgtccggtcgaggacgcgacgtggcgtcaagggcgacaatatcggcacctgccatcatgcagcagcgtgcatggcgcaaggtgggcgtaatgtacactccgctctcgccttccttccataggccgatgaccggtaccgacacctgccccttgaccgcactgatatcggccaagccctggcatctgatgcccgccgcaccaccgagttgagcggacagtgcaatctgcgccatggtttccgggtgtctcatcggctctcccggataggcctggcagctgacgatcagtccgccctgcagttgactcacgaaatcacgcatatcggatccttctccacagccgtgccttcatcgccctcgatcagtccgaggtactgggccagcggaacggccgcgcccagaatcggagcctgagcgcccagtgttccgggcactatgggaatgtccgacaaggcatcgatcacctgatcctgatagccctgtctcacagcgtccagccacagctcaccggcaccgcacaccgatccggagagcacgatcatctcaggatcaagcatgttggcctgcatccccagggtattcccaagtgcacgtcccgccatgagaactgcggattgcgcgtcattgtcaccgttccttgccatttcggcgatgcgatcgccccttgcgtccttaccgctgagcttgtggtagcaacgttcgatgcccagtccggaggcaatcggttccacatgcccgtaccggccgcacgaacacctgatgcggcgagcatccggatggcacacatgtcctatgtgaccgccaacgttgtgggcaccatgcagaacatgaccgccaagcaccatcgcgccaccgatgcccgtgccaaccgcgaccagcagcatggaggagacatcgcggcccgcaccccaatgcgcttctcccagcgcgtgcgcatgcacatctccgacaacggaaacggttttcccagtggcggctcgcaatgccggccccaagggcattcccgaccatcccggcatcagcgaggtcgcggattcaatggaaccatccagcgcaatcacaccggcggcaccgatacctatgcccatcacttcccggtcgattcgtcccagcaactcgcaggagaactcgacgatccgctgcagcacggccaatccgccctcctgcgcctgagtgggctcctgtaccagacggatcagctcaggcatgtgccccgatgagaatcgcaggacactacccgcaatctttgtgccaccgacgtccaacgccagtatcagtttgccctcttcatcggttccgtcgttcattgtcagactcccctttcacgaacataagtcgggtgattcatgatgcagcctcccatcaggtgatttcaagattcatatcgatctcgaacaaacgtcgccatggaaaactcactcgtgcaacctgaagaggcaacgccttcgacagcatcgtctcatcgaccatgtgttgcagaaggttgcgcgtatgatcctcgacccatcgccggcagacgccgatgtcctggtaggatcctccgtgatcggatacctgggcgtcaacctgccagcggacgatgctctgatagaacacgtcttctatgatccggtacgctacgttcacgttgagcattcttcgatcagtgtcggtgccacggacctgagcggccaccgcctgggatatggaggtaccaagcgtattgccgttggtgttccatccggcgtatgacgtcagcgcaggaatcatgccgtcacggtcaagctcatcgaccagcaggggatctccgccgttcgcgaaggcgctgtcggccaaggccacggtacgttcctgcaccagcaggcgttcgatggtgtcgatgaacgccggcagattcctgtaggagtcatacgtgacgtcacgaccgtcgattgcctgagacgcttcctgcatgcgtctgcccggcacattgaccagcaattcgatgtctgctccagaacagccgtcccacaccctagcaccggcagcccgaatgtgtctcagcacggtctctcgcaggggacgatcctcgtacgagggtacgattccggcaccgtattcccccgagtatcgtgctcgaatcacaggatgccgttccatgacatcgcagatggcacgcgacacgagtgtctgcccgacctcatccgaacccggatacattgcgaccttgcgcatcagatgctgcgcgcatatgctccgctgcaacgaacgctgggcacgcgcggtgtacccgtacgggctcgaatcgtcctggggaaggatcagataatcgaccgccccctgttcaaccagacgaagacaagcctggttaacggctagattcacgctccgacgatgctcgtagtcgtcaatcacggattgcggaacagcaatgttcgcaagctcatcctgctccgactcgtcgagtccctcacgctgcttccgatccgtcaaccatgcccggcgaaacagcattcgtccgtaccgcgcatagtaatcaggctcctcctcgctggaatcatacgagggtgcacgcatgatagtggaggcgacatagatgcggagggtcggattacgcagacgtagctcacgaatcacatccagacgctccagaacctcatcggcacccaagtggtgcaaccgtgacggtatcaagcctccgtacaccagcaggtcgatcgctatgacggccgcgttgcacagcttggcctggtccaacaggaactcatgcaacgcagcgcaatcacccggccttttcttgtccggcaacagcgactgtggcggcgtgatcagttcgacgccgcagccggaggccagcatcatgggaaacttcctgttgcagggcctctcgtccaatggcatgtacagtatgcgcatgtcactacccccgcatcaacatcaaacgtgacgcaaacaaaatcatcccttgagaccgccttcctgcaatccgaggaacagattcttctggaacagcgcgaagaatatgactatgggcacgagcgagatgatcgcaccagcagccaccagtcgcggatccgtgtagaacgttccctgaagccggttcagaccgagtgtgagcgtgtacttcctgtcgtcgctgagcacgaccagcggccagaggaagtcattgtagctccccacgaacgagaggatgccgatcacggtcatcgtgccctttacctgcggagcagctatgtggaagaacctctgccacatgttggcgccatcaaccttggccgcctcgatcaactcctgcggcacggaacggaatgcgttcgtcatcaggagcacgttcagggggccgatcaggccaggcaaaatcaagcccagcagactattcgtcaatcccatggacttgaccagcaggaacgtcgagatcagaatgccctccgtcggcatgatgatggccaggacaaacagcatgtagccgatgttgcgccatctgaatctcaggcacccgaaggcgtacccggccagcgtacatccgacgacgttgcccagaacattacctgccacgacaatcagcgtattgccgaaataccggagcaatggcagacgcctgaacacctcgacgaaattgttcagcgtgaaatccttcggaaacaggtatggcggcagggagtacacgttgtcgttcggccccttgatcgccagcgacaattcccataccagcgggcccgccagcagaatgaacacgagcgtcaacactatgtactgaacgaccactcccacggtgacacgtcttgtattcatcattcacctctgcgtgtaatcagctgttgcacgattgtcatgacaccaacgatgatgctcaccatcatcgaacggtggctcgcacgccggttcctgcaccgccaccggcgtgaaggcaagggcttcggatatccgacgatcatcatcggctcgcctgagagcattcacgacaccatcgtgcagctgcgcaacagcaagtcgctcggatacatccccatcgcggtctgccccgtcaaggcgagcgcaggcaacacgccaaacgcaccaagacgactcctctcggtccccttcaccgcagacgacagcgacgaggccgaactgatcgcgctgccgctggactcccatctgccgatcaccgcgaaatacctgaaagcgcaaaccgtgctcatcgccgacgtactcacccgcgattcggaaaccatgcgtgccctatcgctcgccatggaatccatgggcatcgagctcgcgcagcccgcgtcgctggccgacctgagcgccgcgcagctccacttccgcagcaatcccctgatgccggtgctcaccgcgcagctcacgcagtactccaccatcacgagaatattcaagcgcctgagcgacatcttcttctctctcatcgcgatcatcatcagttcgccgatcatgctggtcgtcgcgctgctgatcaagcacgaagatggcggccccgtcttcttccggcagcagcgcataggcatctacggcaagccgtttacgatgtacaagttccgttccatgaacgtcaacgccgaagccatcaagaagcagctcgccgaggaatacggtatggaggaccggttcgtcttcaagctcaagaacgacccgcgagtcacgcgaatcggccatttcatccgcaagacctcgatagatgagattccgcagttcttcaatgtgctcaaaggcgacatgagcctcgtcggcccgcgtccgccgctgccggaggaagtggcgcgctacggcacgctgtattcggccagattgctggtgaagcccggcatcaccggtccgtggcaggtgtccggacgcagcaacctgacgcaggagcagtccgaattcgtcgacgtgtcgtacatccagaactggtcgctgaccggcgacatcgcgatcctgctcaagaccgtggtggccgtcgtgcgcggcaccggctcgtactgacggagatgcggcggcgcgacttccgcaccgtcgcatctccgcgccgccaatatctgagtgctcatattttcgtctccccctactcaacttccgattccttgcgccctcctctctgtgttcttccattccacccctccgtggccttccctacatttttcctccgcgcccttctcccccaaccttctccccacgcttccacccgggttgcccacctgtaggagtagtgtattggtcggcagaaatgatgcatatacaacaatccctacgcagcgaaacagggatgacgcatacacaggcgcatgaggcggaacggaggagaatacggcacaatgaccaatcgcagcgacaataacgacagcagcacggaaaccagcacgaacggcaagaacccgaagaaaaccctcgcaaagcgcggcggcacagccggcggtaaacgcgtatccacgctgtccacgccgctctccagcgacgaaagctatgtgaacggccatctttcgcgcgtggccctcgcttcgcttgccatcttgacgttcatcacgttcgtcggcaacttcacgcagctgcagctgtccgccgcgctgccgaccatcgtatcggaattcggcatctccgtgaccaccgggcaatggctcacgtcgattttccagctggtcatgggcgtgatggtgccgctcaccgcgttcctgacgcgccgcttcaccacccggcaaatcgtcatcgtctcgatgaccgtgttcgctgtgggatcgctgctggcatgggtcggcccgacgtttctggtggtgctggccggccgactgcttgaggccgtcggcacgggcgtgatgtggccggtgctgcagatcaccgtcttctcgatctacccgttatcccgccgtggcatggccatgggcgcggtcggcatggccatgagcgtggcccccgcgctggggccgactttcggcggcttccagaccgacagtttcggctggcgttcgattttcttcacgctcacgatgatcggtgtgttctgcctgctgctggccatcttcgggctgcgtaacttcgggacgaccgacgaccatgccaaggccgatttcttctctgtggccatgtcggtgctcggcttcggcggcctgatgttcgggttcacaaacatcgaatcgtacgcgccgtcgaatccgatggtgtggggcgcgatgcttgtcggactgtgcggcatcgtgtggttcgtggtgcggcaggtgcgccgcgcgaaggcgtatacggtggccgtccggcaatccgtggacgagtcggacaccgcgcaacgcaccactcccgaaccgccgctgctcgaccttggcgtgctgcgcaaccgcagtttcaccgtcgggacgatctgcgccgcgctcagcttcttcgcattcagttcgatcatggtgatcatgccgctgtatatccagaacgaccgcggctattcggcgactatcagcggactggtcatgatgcccggcgcattcggcatgtgcatctcgcagttcttcggcggcaagctgctcgaccggctcggggcgaggccggtggcgctcagtggcacgctggttctgctgttcggcaccatcatgatgagtctgatcgacagcaacacgtggatctggtgggtatcgatatggcagttcgtgcgccagatcggcatgggtttcatcatcatgcccatcaccacttggtcgctcaactgcctcgacccgacggaggtgtcagccgggtcggcggtcaccaacacggtccggcagatcgcgggtgcgatcggagcccccgtgctggtcatcctgatggagacgctgattcaactgcatggaggcgacgcaatcgccgcgagcatcttcggcacgcagtggacgctgcgagtcagcgcgttcatcgtgttcatacaggtgctcatcgtgctgttcggcgtcaaaggagccggtgccggatcctcgcgggacgtggcgcagcgggccatcgcgagaatccgcacggtctcgcaccggtaatcgcagcaaattggcgactattgtcaccggacgatgacaatagtcgccaatttgcgtaggaacgtcaccggtaaccggaatccaattgccagacatcacggctccgaacgatccagagccatcagagcgcgaaagcgtctctaagtgcgcgccgaaatgacaagtccgcgcacttagggacgcaaatggcccggtttgcgtcgctaagtgcgcacggtcgtcgtttcggcgcgcacttaggaacgctttcgtcatatgccatccctaatcccgcatctcggagcggaatccgcgggaaatcggcgagtctcggcgtcagtcgtccacgtcacgcacgcccgaaaatcgtaagcacgatcagcagcacgttcagcgccacgatcaacgccaccacgatcatgaagatcacgtgtttgaccgtcccgtcgacccattcgcccataagctccttggtgtgcgtataacgcatcagcggaatcacggcgaacggaatgccgatggacagcaccacctggccgatgaccagcgcctgagtggggtctttggcgaaccacagcacgattagcgcgggcaccagcgtgaccacgcggcacgcccacatcgggacgttgacatgcagaagaccacgcatgatctcggaaccggcatacgtgccgaccgacgtggaactcaacgacgaggccagcaggccgatggagaatatcgtgccgatcaccgggccaagcacctgcgtgatcgcccgttgcgcgccgtcgatggaatccgtgccggacatgccgtgcaacgagttcgcggcaagcaccagcatcgccagattcaccgtgccggccagcagcagcgcccacgtcacatcgatcttcgaacctttgagctgcatggcgatcgacggcttatcgctgtgcgtgtagtaatggtcgttgaccaacgtggaatgcaggtagatggcatgcggcatcacggtggctcccagaatcgaggcggccatcagcaccgaatcggtgccttggaagcgcgggatcaggccccgaaccaccgctgcgggatccggcggggccacgaacaggcccgcgatgaacccgaaggtgatgaccagcagcatcacgatgatgatccgttcgaacgtggtctgcgtcctgccgccctggaaccacagcatcaccgtggaggccgcgccgatcaccaggccgccaacgaacagcggcaagccaaacagcagattaagggcgatagcgccgccgatcacctcggccagatccgtggcgatggcgatgacctccgcctgcatgaaaaacatgaaccgtcccgcgttgcccatacgctcccccagcagttccggcaggctcttgccggtgacgatgccgagcttcgccgactggtattgaatcagcacgctcatcgcgttcgccagcaccagcacccataccagcaggtagccgtatcgtgcgccggacgtgatgttcgccgccacattgcccggatcgacataggcgaccgcggccacgaacgccggtcccaagatgctggcgagcgcatgctcgtgatgctggcgcccggacgcttcctcggcatggctgcgttcgatgtcgatctctgaatcggttttgtcatcgatcatctgacgatgctctttcattccctcattcctctcatgcgcccgacccctgggcgctactcgattcgcctaatggtatacaccgcgtttgtaacagaccgtcgaatttcccgccacacgactcccccgctgggcggactgcggcatttgtcgagcgatgggctctattccgcccctcactgactggggatctgttgcgcggggcatgcgcgcagcacggcgagcatcgaacgcttctcgctggtggtgacggtcagaccgtaatgccgtttgacgccgatctgccgcgcgacgtattcgcaacgatactcgccgttggtgggaagccagtaagcggcggaggcggatcccttgtcctggttggcggagccatccacggcgagcagattgtaagggtcattgccgaagcggtagcgctgggcggtggtccagtccctggcaccggattgccaggcgtttgcgagcgccacgacgtggtcgatctgcacggcggcgctggtgtttcggccgcgcacgaacaggatggtcttcccggtgtaggggtcggcgagcgtacccgaggagacttggcagcgcttggctgcgctgaatatgacatcagtcaggtcgcgggcgagcacatcgtcgcgcacgtcgcagccgtcgccatcatcgtcggtggcgcggaatccgaaggagtcgcggtcgtagccggtggagtcgggccggtcgtcgacctgcagcccgttcagcgcgtccgccgccgggccggaggcaatgtattcgccggtgatctcgccgatggaggggctgattttgggcaacgccagaccgatgacgacgccgagcagggcggcgatcaccaccagtatcataagacgttccagcggggatgatccgcggaatcggcgtttgcgaaaatgcgtgcgcacggtcaatcggcctgtcgttggttctgcggtcagtctcgtgggctgcgcggtggtatcgtcgtcggctcaggcgcgcggcataagcccggactcacgccgcgtacctttctccccgccggatcaggcgtaggagaacgtgcgaggatcgtgccccgcgcgttccggaccgtcgagcgcgtcgatggcggcatgttcatcgagcgtgagcgcgaagccgaacaggtcgaggttctgccgctgacgttcggagtgcaccgacttggggatgatgatcgtgccgttttcgatgtgccagcgcaggatcacctgggcaggcgacgcctcgtgcgcctcggcgattcgcgcgatcgtgccgttgccggccttcagatcggcgccgcgagccatcggggagtatgcttcgaccgcgatgccgtgctccttgcagaatgcgacgacttcgcgctgctgccaggtcgggtgcagctcgatctggttgaccgccggccattcgccggtctcctcgtacagacgggtcagatgctccggcaggaagttgcacacgcccagcgtcttcacacggccttcgtcgcgcagcttggtgaacgccttccaggtcgctccggaacgccaattgaacggagtcggccaatgaatcatgtacatgtcgacgtattccagctgcaacagtcccagctgtcggtcgaaggctgcaagtgccatgtcgtacccctgctcggagtcgcgcagcttggtcgtgacccacagatgactgcgcttgcgccccttgttgaagccggtttcggcgagggcgcggccgacgccgccctcgttgttgtagcccgcggctccgtcgatatgccggtaccccgccgccaacgccgatttgaccacgggagcgacatcatcgttctcgattcgcagcagccccaacccgatttgcggaatcacgttgccgtcattgagtttgattcccggcacgctcgcagcagccgccgcaacggcgagatcgctggttcccagcatggtcgtctccttgtcttcacactacatccggttcggagcatatgccatggcgatatgccgagcctccctacaccagtatgccatcatatcggatgaccgacatacgattcgcgattggcggcatcggtgcaggggccggcagacaacgccgccggcccctgcaccgatcgatcagccgtcatagcggccatccgttcaccagcccgtcaacgacgccgccgccatcagctgcgacacgcccggagtgcgcagcacaaccgtcatatgcagtcgtgacgaaccgctcaattcctccgatccgcaataaccagcctcgcaattgtgccaccactccgggcgtgtcgcgacaaatcagacccgacgcgcaccacggttctacgcaagacccatggccgaagcatccctcgaccaccccagccggcctccgaccgacaacccccgccaacgcccaccaggccgccattatgtcgattgtcagcgccccccatccggcaaaagtcccatccaaggccagtgaaacgggactttcgcgggacggagcacatgccgccaccgacctcaaatagggaaacgcggcgttatacgctctcaaaactcacagggtcaaattcactaaaaatggcctgtatctgcgagttttgagagcgtggttcccgtaatccccgagattcaccgcgtgctgtcgcgcacaatcacattgcaatcggtcatcaacaactcgggcttagcgatctcaccgcggatgcgccctagaatccgctcgacggcggtaggcgcggtccactccagacgcgaatccatggtggtgagcggaatctgcaggtattgcgactcctcgatgttgtcgaacccgatcacctgaacctgccggggaatctcgatgccgttcgcgcgcatcacggtcaacgcgccgatggccagctggtcgttcaggccgatgacgccatcgaacggcacgcccttgtcgatgagctcctgcgtggcatgggcgcccgcgccaatcgtccattcctgctcgacattgccgaccagccgcgcatccagcgtcatgccgcgtcgccggcattcttcgatgatgccgcgcaaacgcagctgcgcgttgccttccaccgcgccgagcagcttcgcctcgtcatatgcgccacgtccgccgaccaccgccagcgacttcacgccgcagtcgaacatgtatccggcggccgatgccgccgcctgcacgtcgttgggcgtcgcatgatcggccttgccccacgtggttcgcgcgccgaccaccaccagcgggaaatcgacctccaggtcctccgggttgatgtcctcgacttcgctcatcgacagaatcatgccgtccgacaccgtggtgttgaagttgcgcaacagctcgcgggcgcccgtcgccgacccttccgcgtatgtggtgacgtacacgaggtatccgcgctgccgggcggcgtcgatcacgcggttcgcgagctcggacaggtacggcgcggtcagcgtcggcacagcgagcgtgatgaagccggtgcggtcccggttgaggttgcgcgcggcgacgttgacccggtatccggtctgctcgatgacggcttcgactttggcgcgggtggcgtcggtcatgcgtccggtgccgttgatgacattggatgccgttttcagcgacacgccggccgcggtggcgacgtcgcgcaacgtgacgcgccgacgtgcggccgtcgtcggcgagcctggcaggttccgcgcgatctcgctcttgccggtcttgccgttttcggtcttgcccatcgcgtcaaccttactcgtagaggaaactccccctatggtaatcgtcttcgccgaagttgtcatacgggccaccgcatgtctgctacggttttgtcgtcttcgcgacatcgttgccatccgatgacgtgttcgccaccacgcatgtcgccgctgttcatgaccacgccaggctgctcatcgataccgtcaccggtctgatgagcggcacgccatccgtcccgttcgtcgaattcgagtctggcgaaccggatttcgcgcttgttgccggtgcggatgcgctcgcccgtgtaccggtccacgccgcgcgggcgcatggcgtccggcagaaagcagtggtaggcgatgacccattcgtcggtgccggggacccgaagtatgcagtgatgcccggtgccgagtatgccgaggcgttcgttggcgaccaggatttcgccgcgataggtccactgcgaaccgtcgccttccatggtcgacgcggccgcataggcgactcgatagtcggggtcgtcggtgtcgccgatcgagtacgtgagatagtacgtccacgttccggcatgctctctcacgttcagatatgcggcctcccggatgtcgggcgtgacttcggggatgatgtgcagcatgtcgtcggacaggcgggagtagcgtgcccggttctgcccccaggctaggtaccatcggccggcctgcgggtcgcggaacgccgcgggatcgacgccgggcgcgacgatgccggttccgaagccgtgccgcgcggcgtgcgagccggttcgcgccaagtcgccctgcagagcgtatcctccatcgatatggtcggataccgccacgttggtctgcccgtcgccgcagaaatacaggtaatagcggccgtcgcgaacggcgagcgccggcacccaggcgtggccgggcaggatgttggttcggccgctgccgtcgagatgctggtcatgcaggtcgatgacgacaccgcggtcctgccaatgtgccaggtcttcggaggcgaggcagcggatctgccagccgctccacccgccgtgtccgtcggtggtggcgaacaggtagaacgtcccgcgttcgtatgcgagttcagggtcggcgaagaaacgcatgccccgcctgccggtcgcgtcaggcgtgtcggggatgcgcacgggggtgtcgagtcgttccgcgacgacggagatgaccacgcgcgaggtatcggcagtcgagccgtcaatgcccgacccgtcatcgcggtgcaccgcgagcaggagcggacggaacagatcctgggtctgcggtacggcggatccgtcgagggccgtcacggttccgtaatcgctgcggaaccgcagtcgcagccgagtgatgtcagtgatttcgccgctgaccgcaccgtccggcgtccattggtccagcgtcagccgtagccggtaatcggcccacggccctgcggccggcgttgcttccgcgccggaagcccggtcaccgtcatgaacccgcgtctccccgcgcagcagcattgcgacgaagtccacgtcgacgtcgtcgcggacttcgccgcggcccgactctcctcgaatcgccggccccatgtctggagccggcgatccgtcaacgttgcgacaccgtgatgagcacaccgttgcgtttcagcgtgacggccctgccatcatcggtattgccgcatccgcggtagacgagcagggtctcgcctgccggctcgcgcacgacagcctcgttcttcgcacggttgaagtagaagtcaaacccccgatccaccgtccgcatctttcaccccgctaaagacccattcggaagcgacgaacgatatggcatgacaacgttgacataagcttatcgtgtcgacagatggcgccatccggcgatttgtgggtcatacgacgcacacgacatcgcaaagtctgtaccacaccagggcttttttgcctcttttcggccttctgtggtacacgcgcccaataccggtttggagtcggaatcccgttttccttgatatttcaaggaaaacgaatgacatcatgtaccacaccaggtcatgtaaacgtttgcacgagctggtgtggccatcggcgtggccacaccacggccaaatcgggcaaaatcacgctggtgtggcacaactacgaaacgaagggacgcggcgacctgctgtctcggccaaaaatcgagacgccgagctgcggatgataccccgaaagtcctcggccgccccagtcaccttcgcgaacagccctcgaccctgcagttacggacatgccatgcatgaccagcccgctggtctcactgccgttccccgccgacaagcagcccgatccgctagcgggagcctacaggctcaaaaataactcgtgaatgcgggtgtcgtcggtgagttcggggtggaaggccgtggcgagaatgttgccctgtcgcagaccgaccacacgcccatcaacctcggtctcgatcgtggcgtccgccccgacatcggagacgaacggcccacggatgaacacgagcggaaagtccttgatgtcaccgaaatcggccgtggagacgaacgaaccgagctgccgaccgtaagcattgcggcgaaccgtggcgtcgagggcgccgaagtacacattgtcgtcgttttccagtcgcttcgcgagcagaatcattccggcgcacgtgccgaacaccggcttgccggcggcgatgtgcgcggcaatcggctcgaacagaccggtggagcgcagcagcttgccctgtgtggtcgactcgccgccgggcagaatcacgcggtcgatggaatcgtcgaaatcctcggcggcacgcagcagcttccactgggcgccgagcttgtcgagcatcgcagcgtgctctgcgaacgcgccctgtacggccaggatgccggtcacgccgtgctttgccgtctcggcatcggccgactcttccttcgaaatatattcaacagctacaaccatgattactccttggctcccgatgaggggagccgtcgaatgcggtggggaggggtggggtgactgaggatgtgcctctaccaccccagtcgccccgcggcagccctcgccgccagcgggggcggattcatgcggaatcgcccccgccaagttgaccgccttcgccagcgggaggggcggctcgatcgtcccgccgctagcgggctatgatcactcgccgcgggcggccatgatggtctggatttcgtcctcgttgatgccgaccatggcctcgccgaggttctcggagagtcgtgccagcagatcggcgtcctgccagttggcggtggccttgacgatggcggcggcgcgcttggccgggtcgccggacttgaagatgccggaaccgacgaacacgccttcggcaccgagctccatcatcagcgccgcgtcggccggagtggccacgccaccggcggcgaagttcacgaccggcagtcggccgttgtcgtgcacgtaacgcgccagctcgaccggcacggccagctgcttggcggcctcgaacacctcgtcgtcacgcaggccgacgagctcgcgaatctgcttgttcatcgtgcgcatgtgacgcacagcctggatcacatcaccggtgccgggctcgcccttggtgcgaatcatcgcggccccctcggcgatgcggcgcagcgcctcacccaggttcttcgcaccgcacacgaacggtacgtcgaactgtgtcttgtcgatgtgatagacgtcatcggccggcgaaagcacttcggactcgtcgatgtagtcgatgtcgatggcctgcaggatgcgggcttcagcgatgtgcccgatgcgcaccttcgccatgaccggaatggagacggcctcctgaatgcccttgatcatggccgggtcgctcatacgcgagacgccgccggcggcacggatatcagcggggatgcgctccaacgccatgaccgcgcacgcgccggcgtcctcggcgacccgagcctgctcgggagtcgtcacgtccatgatcacgccgcccttgagcatctgcgccaggttcttgttcagttccgctcggttttcagccattgagggttctccttccatatgctgcggcgatggccgtcgcgacgactgtcgtcatcgccgtcattgttgccgttactgtattgtctatattgccattgttgtcgttgcctcgaccgcccgcacatccccgggatgcgccggcggcacacaaggcaccatgctagaggcgttcccgccgcgaacacgcgcagcggctcatttccggcgataaggaaaacctataatccgttatcagccggccatgctgcaccgccgcgcgggaacaccgtccgcccgacgtccgccaccgcgccgccgccggcctgcgccgcgcggttgtgcgcgacgacaaaacccgacgccgcttttcgtgcccatgcacaacaccgcaggaacctacggcaacgtacccttgacgatggaatacgtatcaggacatctgcaaaggaaatccacgatgccacaggatcaggcacaggatcagtcgaacgcggcccaagccgccaagccggcggatgaaccggcacccagtatgacggcaccggccgcgcggccggtcggcaccgctgccgttccgaccatcatcagcgaatacacctcccccggcgacgtcgccgtgaacgacgacgagacactgtactcgctgctcaccgaacgcatcgcccgcaccggcaatgcgaccaccatcgcggcgcgcaagaccggcccgggcgcgtggtcgagcatcaccaccggcgagttccaccgtctggtgctcgccgcagcgaagggcctcatcgcgttcggcatcggcaagggagacgcggtgacgctgttctccgccacccgcttcgagtggggcgtgctggatttcgcgctcgccgcgatcggcgcggtgaacgtgccggtctacgacaccgattccgcggcacaggcggagcgcatcatcaacgactccggcgtgaagctcgccgtcaccgataaccgcgaacgctatgaccgtctcgattcgatcaacgaccgatgccccggcctgcagcgcatcctcatgatggacggcaacgcgctgggcgctttggagggattgggcgtgtcggtctccgacgaggagctggaggcgcgcatcgccgacacccatgccgacgacctcgccactatcgtatatacgtccggctcgaccggcgccccgaaaggcgtggagctcacgcaccgcaatttcctgtcggtggttcgagccggatacgagtgcctcggcgaggtgctgtgcgacaaccatccacggctgctgctgttcctgcccctcgcccactgcttcgcacggtacatccagtactgctcgattggctccgacgatggcgtggtcggctatctgccggatacgaagtcgctgcttcccgacctgcgctcgttcaagccgacctatctgctcggcgtgccgcgcgtgttcgagaaggtgtacaacgccgcgtcacgcaaggccggcaccggtttcaaagggcgcatattcgcgcaggccgcccagtgcgcccgcgaatggtcgcgcaccgagcaggacggaggcaagcattccgccagccagcgcgcccggcacgcgatgttcgagacatcggtgtaccgcgcagttcgcggcgcactcggcccgaacatccggtatgtggcgtgcggcggggctccgctgagcgccgatctggcgcacttcttcgccggcatcggcctgccgatgatccagggatacggtatgacggagaccgcggcaccgtttacggtgacacgcgtgaacgacaacaagatcggcacggtcggccagcccgcccccggctcgtcggtgcgtatcgcggacgacggcgaggtgcaggtgcgcggcgcgaacgtgttccgcggctatcacaatctccccgagaaaaccgccgaaacgttcaccgccgacggctggctcaagaccggcgacctcggctcgctcgacgaggacggccggcttatgataaccggccgcaagaaggacatcatcatcaccgccggcggcaagaacgtctcccccatcccgatggaggaggagatcgccaagtgcccgatcgtcgagcacgccgtggtcgtgggtgacgggcgtccgttcatcggcgccttggtgacgcttgacccggaaggtctggcgtcgtggctgccgaccatcggtcagccggccgacttgtcgctggccgacgcggcagcgctcccgcaggtgcgcgaggagatccagccgttcgtcgaccgcgcgaacgcgacggtctcgcgggccgaatcggtgcgcaagttcgtggtgctggatgcgcagttcacccaggagaactcctgcctgacgccgtcgctgaaggtcgtgcgtccggctgtgaaccgcgtgttctccggcgcgatcgaccaggagctgtacgccggcaagcgctgaccaccgggccgcataaccgaacgaggggtgatgcgaacgtgccgtctggcacattgatatggcctgttttttgttccgctcttatagtggggcggcttgcgccgcttggctcgcataatacccggtttcggtccgtcccggtgtccggtagcccgaggaccggcgaggcgggttcggcgccccgcctcgaacccgcgttccgcgaggccgggcccgccgcccgcgcccctcgccggtctggcggtgacgggcatcccgccgcggcgcacgccgcggattcccggttcccgcacgacgctcgtcacccggccgcggccgatcccgaccctgaaacggtccctgaactcgtcgacgtacgcgaccatcaacgccgtgccgggccgagccatgccgcgaaaaaagccgccgccgtcgtcaatatctcgttcgcccgcctcaatcgcccggcggcactcgtcatcatccagcagcgcgagtccgccccggactccgccgaccagtttcactgccttgctatgcctacccatagcttcattgcacgtactatgcagctactttgcaaatcaaaaccaacacgttggtctaacagacccaagaaaaacgcgcgatcctcggtcagcggttggcggcggggccgagcgacgaacgcttcacgacttctgcggggagcagaccgacaccatgtgcggacgcgggcaacgccacttcgtcaccttcccccagcagatgcagcacctgccgcatcgcagcgacgcccaacgcctcaaaatcaggccgaatcgtggtcagaggcggaatcatgttgtccatcgccggcatgtcatcgaacccgaccagactgacgtcacgtggaatgcgaacaccgtgctcatacagggcacgcgcgacgcccaccgcctgattgtcgttcgccgtgaccacgaccgtcggcaacttgccgccctgattgccgatggaatcgagaatatggttcatcctggcgtacgcctcggtcgactcccaggtcttgcaacgcaccgtgacggaactgatggagcgggcgcgggtcagtttcacccaggcatccagtcgcgtcatcgcaccgcgccaccccaacggaccggcgaagtacaacgcccgcttgtgaccgtattcggtcagcatgcgcaccacatcgcccatcgcactccactggtcgataccgacgatcgacacgcggtcgcgctcgcgcgagtgaatcaggcgcagcccttcgctcacgctgagttcgccgtgcgtggaggtgatcatcacgcgaggctgcgtcagctgcgtgtagcaggccgcttcgaacatgacatcggtgggcgtgagcatgatgaacgcgtcgacgttctgctcgttgaacgtgccgcacaggttctcgaactccgcccgcgtgcacagcgcctcatgcaccatcatcaccgacatgaacaggccgtgcttgcgcgccatcatctcgatcgcggaaatcgccgaaatagggccgtagaacttcatgccgcctgcgatcaggccgatcgtgcgggaacggtgcgatgcgagcgctcgcgccgagttgctgggacgataatcgagcgccttgatggcatcctgcactttggtgcgggtggcgtcggagacatcgggagaatcgttgatgacccgggacaccgtctgatgactgactccggcgagcttcgcgacttcgaacatggatgggcgtttccgcccgcttcgcttggccgtcacgctgtcaaacctcccgctgcataacaacacaatatgggcaagtctacccggtaacgcttaaataacacacgtgagcgctcacaaatcatgcgcaggtaacagattcgccactgcgctgttcggattcacgccccggacttcttctcacaaagaactgtggcactacagcgcccgcacctgagacaaagcaccgagtcagataaccgggccgggccaaattaagccgcgccatgccgagctgcgcgacgcaggcccggaatcagccgcaacgccgcaatcaggtcagatgccacgtgacccgatgcagcggcgtgactcccagacgggcgatggcgtcgcggtgagccgccgaaccgtatcccttgttgtgcgcccagccgtacggcgcgtaccgcggattgccctgcgcgatgtcaaccatcaggtggtccctcgtcaccttcgcgatgaccgccgcgcaggagacggtcgcacaatgacggtcgcccttgaccttgcacgacacctgtaccggaatcggcaacgccggcgcgtcaaacgtgttcatcgtcttggtgatgtaatcgttcggaccgtccaggatgacgtccacgcgacgacccgaaccggccggcccgtccatgccgagctgccgctccacatcgttgagcgcccgcaaggcggcgatgcccaacgcatgcgatatgccccattcgtcgatttcggcgttactcgcctgacctaccgcgtaagcggcgcaccacgaacgcaactcgtcgacgattccttcgcgcctgtgctcggtcagcaatttggaatcggcgacaccggccggcacttgcgcggcggcgaggtcacgtgaccacatggcggccgccccgaccatgaccggaccggccagcgccccgcgcccgacctcatcgcagccgatcaccacatcgcagccttgggcggcaagctgccgctccatatcaagcgtcggatgttcgatcatcgccatatcaccatccgtctgatgtcactgcgccttgccggcgggaacgtccttgaacacatcatgatgggagctcaggaaactcatccggttcagcggccaataccgcatcagtcccactccgaccacattgtcgatgggcaccaagccatgatcaccgtcgtcctgatggtatcgggagtcggctgagctggcgcggttatcccccatgacgaaaatatgcccggcggtcacctcgacgcggaacgagaaactgctcgggtcgacgccggatttgatgtatgacgtctcatcaatcgcgacgccgttgatcttgaccggctgcccggcaccgccgcactcgaccacgtcgcccggcaagccgatcaggcgtttgatgagataatcgcctttgcctctggtggtctcctggttcagccagttcgcggggtcgtggaacacgacgatatcgccgcgtttgagatcgaaatatctcggcgtgagcttcgacgtgatgacccggtcgccgatctcgatggtatcgcgcatcgatccggacggaatcacgtaaaagccgatcaggaagatgcgtaccagcagtaccgccacgaaggggacgacgcaccagatcagcaggtctcggaacgagaacgaatcattgttgtgcttaggcgaggtcttgcgatgggcacctttcctgcggcgggccaacgagtctcggccgtcggtgcccactacccgccccggcatatcggtggggtccacgccatgatcggctatggcgacgatccattcgtcccggctgaattcggtgccggaaccgggcatggcccgatccgtccgatggtcgtctggccgcatagttcctccatcacgcatacatgaaaccccaactatactagcggcgttcctataaattcagcccggaaccaatcggctccgggctgaatttcacggtactgtcgcctcgcttggcaaaactcaggcctgagtcgccttggcggagttgtcgcgacgctcgacgatgcgagccgccttgccgcgcagcttgcgcaggtagtacagcttcgcgcgacgcacgcggcccttgcgcaccagcttgatggagtcgatggacggggagtgcagcgggaagcggcgctccacgccggtgccgaagctgatcttgcggaccaggaaggtctcgcgcaggccggagccctgacgagcgatcaccacaccggtgaaggtctggatacgggagttgttgccttccttgatcttgacgttgacgtcgacggtgtcgccgggacggaacgccgggatctcctcggcgggcttcatgtgcttggcgtcaaatgcctcaacagcgttaaccattgctattccttagtcgctgccgcatatcagcgcactggtttggggttcggtgatgactggcatcacgaacacgtctgtaactccctcgggtctgccctcaggaagcctgtcaatccgccgaaacagcggctttgcgcccgttcggtctggactcatgaagaggcggcttatgcggcggccgaccctcgacacagcaaaacaacattttattgattcatatggacgagacggaattgacatcaacttcggccgggctccgtaacggaagcctcccgttcggccgacggaacgagccgacacgcccggagtgtgcagcacaattgttgggtatcgccatgcgaatggtgcgataaagccaatcgcgatattgaaccgcgacgattgtgctacgcactccgggcgtgtcacaagcacagccccccatacctcgctcgcagccgaaaccaaatcacaatcccctcatgtgccccgtcgtcagtgctggccgtacacgttctggtaacggtcgttcagcttgtcgatgtccgcctgcggaatctcgatgatgtcacccagctgacgggcggcccacatcgtatgagccacctcctccgtcatcgccgcggccttcaccgcggcctccgcatccttgccgatcgtgaacggaccgtggttctgcatcagcaccgcctgcgacttcggatatttcttcagggtctccaccacgcccttgccgatcgcctccgagccgatcagacggaacgggcccaccggcaccgggccgccgaactcgtcacccatcatcgtcaggccgcacgggatgttctgacccgtcgccgcccacgccgtcgcgtacgtcgaatgcgtgtgcaccacgccgtacacgtccggcatgttgcggtagatgtacgcgtgcgacgccgtatccgacgaaggcgcctccgccccatccaccacgtttccgtccagatcgcacaccaccatgctcgacggcgtcaggtactcgtagcgcagacccgacggcttgatcaccatcagatccgccgaatgcagacgctgcgacacattacccgccgtccacaccaccaggttccacttgatcagctgctgatgcaaggccgccacgacctcacgcacctgcttgacctcagcacgaacctcaggaccaaaatcagccaacgaaaccataatcaccactcacttttcttattcgcacttatatatcgggacgttcatcaaaggcggtgccggcgcgccggcacccacgagcgggctcagtattctccgatgccggcgatcggctcctgttcgatgcccaccacgtcgaacagcccgtcgaacatctttttggcccgagtcacctcggccaccggatccggcgactcatcggtccacatctcgaccgtgtagctgccctggtatcccagtcgtttgaagatacgcaggcacgcctcgaagtcgaccgtcccctcaccgaagggcacccgtttgaacacgcctttcgaggtctcgcccaccggcttggtgtccttgaggtgcacggcgacaatgttgtcgatgttggattcgatctcgcgccccacatcgttggtgggccaagccgtgaggttgcccacatccgggtacgcctgcagccatggactgcgcacttgcgacttgtaataggtgaccttgtccagcgagttgatgaacgggtcgtccatcgtctcgatggagagcatcaccagtttcttcgcggccatgtcgacgcatttgcgcaggttctcgacgaagtattcgcgagacagcagggttttcggctcgtaatacacgtcgtatccggcgagttggatgttgcggatgcccagatcgacggcgaggtcgatcgccttgcgcatcatgtcgagcgccttctcgcgcacctcggggtcttttgacccgagcgggaaccgcctgtgaccggagagcatcatggtgttgatgcggctgtgggtgcgccacatggcgtcgcggaaccgtgcccggtcgtgctcggtccagtcgagacgggccagtcgctcgtcgctttcgtcgaccgagaattcaaggaagttgtatcccagctcatgcaccagatcgaacgtctgctcccagctcaggccgcgcggcagcgccttttcatatattcccagcgcgttggtgaccatgtcagcgctccagcgagttctgcatgtcacgcagcgcggcccatccgccgtcgagtgcggtcagcagcgcctcatacgcctcgaacttgcggtcgtacaccgcggtctggtccgcgtgcggctcgaaccgcttggcgagcttcgacatgttgccgaacgcctcctggaacgacccgtacaggcctgatccgaccgccgcgcacatggcaccgccaagaccgcccagttcggttacggccacggtctcgaccggcaggttgagcacgtcggcgaacatctgcacccaaggatcagaattgcatacgccaccggagatgcggatggccttcggcttgtgcccgagcacgcgcagcagctgctcgacatggtggcggtgggcgaatactacgccctcgtacacggcccgcaacagctggtcgcgctcgctggagctgcgcagtccgatgaacgcgccttccgcgcccaggttcacgttgctgccgtagaggaacgggaggaacagcacgtcggtgtacttggcgtcggtacgttccagcatcgctccgagttcgtcgtagctggcggccttggagccgtctgccgtcatcatgcgcagcacgtagtcgaggttgccggcggaggtcgggctggacgcctcgaccaaggtgccaccggtggggaacacggagttcatgcagccgccgtcgagcggcgccatggtcttgctggggaacacgttgatgttccacgttccagcggtgatgctgaagatatcgtcgctcagcacgccggtggcgagcgcgcaggcgtcgatgtcgaacagtccggcatacacgggagtgccttcggcgaggccggtgttcgccgccgcttcggcggcgatggatccgcagcggtcggtcgcgctgacgagcttcggcatgcattccagcatttccgggatgccgaagaagtcgaacagccggccgtcatattcaccggtttcgaggttgaccagattgttgccggaggcgtcgccacgctcctcgaggatctcgccggtcaggaagtgccggatgaagtccttgttggacagcacatgcccgatccgcgcgtactgttccggctcgttgtccttcagccagcgcagcagtaccgggaactgcatgaccatgacgtgctggtgactgatcgggtagatttcggcgacgcggctctcgaattcgttggccaggtccgcggcgcggctgtcggaggagaggatgccgtccatgaacggcttgccgtccttgccgagcacgtacagccccttgccgtggccgaccggtacgacgccgtcgatctggcttccatccagtccggcggattccagcgcggccttgaccgccttgccgatgtcacgccacatctggccggggttgacttcgcggaagccgggacgccgctcgatggcgtcggtcgggaacgacgagacggacagttgccggccatcctggtcgacgatgatgaccttggtgttggttccgccattgtcaatggtgaggaaatgcttcgttgcgtttgtcatgatgattccttattgaatatgtgccgatgatatcgcagccgctcaggcgatcatgttgaacagttcgccgatcttgacggcgacccagccaatccatgtgctcactgcgccggtcatgttggtgacggcggtgaagtccttgggcaggtcgatgttgctctgcgtgaacgattgagtgacccagggcgcgatatcggtgccgacgtagaggatgatgatgacgctcagcgtgccgacgatcagcatcttgaacatgttgcggcgcacgaacggggtgaccagcgcgaggatgaacacgagcgacgcgaggtcggcgaacgggagcatctcgttgccgggcaggatgaaggcgagcagaatggtgatcgggatgagcagcagaccggtggcgagcaccgaggagtcgccgatgagcagcgcggtatccatgccgatgtagaactcgcggttggggaaccagatcttgagctgcttctcggcggcgtcacgcacggaaatcaggccttcgatcagcacgtcgatcatcttgggcagcagcaccatggccgcggcgatgttgatggcgagcgtcacggacttgtcaggactgtagccggcgagcacgccgatgagcagaccgaggatgaaaccgatgaccacgggctcaccgatggcgccgaagcgcttgcggatcttgtcggcgttgaagtcgacgttcttaaggccggggatcttgtcgatgatccagttgacggcgatggcgagcggcgaccaggccagaccggcaaggtgcgggaacgagatgccttcgaggttgtattccttctggatgtaaggcgcggtgaggtcagcgaccttcagcacgatggcgaagatgacccaggtgaagatgacggcgaaccagaagttgctggtgacggcatagaccagcgctccgacttgcaggaagatccagtagttgaagatgtcgacgtcgatggtcttggtgagcttgcagaacaccatgatggcgttgatgacgaggaagccgacgaccgtggcgaccatgatcggcgtgccccagccgaccgtcgaggcggtgggccagcccacgtcaaccgtagtcaggtgcaggccgaggcggttgaccatcgccttcgaggcggggccgaggttgtcaagcagcaggttgatgaccatattgacgccgacgaagccgacgccgacggtcatgccggccttaaaggatttgccgattcccatgcggaagatgagtccgaccacgaagaagatgatcggcatcatcaccgaggcgcccaggccgatgatggtgttgatgatttccataatgttcctttcccgtgcacgaggcaggctgcttcgcccgctgctctgcgttgttgccccgcactttccgtcggcgtcggtcttcgatgagccctgcgcgtcgacagcctctagctaacggcggaaaggtcttgcacaccacccacgcgatgaacacatgttcatcgaacacatgagagctgagtgagcacatgtaatcgaccttcttttttgcaatcgattgagagcgctcacatatcaaggattcattgagttctttcgcgctctgaacaattgttcagcatcgttgctgcactggaaaaactaacatatgttcaccggccacaccggatggaatagaataatgccatggttgcaaacaagctgacaatgacgacaactgagtcgcgaaaccacatcgagctcgtgctgaaaatcgctcgcatgtattacacggacaatctgacgcaggcgcagattgccgcgcagattggatactcccgccccaccatctcgcggctgctcagcgaatcgcgcgaccggggcatggtacgcatcgagatcgggcatccactcgaacgtctgatgcagctggaggacgcgctggtaagacggtacgggttgaaatgcgcacgagtggcgcaggtcaatcccgggcaggatcccagcaccatcgtcccccgatatgccgcggccctgcttaccgaaaagtcgtcgcccgactcgctcatcaccgtctccaacggacgggccgtcgccgccacggtccgcgaagtcgccatccaggactggccgaaatccaatgtggcgcagatggtgggcgccctctcccccagcaatccgatgacggattcgcccgacatctgccgcatgctcgccgaacgcctcggcggcaccgtcaccacactccacgtaccgatgatcctctcctccgcccatatcgccgcggccatgcgccaggagccacaaatcgccaccgcgctggcgctcggcggcggcgccgacgtggccctggaaggggtcggtgcgaccgaaggcgaccgcctcagtccggtgttcgacgcctatgtcacaccacacatggtcaaggaaatccgggcgcagggcgcggtcgccaccgtatgcgggcacttcatcgacgcgcagggaaggcccgtatgttcggagctgtccgaccgtatcatttcggtggagctcgatcgcctgaagcgcatcgcgctggtcatcggcgtggcatgggggcaggaaaaagtcaaggccatcaaggcctgcctggtcggcagctatatttccgccctcgccaccgaccaagccacagccgaaagcctgctcgcctgacatccatccgatcctgccccgccggcggggcaggatatggcccggcgtagtttgggcgcgacactacggagttgacatggtctgccggcggttttaccctgagagcgtcggtaggcgaggctaccgcagggatatgggttgctgccgctaacagtggagacactgcacgcaggtcagcagttcttgtcggattaaggcatgaactaacgcaactccaccgccctgcgatgctgaagcttgaacgatgacacgaccaggggcaactctcgagaagtcgcacttcctcatgtcgtcaatgtccgacggcgtactggatccattgaggaggtgaatgtcatggacggcgatttaggtcatagtagccggctgcgcgatggcggacaatatcacatgccatcgggcgcagcatacggcccattctcttcacacgtttgtaccgcgaccatggcattggccgtccgtcacgacaccgccgcatccggcgagggcgatccgatcactgactgattcggcccgcatcgacttcaccgcctcacgacgactgcgacatcccgcatgacgtacgcgccgaacgcctgactcgcgaatccacatcccgttctccggactcccggcatatcggcatcatcatatgacgacgccgatcggctatctgtatgcagacatacccgcatatcggcgcgcctgcacgcgaccgccgacgcccatgacgcgcatttgcggcacggataccgagtcgaacgcccaccgaacgggaaccgtttatctccttcgagataacgacatgagagcgcacaggttccgttatgtccaattttttcaattactcctcgttccccggcattcgtccgcgttccggcgccgacaccgccgacatgtcccgcagcggcgccgtgcgccgcatcgccgcagacgtggtggtggccgcgggcgtgctcgctctgttcggcgtcgtcgcctggctgctgccgcaaatcaacgaaccgatcggcccgtcaggtgtgccgagcacggtgagcgacgatttgcatctgctgccgtattacgcgctgcgttcggtgttccgcatgttcatcgcgctgtttttgtcactggtgttcagcttcatctatggtttggcggcggcccgatgccggcgactgcgcatggtgctgataccgctgctcgacatcctgcagtcggtgccgatcctcggcttcctgtccgccacggtcaccatttggatggtgttgttccccggctccattctcggcgtggaggcggcgtcgatcttcgcgatcttcaccagccaggcatggaacatgaccttctccttctaccattcgctgctcagcgaaccgcaggagttggatgaggcggctcgttccatgcagctcacgcgctggcagcgtttctggaagctcgacgtgccgaattcgatgattccgctgctatggaactgcatgatgagcgtcggcggcggctggttcttcctgacggcctcggagatgatctccgtgaacaacaggacgtacgcactgcccggcctcggcagcttcgtggcggtggcgtccgagcacgaacagctgggcaaggtgctgtgggccatcgtgaccatggtcatcgtggtgctgctcatcgacgtgctgctgtggaagccgctgacggcgtgggccgagaagttccgcatcacgcagaacgagtccgtgcaggccaagacgagtttggtgctgtcgattctgcggcgttccggcatttcggatgcgctggctctcgtgggccggcccatcgccgatctgatgttctggctgacccgcccgctgggccgtaccggcgcacgctggccggccgccggcacccggcgtcgcacgctcgacatcgcgttcatggcgctcatggctgtggcctgcctggccggcctgtggatgctggtgcgtttcatctcggacggcgaggggttcgccgaggtcggccacgcgatggtcctgggactgatcacgttcatgcgcgtgacgctgctgaccgtggtgtgctccatcatctgggtgccgatcggcgtgaagatcggcatgaatccgcggatttcccggttcgcgcagccgctggtgcaggtgttggcgagcttcccctcgaacttcacgttcccgttcgtcacactgtggttcatcgcctggcatatcgacatcagctggggcagcattctgctcatgtcgctgggaacgcagtggtacatcctgttcaacgtgattgcgggcgcttcggccattcccgatgacctgcgcgaggccacgcgggcgttccatctggacacgcggcagcggtggaccaagctgatcctgccggcggtgttcggctcatggtgcactggcggcatcaccgcggcgggcggcgcgtggaacgcctccatcgtctccgagatcgtgacctacgggcacaccacgcttacggcaaatggattgggaacatatatcgccaatgcgaccgcggtgggagacaccggcaagaccatcatcggggttgccgtgatgagcgtgttcgtcgtgggcgtcaaccggctgttctggcgtccattgcaggcgtacgccgagcgccgtttctccgtcgcctgacggaggccgcaccggccgtcccggcccatcgacccgcaacaatccaacagcatcggcggcgagcgcatgtcattcgaatccgccgcgatcatccgcaaaaaacgtaacagcaaggaccatttatcatgaccatcgcaactttttccgaccgcaccgcaaccttcccgcagaccgccgcgacgaacgccgccggcaccgcgatcatcgaggcgcggcacgtgggcaagacctaccgtgccgagcgcggtaaagagctgaccgtgctgcgcgacatctccttcaccctgcatgagggcgagatcgtggcgatcctgggccggtccggcgccggaaaatccacgttcctgcgcatcctggcgggcctggtacccgcgtcgagcggtaccgtcacctaccgcggcaccgacatcaccggccctaatcccggagtgggactcgtgttccagaccttcgcgctgatgccgtggctcacggtgcaagcgaatgtggaactggggctggaggcccgcggcgtgccgcgcgaggagcgccgtcgcgctgcactgcaggccatcgacgccatcggactggacggattcgagaacgcgtacccgaaggagctctccggcggcatgcgccagcgcgtgggcatcgcacgggccctggtggtgcagcccgatgcgctgttcatggacgagccgttctccgcattggatgtgctgacggccgagaacctgcgcaacgaggtgctcaagatgtggagcggcaatcagcgttccatcaagtcggtgctcatcgtgacgcacaacatcgaggaggccgtgcagatggcggatcgtgtcgtggtgctcggctcgcatcccggtcatctcatcgccgacgtgcccgtcaccctgccgaggccccgcgaccgtcattccgcccagttcgaggctatggtcgacaccctgtatgcgatcctgaccgggcagagtcgcgatggcgggccggcggataccgccgacgagcgcacggccgccggggacggcgtcgcgcatggcacgtcagatggcgcggcgaaccagaccacggcagcggatcaggccccggcccgggcgagcaacgccgaccatcaggcatcctccgacatgctgcccaacgctacgccgggaggcctggccggactggtggagatcgtatacgatcacgcgcagggcatcgacctggccgatctggccgacgagctgtcattcgaggtggacgacctgttcccgctgatcgacgccggaaccatgctgggattactgaccgtcgagaacggacacgtgacattgaccgagctcggacgccagtggaggcaggcggacattctgacaagcaagacgatgttcgccgccatgctgcaagacaaggcaccgctggtgcgcatcatcgaccgagcggtccgtcacagcgaacacggccgcctgcgcggcgagctcatcgtcgacctgctgagggcccgtcatacggacacggaggcggagcgccagttcaacatcgccatgacgtggggtcgatacggagaactgttcgactacgacgccgatgacgacatcatcaccgtcgacgccgccaacccggcaaacgccacccgaccggccgaggaagccagcgaaacggactgagttgacccgcctcagccaactgccgcaatggaaacaacgatcaacccgacagcggaacggaccgccccgaatcgccaaggaggaatcatgaacacgctacgactgatacgctggcgcggcgaacgccacgccagcatcacccagcgactgtatttcgccgcccatgccacgccagaggccacgctcgccttggtgtatgcgcacgaatccggcttggaacccgacgaggttcgccgggcgcgtcgggcttacggcggcaacaccataccggcgcccgacgtccatgaatcgccggcgcggcggctggtcagggcgttcatgaacccgttcatcggcgttctgatgttgctggcgctcacctcgttcgtgtgttcactggcccagcgcggaatcgtgacttcgggcaccactgcggcgaacggaggcggcacgccggtgaccgtgggcatcatcctgctcatggcggtggtgtccggtctgatccgatacgtgcacgactcccgaagctcgcatgccgccacggcgctggccaccatggtgagtaccacggcgacggtgcggcgggtcggtgccggcgagcggcagattccgtccgaagagcttgtcgtgggcgacatcgtgacgttgtccgccggagacatcgtcccggccgactgcaagctgctggagagccgagacctgcgcatcgcgcagggggcgctcactggcgaaagcatgcccgtgcgcaaggatgctgccgcactgctcgccgccggcgccagggacaccgcgttgacggacgcggcgtgcctggtgttcatgggcacgacggtgatttcgggttccgcgttggcagtcgtcatcgccacaggccgcagcgcactgttcggcggactgtcacgcgcgttccaatggcagcggccgcgcacgcgcttcgagcgcggcatgaactccacgtcctggatgctgatggcgttcacggcggtcaccgtgcccgtgtccatgctggtcaccggcatcgcgagcggcgactggctgcaggccctgctgttcggcgtatccgtggcggtggggctcacgccggagatgctgccgctgatcgtcaccgtctgcctgtcccggggcgcgcggacgatggcctccggcaaggccatcgtcaggcggctcgacgccatcgagacgctgggcggcatggacgtgctgtgcgtcgacaagaccggcacacttaccagcggcgtcatcaagctcgaccgggcgcagagcatgagcgggttgaactcgtcctacgtgctgcatgcggcatggctgaccacactgattccccacacgacgagcaatccgtgggatgacgccatcgtcgcagccgaaggtgactcggcaaacgataccggcgacgtacaggtcgagggaggcacgcctttcgatccgatacgacgccgggcgaccgtcatcgtcgcgaagagccatcaccgcgcggaccgcgagcacacaggtggcagcgatatcagtgagaccagcggcgccggcgccggaacgtccgggaacgtcagccgcatcatggtcgtcaagggcgccgtctccgaaatgctgccccgctgcgacaccgtcatgcgcaatggaaccgcagagccgctgaccgatcgactgcgcggaacatataagcggctgatggccgacaaggcgacgcacggataccgcgtcctgctcgtggcgcagcgctctgtgacagaccagaccacagtgcaggacgaccgcgcgctcaccctgctgggctacctcactttcctggacctgcccaagcccgatgccgccgacacgatcgcccacatgcacaatgccggcatcaccgtgaccatgctcaccggcgacgagccacaagtggcccgtaccgtcgcccggaaagtcggcatcaatgctcgacgggtggtcaccggccgaacgctggacgacatgacggacaccgcgctcggcaccgaactgcgccgcgtgaacgtgttcgccaagctcactcccgagcataaggcgcgtatcgtctcactgctgcgccgcgaggggcattgcgtgggatacatgggcgacggcgtcaacgacctgccggccatgcacgccagcgaaatcgccatcagcgccagcaccggctccgaggccgtccgacagtcggcggatgtcatgctcacgcacaagaacctcgacgtgctgctgcgcggcatcacgcaaagcaggcgcacctgcgtcaacatgatgaagtacatcaagctggcgctgagctcgaatttcggcaatatcatctcggtgatgatcgccggcgcgttcctgccgttcgtgcccatggcacccgtgcagatggtgctgctgaacctcatatacgacctggcctgtctcgcgatcccatgggaccgcgtcgacggcgatgtcctgcgctcccccgcccggtgggacacggcgtctatcgcccggttcatgagtcgcttcgggccggtgagctcgctgttcgatatggtcaccttcaccgtgttgctcaccctgctctgcccggccgtcgcaggcgggaggttcccggagctgcacggggatgggtcgcgtctgctgttcgtcgccgcgttccagacgggatggttcgtcgtgtcgatgtggacccagatcacggcactgcacatgctgcgcaccgaacgcgtcccgttcatcgggagccgcgcgtcggtgccgctggtctgcacgtcgctcgcggcgctgactatcgccacggcgctgccgttcacgccggtcggcgcatggatgggtttccacgtacctccggtgtcgctgttcgcgctgctcgccatcgtcatcgccggttatgccgtgacagtacttgccgtcagaaccctgtatctgcaccgtcagcagccgctgctgtgacttctgaccgcccggcgctcctgcggaaccgatggaatccgcaggagcgccgggcgggcacccccgcgttatcatcctctccccgtaccaccaccgtctcccgcatccattcaaacgaaggaactgatcatgacagtctggaccgcaatcgtcacatcacaggtgttcgccataaccctgcgcatcctgctcagcatcgggctcggtgcgctcatcggattggaacggcagctgcgcgcacgcagcgcgggcatccgcacgaacgcgctggtgtcgttgggttcctgcctgttcaccactgttggcgtctatacgctcgcggccggcaccggagaccccacgcgcgtggccgcgcaggtggcgtccggcatcggcttcctcggcgcgggcgtaatcctcaagcagggtgtgtccgtgtccgggctcaacaccgcggccacgctatgggcatcggcggcggtcggcacgttgtgcggctccggcatggaagcggccgccgcaatcggggccaccgccatcatgctcgccaacatgatgctccggccgatcggcgcggccatcgacgcccggcgcaccgcgcaatcgcatgaggccgagggcatccgttacacccttgaggtcaaatgcctgcgtaaggacgagcaggccatccgcgcgctggtgttcaacgccctgcatcagcccggtttcatcgtccagtccatcgcggcttcggatcttcccgatgatctggtggtcatcaccaccgtcgtcgccacccacatgagcagcaacatcgacatcgaaagcagcatcgaaacagtcatcaccacgcccgaggtcctcggcgtcaaatgggatgccgagcaaatcaccgccgtggattaaacgtgaccgtcatgaatccgcgtcatgaatctgcccgccgcgaatgatcagccgcgtggctcgccagtgggaaagcccgcctgcgttggtcggaatactcgtgaagtaggtcacgttgtccaccttgacgctctggtcggcggcacggacccagctgccgttagcggagcccttctcgaagacgacggcgttgccgccgctgtcgctgacagagaacagggcgccgccgatgccgttgtgctgcttgtcgatcttcttcatggtgaagaatcccagcttgacgaccgtggtggcggcctcggaatcggcgccgccattgtaattggcggtcgcggagttcgtcacctgatcgtcgacggcggctttggcgacgacggcgttgtacagcaggacgagcttctgcccatccttgccggccacggcgatggcctcgcgaatgttgccgtcccacttgtcgctgtccacggccttcaggccaaaggaagtcagcttgcccgtcggcattcgcgaccgggtcgatgtacgcggcgatacgatatgccgtatacgtgcttttcgatgtatcggcatcatcggccttgttcagggtaatggttgacggcgtggccgtttcgggcactgtgagcgtatcggtatcggcattgaccgtcatggtccccaaggccatgccgcccaaggcagccgcaaccgccgcgacgccggcgatgagtttcttgaattgcataggaaccttcctgctccttcatcggctatttgaatccccggcatgacgagaatgagtcatggaccggcgattcctgtgttcctgtcatagcggacgagtccgccatgttgtggagcctgtatccttcaccacaaattcgctcgcgggcttctggccccggcgtctaccgcaatgtgaacgtacccatcaccttgtccggggcgtattcggcgaagtcgtcgctggccgccgcaatatggctttctccgcgccaatcggtcaacgaccagctgtcccagctcatggtggcgccggcaatcccgccgtcgtccccgccgatatcgacggggaccggaaccacgatggattgcccttcggcgagcgcgatgtcgtccatgattccgctgatgcgtccgagcgtcgtcttgcccttcttgagatcgaacgtcaggttcagcccgctgagcgtgccgggcacgtggctgcgcacggccacggcgatgatgcgctttccggtgtccacggtcgacccgccggcatccgccccctgctggatgccccggtcctcgatgcccgtgatctccagcggcgcggacggcgcctcggcggcgggcagcccgagcttgccgcgcaggtagacatccgcttcgctgacgccgtaggcatcgagcgagatcagctcgtcgctggcggacggcgtgaccgagtcggcgacatacgaggcctgccgggccttggcgtcgtattcgttggcgacgacggccgccgcattggcgacctcatcgggccaggtgcgtgaccgcagcgccttggcggtggcgcgcagcacggtggcggcctttcccgcggcggccctcgtggccttcagatcaccgccgtacaaggtgttcatcgcgtcgcgcaacggctggatcgacggcttgacggcttccagatagtactgccccgcgtccttctcgctgagcctggcccccttggcgggatgctccgaggtgtcggacgtgttgacaaacggcgcgtcgccgtccagggcgtatttggcgtcctgcgggcacaccacgcccgtgatcgcggtcacgatgccgcccggatcgccgccgaacatatacccgacacccagcgacgcgcctatggcgacgcccatcgccacgacgatgcccaccgccttgcgcaccgggtggtaagtcatacgccggagttcggcgtcggcttcgacgacggcctgctcatgggtgagcggcatatcgtcgtcatcgatgccgtccgcatcggaaccgtgccgactgtcgtgtaaccttgccatgcataacctcgctagttgtacagtgaactggagatgctgatcaggtcaccatcgcccagcccttcccatgtcgcgctgttggcgaactcgaattccaggttgaagctctgccggttcggcgccaacatcgtgccgtaccggccaccgatacgccaatgccgttcctgggtggagtcgagatagcctccccactggtcggcctcggtgtacagcacggtcgtgtcgtagagcaccgcccggaacctgacggtcagccggttccgggacaggtcgaccttgccggtctgtatatagtcacggtcgaaatcgtctatggtaatcccgtgttgctcgcgcaggtcggacgccgcggcctggtcctcatcggacatgtacgaatcgtcccggccactctcgttgtcgtcgaccgttatctcgtacgcggtcacgtcgccgtatcgcttcacgaagtcgccccagctgtcgcccggctggacgccgcgggacgtgaccagcgcatgatcgcaatccctcttgtcgatacggcaccgtgcgccgcgcttgacgccgctgctggtggcgtcgtcgctgagaatcgtgtactggctggggtaatgccatgtgcgcgccgagctgatcggcttgcctgtggacggctgtcgcagcgaatattcactgaccggcaggtagccgatcggcgggttgtcatggaatatcagcagcgtggttttgtcgcggatctggagcccgaagaagatcaacgccaccacggccgcgatggccgcgaacacgacggccaccgtgcgatgcgattcgcggtcgatcgcggcgaactcgtgctccagatggcgcatcgcctccgcgtcgccttcgccggccgaagatgcggtggagtccttgggcttccccgcattgccggatttcccgaagccgcctggtttggcggggtccttgcgtttctcggcgttcccgccgaaccggccggacttgctgaagatgtcatcgtcgccgtcgaaatcatgttctgacattgccgtcacctgaccttgaacgcgttcagcacgtcatagccgcctgattggaccgcagtgaacgatgcgaggtgctgctcccccgccttgtcctccacataccatgccgacggcacgaaacggtcgccgccgcgcagcagtttcgggtcgatttccatggtgagcttcaccgtgtcccccttatggatgccgccgtgctcgatgatgtcgccatcgtcatcgaactggatgtcggagctggccctcacgccggtctcgcggatggtgccgtcttcgctcagaagattgaatttgatggacagccccgttatctcggccgggacctggtcggtcacggtgacggtgaaacagtgccggtcgacttcctgctgaccgccgtccttggcggtctccagtcccttgcaggctccgccgtcggcaatgtcccgtatgtcgaacgggacggccgtctccggctcgtcgggcagtttcagcgcgctgcggattacctgctgcgctccggatggcctgaattcgccgaacaccatccagtcgatcgcctcgccgttgcggttgccggcgaggttggtatagatcgccgcgcgctcctgatattcgatgatgaccatgcggatctgcttggtcagtgatttcggccaggtgcgggcggcgagggtctccgccgcctgttgcgagaggtcacgggccttggcggcggacttgttcaccgcatccttgtcgccgccgaccgcggcgaggcgcacggcgtcgtatgccgcggccgtgcctttcaccgcctttgcgaaatacgggccggcctgggatcggcccagctgagggccggacggctgcaacggcttgaacccgccataacagtagtccttctcgtccgcgactccggtctggtgcgaacagttgacaggggagccggtctggaggctgcgccgccagcagaatccactcaccagcgatgcgacgatgaccacgacgaccagcagcgtcatccggcggtgccgtttgcgcagcagtgtgacggcctcggcatcgacctcggcggattcggcgtcgtcggtgatgtcgtcggtgatgccgtgaatgtcctcggaggcatcgctcacatcgcgggtctcatcggcgaccggcgtatcccaactcttctgcgccttcatcaccaccatctcccattgcccgaatcccaatccgacataatcgacgccatcttatcagccacaacacaaccccgctaggccaatcccacgatgttaagcccggggactgtcgagcgaagcgagactggggggggtcaatcacagatatcccgacaccccaaatacaaggtcctcatgaaaatgtatcgattaccccaaagagtgcgcatgaaaatgcaaggaacactgcaatgaagcggtttcccacggctgatctcattgacccggaacaccaccccagttcacaggtcatagatataacgtcgcacggaatatatagcaatgtgccccagcatccgaagatgccggggcacatgcgtatcagagttcagctgctagagccgaaccgacgaatcagaactcgcgccatggacggtcgccagaccgaccatcaaacaacacagcgcggcgcgccaaccgcgagttctgattgaagcgacgcaggagcggagatcagaactcgcggttggcgcggtagaacttgatcagggactgggtggaggcgtcctgggcggcgagggcgtcgtcgtcctgggagatggccggggtgatctgcttggcgagctgcttgccgagctcgacgccccactggtcgtaggagtcgaggccccacacggtaccctcaacgaaggtgatgtgctcgtacagggcgatgagctcgccaagcgcgaacggggtcagagccacaccgaagatcgaggtggtcgggcggttgccggagaacacgcgggccggaacgatctcttccggggtgccttcggcgcggacctcgtcagcggtcttgccgaatgccagcgccttggtctgcgcgaggtagttgccgaggaacagctcgtgcacgtcctggtcgccgtccttggtcgggttcggggtgttgacgaacgcgatgaagtcggccgggatgagctgggtgccctgatggatcagctggtagaaggcgtgctggccgttggtgccgggctcgccccagaagatttcgccggtctcggaggtgacgggggtgccgtcccagcgcacggacttgccgttggattccatggtcagctgctgcaggtaggccgggaagcggtgcaggtactggtcgtacggcagcacggcgtgggaggcgaccttgaagaagttgcggtaccacacgttcagcatgccgagcagcacgacgacgttcttctcgaacggggtgttggcgaagtattcgtcgatctcgtggaagccgtgcaggaactcctcgaagcgggcaggtccgaagaccacggccagggaggtgccgacggcggagtcgacggagtaacggccgccgacccagttccagaagccgaaggcgttgttcgggtcgatgccgaactcggcgaccttctccaggttggtggagacggcgacgaagtgcttcttgatggcttcggcgttcttctcgtcggaaccgtcgatggcacccttggccttgagctcctcgagcagccaggtgcgggcctcacgggcgttggtcagggtctccagcgtggtgaaggtcttggagacgatgatgaacagggtggtctccgggtcgaggcccttggtcttctcggccaggtcgttcgggtcgatgttggagatgtaacgggcggagatgccggcgtccgcgtagggcttgagcgcctcgtacaccatgacggggcccaggtcggagccgccgatgccgatgttgacgacggtctcgatcttcttgccggtcacgccggcccacttaccggaacgcacttcgtcggcgaaggcgtagatgcggtcaagcacctcgcgcacgtccttgacagtgtcctgaccgtcgacgatgtacttgccctcgtcctcgaccgggcggcgcagcgcggtgtgcagcacggcgcggtcctcggtgttgttgatgtgcacgccggcgtacatcgccttggtgcgctcgtcgagcttgacggccttggcgaggtcggcgaacagctggagggtctccggcttgatcaggttcttggacaggtcgaagtgcaggtcgccggcgtcgaacgacagcttgtcgacgcgctcggcgtcatcggcgaaccactgcttgaggctgacgccctcggcctgcagctcgtcatagtgcttctgcagcgcggcccactcgggggtcttggtggcgtcaactggcggattgatggccatggtattggtcctttcatcatcactgtacgccggagtcggctctccaatgctggcgggccacaccggttacttcgcttaccaagatactcacaaaagcggacagaaacaaacaaaaatacccaagatgaacaaccgtgaccgacacgacatgcccgcgcacgacatgccagccgaacttgcataaatccacggcatacagtaaagtctcattcttgtgcgcaggttcatcaacgaatcggcagcatgccactttagctcagtcggtagagcggctcactcgtaatgagcaggtcgacagttcgattctgtcaagtggctccatacccctaggctccgcgcctagggttttgtatatccagccgtttcgacgggtggcacgcgcgagtggcgaaatcggtagacgcgcaggatttaggttcctgtgtctttgacgtgagggttcaagtcccttctcgcgcacgcggaaccatacctccgcaatcgccacagggaatagagaagcatgaccgcgatactgaaacccatagcgtttctgctcatcatcgtcgccgcgtatctggtcaagcgggcgggactgttcaagccacgcgactatcgcgtcatgcaggtggtggtgttcgatttcacgcttcccgcctccatcatcgtctcgttcgccacgaacccgcatcatctgagcatgctgctgatctcggtgttcgccatcgtcttcggcctgctgccgctgctgctggtgtatgcggcgacccggcacaagcccgtcgcggaccgcgcgttcctgatgctcaactgctccggattcaacatcggcaatttctgcttccccgtaatccagacgttcatggggccttcggcgctggtcaccgcctcgatgttcgacatcggcaattccgtgatcgtgaccgccggctcaaacgtgatgacgacgtcgctgctgcacatcgacatggaccggccgctcaccgaacagcatgcgggagccgcgccgacacttccctattcgaagccacgggacaaagacgcccgcaggctcgcccgccgcgcgaaggccaagcagatcctcaagggattccttacttcggtgccgttcaatatgtatctgctgatgatcgtggtcatgctcttcagcattcacatcccggcgttcgtgccgacgctgctgcagccggtggcggacgcgaactcgttctgctcggtgttcatggtgggcatgctgatggatttgccgcgcaccggcaaggatgtcggcagcgtgctgcgggtgctcggttggcgcttgccgctcggcgtgctgttcgcggccgcttgctggttccttctgccgttcgacgcgtccgcgcgaaagacggcggtgatgctgtcgctcgcgcccacggccgtgttctcgacactgttcaccgaccgcgtactcggtaacgcgaagctcgccgggttcacgctgtccgtcaccgcggtcatctcaatcgcgctgatgaccatcgtgaatttcgtgattcccgcgtgagtgccgaacatgcgctctcaaaactcgcagatacgatttcaccgatttcgcggaaacagcggaaaatagcggaaaaccgcaaaaacccgtttttgtatctgcgagttttgagagcgtgattctaccgcaacagcgcctcgaccgccggcacgagagccctgatggctttgccgcggtgcgaaatcgcgttcttttctgccgcgtccatctccgcgctggtcagcggatggtccgcagcggcccgctccggctggtcgtccggcacgaacagcgggtcgtagccgaaaccatgctcgccgcgcgccgcgcgcaggatgcgccccggcatttcgccgatttcgacggtttcggagacgatggcgtgcctcccgcccgccacaggggccgcggaatccggcacggccagtgcggcggcgcagcggaaacgggccgtgcgcgccgcgtccgggatgtcggagagctgggcgagtagcaacgcgttgttcgccggatcattgccatgctcccccgcccagcgcgcggacaggatgccaggcgcgttgcccatcacgtccacaatcagtccggagtcgtcggcgatggccggcaggccggtgagaccggccacaaaccgcgctttgagcagtgcgttctcctggaaggtgacgcccgtctcgaccgggtcgggcaggcctaggctgccggcggagacaagctccacctgagcggagtccgcgcccagatcctcttcgagaatgcggtggatttcaacgagtttgccttcgttgtgcgtagcgacgacgagtttcatgggggtcctttattccttacctatggttgtgcatgacggggtgaggccgatcgcccgccggcggcgtgcccgactcgtttcaatcgagcgagagggcggcacgctgggcggcctgaagctccttgttgcccttttcggcgaggtcgagcaatgtgttgagttcggcgcggttgaacgggcggtgttcggcggtgccctggatctcgatgaagtcaccggatccggtcatcgccacgttcatgtcggtcatcgcctgactgtcctcgatgtagggcaggtcaagcatcggcgtgccgttgataacgccgaccgacaccgcggaaacggcgtctttgagcacgcggtcggccgaacgaatgtggcgcttctgctcagcccagcgcatcgcgtcgaccagcgccacatacgcgccggtgatcgaggcggtgcgggtgccgccatcggcctgcagcacatcgcagtcgatctggatctggttctcgccaagcgccttcatgtcgacgacgccgcgcaggcagcggccgatcagacggctgatctcatgggtgcggccgccgaccttgccgcgcactgactcgcggtcggtgcgctcggcggtggctcgcggcagcatcgaatattcggcggtcacccagccgagtccggaatccttgcgccagcgcggcaccgacggtgtgaacgtcgccgtgcacatcacgcgcgtgttgccgcattcgatgagtaccgatccttcgggcacgtccgtgaagtgccgcgtgatgcgcaccgggcgcagttcgtccactacgcggccgtccgcgcgaatcaccattgccttgtccaacatgtctttgatttcagccatgccttcaacgtagcaccatgcggcgaacgtgcccgcagcgcggcacgtctcccgccgccgctgcggcagccatcgtgaccgccgtcacgccgaatggctcttgcgcgagtcgccgcgcgacactagggttttggataacacacgattcttgtcttgcgggagggcggtcatggtcgattattcaccggcactgatgacggatatgtatgagtacacgatgctggacgccagcctgaaggatggcacggcgaaccgcaaatgcgtgttcgaggtgtatacgcgccacctgcccgaaggccgccgttacggtgtcgtggcgggcatcggccgcattctggatgagctgggtcggttcctcctcagcgacgaggacctgcgtttcctgtccgaccgcaaggtggttagcaaggagacgatttcgtggctggagaacctgcatttctccggttcgatcaagggttaccgcgagggcgagatgttcttcccgaattcgccgattctgcaggtcgagggcacgttcggcgagtgcacgctgctggagacgctggtgctgagcgtgctgaactatgattcggcggtcgcatccgccgcctcgcgcatggtgagtgccgcgaaggaccgcccctgcatggacatgggcgggcgccgcaccaacgagtgggccgcggtggcagccgcacgagccgcagtcatcggcggtttccagggcacagcgaacctgcttgcggcgcagctgtatggactgaaggccatcggcaccgccgcgcactgcttcacgctcgtacatgatgacgagcgcagcgccttcgcctcgcaggtcgaggcgcttggccgcaacaccacgcttctggtggacacgtacaacgtcgaagaggcggtgaagaccgccgtggaggtcgcaggtcctcagctgggcggcgtgcgcatcgattcgggtgatctggccgccatggcgcagcgcgtgcgcaaccagctggacgccctgggcgcgacgaacacgaagatcaccgtcaccaacgatctggacgagtacgcgctggccgccctgcagagcgcgccggtggactcgtacggcgtgggcacgatgctggtcaccggctccggtgccccgacctgcgcgatggtgtacaagctcaccgagcgcgagaattcggctggcgtgatgcagcccgtggcgaagaagtcgaaggacaaggccagtgttcccggccgcaagctcgcctaccgttcatatgagtatggtctggccgagacggaacatgtgatctccggatcggaaacccagctggccgagtatcgtccggctgagggatggaaggacctgctggtcgactacgtcgaccacggtgacatcgattcacgttatcagggtcacgccgccatcgccgacgcgcacgaataccgggccaaggccctgcgcgaactgccgatcaccgcgcaaagcctgatgaaaggcgagccggtaatccccaccgaaatcaccgtgctgtaatccttctggccctgcgagctcgatgtcaagcccggtcagcacctcgaccatcacggccaccaccttgctgacgctgatgtgtgtggatgccagcatgtcgaagaaccagtcggaatacgcccatgtcctcggcagcgcatggctcttcttctcttccggaccgcaccgcgtggcccattcgcggcggaccagcatgtccatctgctcgcgctcgaaccgcttgccctccgccttgtcggcgaacagcggcagcggcgacttgtagtactggcgtccgtcgctgtacgagttctcgcgctgcttctgcatcatcttctgcttcatgctctccaacctgtcgttggagaccttcaggccctcgcgaagatgccgcgcctcgtcctgcagctgggtgaggtactggaacacctcgtcggcggcggactcgtcgatatggccgtcgtcgtcggtgataaattcgacgagctcctgcatcgagtcgaattgcgtgcgcgtcatggcggcgccttccggcagggctgccgacagccccccccccacgccgctttcggggtgacgaggtcgaatacggcggcgacatcatgcagattcgaggcgaggctgttcgcgtcgaacaggggcttgccgaagcgacgggtcaccactaccgcgggatgctggcggtcgggggacgtcaggtattcggatagggcttcggcctcgtcggcatcgctgatggcaatcgcagtgcccgtcatcgtatcgtaaggttccagtggctcatattgcgatgaattggattgcgctgtcatggcgaacggtgatgtgccggtctgtatcgaacctgattgtgcggaaccagactgtgcgatggcatcgatcccctgcaacgcttccccgccattatttcatatttcgcacggcatgttccacaatgtccgctttcgcgatagacgccgtttcttcaagattccggggaatccgcgcgatgtgctacaccgatgggcatcaccgcaaaaacaaaaaccgggcgggaaagaacccgcccggcaatgtcatgctcggccacgccgataccgcatcagcggcccttaatctcggagccgatgaccttttcgctcagcgccttcggaccgcgcgtcacggcgaccgcgccggaacgcaccagctcgatcacgccgtagtgctccaacagacccagcagcgcgtcgatcttgccttcggcgccggtggcctcgatggtcagcgactccgggttcacatcgacaacacgcacacggaacaggcgcacgatctccagcacgtcagaacggttcgactcgttcgccgccaccttgatgagcaccagttcacgctccacagtggtgttcggatcgagttcgacgatcttgagcacgtgcagcagcttgttgagctgcttgatgatctgctccagcggcacggcctccacgtcggcggtcacggtgacgcgggaaatgtccggacgctcggtcggcgagacggacagcgagttgatgttgaacgcacgacgggcgaacagaccggcgatgcgggccagcacgccgggacggttctcgacgagcaccgacagcgtgtgacgctcggaaccgaggcgggaagcgggatacatagccataatcacttactccttattccttgacaaccgtgccgtcacgcctggtcaccatcgtcgacgcccttgtgcagcagcggctgcgtgcccggacgatacgcgacctcgttgttggacgcgccggctgccaccatcggccacaccatggcgtccttccatacacggaagtcgatcagcaccggacggtcgttgatctcgttcgccttgttgatcgcgtcaatcgcctcgtcctcggtgaacgcgcgaaggccgacgcagccgtacgcctcggcgagcttgacgaaatcaggcacgtcgaagaactctccgccttccttcgaatcgccgtcagccaggttggtctgggagtagtgctgtccgaagaacagagtctgccactggcgcaccatgccgtacacggagttgttgatgatggcgatcttcaccggcgcatgatccaggaacgcggtcgtcagctcttcggaagtcatctggaacgagccgtcgcccgcgatcagccacaccggcttgcgccccttgaagtcgcgctgggagccgaccgaagcgccgatggcggccggaaggccgaagcccatcgtgccgaggccgccggaggagatccacgaatgcggcttctcgaaatcaatcagctgggccgaccacatctggtgctgaccgacgtcggacacccagatcgtggaggggtcggcatggtcggacagctgcttgatgacccactgcggcgcgagcgaaccatcggtcggcttatcgcacggctgatcgtaatcgatggcatattcctcgcgcaggcggttgagctcgtcccaccacggcttgaggttcggcttgccgccgatggcctgagaacgcttgatttcgggaatcaggtcgttgagcacggtggacacgtcgccgacgatcggcacgtcgggagcgcggttcttgccgatttcggccggatcgatgtcgatgtggatcacccgcgcgccgggtgcgaacgcgtcgagcttgccggtcacacggtcgtcaaagcgcgcgccgatggcgaccagcaggtcgcagcgctgcgcggccgcggtggcggcgacggcgccgtgcatgccgagcattccaagcgccttggggttcgagttcggcacgatgccgcgggccgggagcgtggtgacgatcggcgcgccggtcacttcggccagctcggccacttcggcggacgcgttggaacgcaccgcgccaccgcccacgtacagcacgggacggtacgactgcgcgaacagcttcgccgcatccgagatcacgcggccgtgcgccttcgtggtggggttgtaaccgggcagaatcatgcgctgcggccacgaataatacatctcgccggtctgcgcggtcttggtcaggtccacgaccaccgggccggggcggcccgaacgggcgatatagtgcgcctcggcgagcacgcgggggatatcctgtgcgcgggtcaccagatacgagtgcttgacgaccggataggtcgccccaacgatgtccgcctcctggaaggcgtcggtgccgatggcgttcacgcccacctgaccggtgatcacgacgagcggcacggaatccatgttcgcgtcggcgattggggtgatcatgttcgtcgcgcccgggccggacgtgacgatgcacacgcccacgcggcctgtcgccaccgcatagccttcggcggcatggccggcggcctgctcgtggcgcacgagcgtgaaccggaacttcgtatcgtcgttgatcgcgtggaacaccggcaggatggcgccgccgggcaggccgaacacgtcctgcacgcccaaatcctccagcgcgcgaatcaacgcctgcgcgccggtcattttctcaccgtcgatgatcgtctgcttgtctgcggatgcggtgtttttcggaacgccgctgaacgcctgcaatggtgtgggtagagccatcatgtcctctcaactcaaatcgttcggtcatatgcctggacccgtcgcgcctcgcgagcgttcatgacttgcgtgcgccgacggtcacgatgcgcgttcgcttgtggctatggcgtctgtgattcgtattttctcagtttaagcatacaggtgacagcatcgcgcaatcgccgttcaccagttggtcagttgccggccgagccgctgcgccggtgcttggacgagccgttcttgcgggccgccttgagcgcgggcgcgtaccggtcgagctcatgccaggccatttccgccgcggcgagctgcgccttgcgcttgctggtgccggtacccttgccgatgatgtcgtctttcgggccgatggtggccttggcggtgaattcctgcgcgtattcggggccggacacgctcatgcggtaccgcggctcatccaggccgagctcgtgcgccttcacggtcagcgaggtcttccagtccagggctggtccttcggtggccacttccgccaacgtgtcgtcgatgagccggtgcacgaccttgcgcgcgccttcgatgccgtgctccaggaacgtggcgccgatcagcgattcgacgatgtcgcacagaatggagcttttctcggcaccgccggactccgcctcgccgtgcccgagcaggatgaacgggccgacgtgcaacttgtcccgggcgatcgccgacagggcctcctccgaaacggccttggcgcgcatcttcgccagctggccttcggtcatgtcgggatgcagcgtgaacagcgtctcggtcgataccagttccagcacggcgtcgccgaggaattccagccgctcatagttcgatgtgccggggtgttcgtgcgagaacgaacgatgggtgagcgcctgtatcagcagatccgggctgatggtgacgcccagcgcggagaacagctcttcgcgcggttcaggttcagtcatgtttttctccttgtccaccgtatccggccgcacgcgcacgccctgaacgcatacgcgcagtgtccggatggcaatgcgacaatatacgaagaccctgccacccgtcgatggcagggtcttcatttcgctatcggcattcggctgcgatcacttggtgtgagcggagcgaatggctgcgcggtacacgcggccgcggtaggagccgcagctcgggcaagccatgtgcggcagcgccggagcgccgcagttcgggcatgcgatggtctgggcggcggtagccttccagttcgcgcgacgcgagtgcgtgttggcgcgcgaggtcttgtacttaggcagtgccatttgttattcctctgtttcgttcgaacaattgagcttaagcgtacggtatcttaacgcatcgcccgtacaacggcatgtcgcggcgtcgcgcgagcaggttcccagacccgcacgccgatcgcccaccgttacttgtcgccgtgctcctcggcctccagctgggccttcaacccggccagagccgcgaaccgcagatcggtcacgtcatgatgatggtccgggtgctcgttgaggtcgacgccgcactgcgagcacagtccccggcagtcctcgcggcacaggggctgcaatggcagcgcctccaccagcgtgtcacgcagcagcgcctccaggtcggcgaacgccccgtctcggctcagcggatacacgtcctcggactcgtcctcccccgcgacgatctccacgtcctcgttcttgggcttgccgtgcgagcgggccttcgcgctctcctcgtaggggaagaacgcgacgacgtccacaccccaatcgcgcttgatgggcttgaggcagcgtgtgcactcggccgcgacgggcgcttcgatgcgagcggtcagcaccaggccgtcgactatcgagtcgaacgagccgtgcacgctgacgtccgcgccctccttcacgccgatgacctcatcgccgatgccgctcggcgcgggaaacaccgcgtccaccgtcttggactgccccggccgcgacgccacctgcgccacgctgaccgcccatgcggaatcctccggtcgtgccatgcaaatctcctccctgctgctgccgcgcatgctgttgcgcgttccgttacactccggcgcgcccctactgcgcttccggataatcgttgatgttcaggtgcggcatctgctcgcccgccgcgcgctgccgttcctcaagcacgttgagtcctgcctgcacgtcgtgactgagcttgccgagctgctcctgcaggccggtcatcaccgtcgtgcagtactcgtcggcgccattggtcagatggtcggcacgcgcctgcgccttgtcgagaatcgcacgcgcacgctgccgcgccttgtcggtgatgttctcctggccgacgaggatctgcgcctgcttgttggcctcgtccaacgtgtcggcggcacggctctgcgccgacgcgatgatggcgttcgcctgcgtctgcgcggattccaagcgccgctcggcctcgcgcatcagcgcggacgcgcgctccagctgcaccgggagcatccgcttgagctcgtccagctgaccggcgaactcctcgcggtccacacgcaccatgctgggcgcgaacaggctggtcttcgcggcctccagcgtcgcctccatcgagtcgatgatgtcatagacggtggtgaactcctcgcgggacttcacctcctcggggttcatgtcggccttcggatccagcgtctcgcgcaaatcggggagctgactgatcgggaacgtcggcttggactgcttcgcgtaatcggatatgtccggcttgttctcgtgcgtcgcagcggcggccggctgcggattgtgcgacatttcgtcccacacgctggcaggtgccgcgctttccggcgcatcgttcagccgcgccgcggccgcatacgtgacgctgtaggcgtcggtcgactgcgcggccggctcggtgccggtcgcgggattcatggcggcgccgccgtcgttgccgtcaccgacgttgacgatgccatcgttcgttgattcatccatgctgcatctctttacttttattccggtcacgtatcagcgaccggaaaacccagacaatatcatatgggattcgcgtcgcgacgtcactcgccacgctcatggttcaacgcctcgtccagcatcggcaccacgccatcaggcaccatgccggtcacgtcgccgccatgccgggcgacgtccttgacgatggagctggaaatatgctcaagcaccgggtcggccggcaggaacagcgtctccacctctgcgagcttgcgattgaccagggccatgcccagctccgcctcgtaatcgccgttctgccgcaggcccttgacgatgacggtggcaccgatctccttgcagtagtcggtgatcaggccggtcgtggacgcgaccttgacatcggggaatccgtcgtggtcgagcgcctgacgaatgatatccactcgcgtatgcgccgggaacatcggggtcttcgcggcgttcacggccacgaccacgtgcacttcgtcaaaaaaacgggcgcaccgctcaatgacatccaaatgtcccgcggtcacggggtcatacgatcctgggcatactgcgatagtcatatgcatagcctaccgcgaatcgccggacagtccgtatacgagcgagccggggctcagacgccggacatgcagcggtagcatgcgggcattatcatgaatctatgccggtggaagacaggccggccattcgccgctatgatgtcgtcatggatgaaggaatggagtcgaaatgtcatctgaaccgtcaacacagctgaagccgacatccgccgtcgcaggagggatcgccgcggatctcgcggatccggtgtcgccgctgtccaccccggaccagggcacggggacggcggtgctggagcgtccggaaaccgaggagcagaccgaccgttccgacaatggcgacgccgaccggttcgcgcactatgtgtcgcgcgatcgcatcgccgaatcgaagctcaccggccggcccgtggtcgcgctgtgcggcaagatctgggtgccgaagcacgacccgtcgcaataccccgtctgcccggactgcaagcgcatctatgaagagatgatgaagtaaggtcgcgcaccgcgcggcgattactccagtttttcggacaattccatccattcggtctccaaggcgccggactcgtcggagacggcctgaagctgcccgttgagcttgttcagcccctcatagtcgctcggatcatgggcggccatatccgcttcgagcgcggtcttctgctcctccagctttgcgagcttgcgctcgatggcggagatgcgcttgctggtctcgcggaattccttgccgctgagcttgggggcgtcgtccgccgtggcagtgacgccggagtcggccggctccttctgcgaagccgatacacctgccggcgctgcggtcttcgctttttcgatcatgtcgagataatcgtcgacgccaccgggcagatgccgcaccttaccgccgatcagtgcgaactgctggtcggtgacgcgctccagcaggtaccggtcgtggctgacgacgatcagcgtgcccggccacgtgtcgagcagatcctccatgacggcgagcatatcggtgtcgaggtcgttgccgggctcgtccatgatgagcacgttcggctcatccagcaggatcagcagcagctgcatgcggcgcttctgtccgcccgacaggtcgcggatcggcgtcatcagctgcgcggattcaaagccgagccgttccatcagctgaccgggcgtgacttccttgccgtcgacgatatagctgggcttgtagcgggacagtacttccttgatcttgtatttgccgagtttctccagctcgtcgagccgctgcgaaagcaccgcgaacttcacggtcttgccgatgttgacatgcccggctgtcggcgtgagcgtgccgtcgatgagcttgagcaacgtggatttgccggcgccgttcgcgccgacgatgccgaaacggtcaccggggccgatcagccaggtcacgtcgtcgagaatcttgcgaccggcgacggtgatcttctgcgccgcggaggtgacctgcggcgcgaccgactcctccgtgacacccttacgttccgcgagcgcctccgccttcgccttggcttccgctgcggcctggatggattccggcacgccggcgtccacgagacgcgggtcggcgagcgtgtcgacggcgacttcgacggaaccggtcacgcgcggctccgagtatagggaggggacgatatcgatctgagaggaggaggcgggggcctgatccgccgccgtgtcgtcggtcggcgtgaccggctgctcgccttggcttttcgcgaagatctgcgtgacgtcgatcaggtcgacgacctgcttgcccaggcgcgacgtggccatctgcttgagttcgacggcgttgcgcatgggcggcacgtcggcgatgagctcccgcgcggccttgacatggaacttctgcttggtggagcgggcgcgggcgccgcgcgacagccaggcgagctccttgcgcgcgaggttgcggcgctttgtctctcgcacatcggcctgtcggtcgcgctccacgcgctgcagcatgtatgcggagtagccgccttcgaacgggtcgattacgccgtcgtggacctcccacatcgactcgcacacctcgtcgaggaaccagcggtcgtgggtgacgagcagcagcgccccctgccctttcgaccagcggttcttgagatgttcggcaagccagtggatcgtcacgacgtccagatggttggtgggctcgtcgagcgcgaggatgtcccaatccttgagcagcagccgggccaggtcggcgcggcgtcgctggcctccggacagcgagccgacgcgggcgttgaggttgatgccgcccagcagcgcctcgacgatctcgcgcgacttgttgtcggcggcccactcgtaatcctcgcggccttccagcgcggccgcgcgcacggtggcgtcgtcgtccagcgggtcgcgctggtcgagcatgccgaacgtcagtccgccgcgcttggtgactcgcccggaatccggctcctgagtgcctttgaacaggtgcagcagcgtggatttgccgtcgccgttgcggccgacgatgccgatgcgatcgccctcgaatacgccctgcgtcacatcggtgaagatggttttggtggcgaaggcgagtgaaacgtgttccaatccaaggtcataagtcggcatgactcaccaatgtagcgtcagcggtgggcatcaacgtccgaaccaccatacgcccccgctggctcgtcatgttcgccccccgccagcggggagcgaactcgcagttcgctagcgcagggattgggcgtaggtgttgcagcgggcggcgaatccgccgaacacctgctcggccaacggctgcaggcgcggattatattcggcgaacgcttcgcgcagctgcgacttcgatccgcccaccgccttgaggtccttgaccatcgaggactcatccagccattcctccagcaacgtcggcgtcacttcgagatggaactgcatgcccagcgccgagccgatgcggaacgcctgcaccttggtgtgctcggaccgcgccagcagctgggcgccggcgggaagccccaccacgtcattgtgccagtgcagcacgtcgatctgcttgttccacatcgagaagtaattgtgcttgtcaacgcgcttgatcggcgcgaacccgatttccggcgactcgccacggctgagtttgccgcccagcgcggtggcgatgatctgatggccgaggcacacgcccagcaccggcttgccgacgctgatggccgccttgaccagtttcgcctcgaccttgagaccgggatacttgtcataatccagcgcgcccatcggaccgcccataatcaccagtccggcgacctgcgcgaagtcaggcagatcgggcttcttttccttggcgatgttcaccaccgtggacgacatgttcaggtcgtccaggttgtccaggatgcgccccggcttctcccacgggacgtgctgcacgataagcacttgcgattgcgtcataactccattgttgcatcacctacgtaaactttgcacaccgtttcttcatctttcgtatttccagccgcgcccgggcggccgcgcaatcacatttgccgggtggtttgtctgatggtttgtcgtataacgcgaatacgctcgacattatgacacaagcctcagaaccgcagaattccaacacttccgagaacgccggcgtggcgcgcgccgcggccggcctgaagctgtatgacacggcttcgcacacggtctcgcgtttcaccccgatcaagcccggccaggtggggatctacgtgtgcggcgccaccgtgcagagctccccgcacatcggccatatccgagcggccgtcgcgttcgatgtggtgcggcgatggatgctgcggctgggatatcaggtcacgttcgtgcgcaacgtgaccgatatcgacgacaaaatcctcgacaaggcggccgcggcaggccagcagtggtgggcgcgcgcgtacttctacgagcgggagttcacgcaggcgtatgacacgcttggcgtgctgccgccgacgtatgagccccgcgcgaccgggcacatgatcgacatgatcgacctgatccgccgcatcatcgacaacggtcacggctacgtagtttatgacgcggatggcaagccgaccggcaacgtgtatttcgacgtggcgagctggccgcattacggcgagctgacccatcagaagcagggtgccgccgaggccgacgaggccgccgccgtggctgaccgcatgggcccgtccgtggatgcggccggcgacgacaagtacaatccgatcgaccccgccgacgcatcccccgacaagcacgatccgcgcgatttcgcgctgtggaaggcgccgaagcccaccgacccgcaggacgcgcgctggtcgacgccgttcggcgtgggccgccccggctggcacatcgaatgctcggccatgagccaccggtatctggacggcatgttcgacatccacggcggcggactggacctgcgcttcccccatcacgagaacgagatggcgcagacgcgtgccgccggatacgagtcggccgcacgctggatgcattcggcgtgggtgaccgccaagggcgagaagatgtcgaagtcgctgggcaccggcctgtccgtgccgagtgtgctggccgagcactccgcatgggtggtgcgctatgcgctcggctccgtgcagtaccgttcgatgctcgaatggtccgaccaagcgctggtcgaggcccaggccgcatacgaacgcatcatgaacttcatcgagcgcgccggcgtggctttgggcgagcagcccgagcgcgccgagatcgccggggtcagcgccgatgatcttcccgccgatttcgtctccgcgatgaatgacgacgtgaacgtctccggcgccacggcggcgatcttcaccgcgattcgcaacggcaacacgctgctgagcaagctggatgaccgtgccgacggcgatgcggcccgcgccgaggtgcgcagcgccctggtcgcggtgcgggcgatgctggatgcgctgggactggatccgctggccgagccgtgggccggtgccgcaggcgcggacggcaacggcgagagccgcgagcatgatgtgctggacgccctgatcacggagcagctgaacgcccgcgccgaagcgcgcaagtcccgcgacttcgccaaggcggacgcgattcgcgacgcgctgggcgccgccggcatcgccatcgaggacggcccgcaaggcagcacgtggagtttgaagtaatcctcccccgacactgtgtgatccgttatgttgagccccgcctccctccaaaaaaagcggggctcaactggttacggttatgcaatcggagcatattttgacggtgaaagcgacgatagcagcccagcattgtcgctggcattatgccagcaaatgcaatcaaataccgagcaggaacgccccggcatcatcgcgggacagtcatgatcatccgatcctgttccgctccttaatcgaacacgaaatcgacatccacgatatgcagccgcttggtcagttccttctccaagtctcgcttgcactccaccagatcctccacgtcaatgctctgcccgataccgctcagatacacatcgaccgtatagttcatgccggtcttgaacaccagtacctgctcgtaatcggtgttctgcggcagatgccgctgcgccgccgactccacgaacgcgttcgtcgcatcgtcgtcatgcactccgccgaccagttccacgaacgcgtccttgagcacaccgaacggctccttgatcgtgagcagcaccagtgcgacggtgatgaagaaatcaccggtgtaatgcaggaaatccagagggccaccagccggcaggaaccacaggaacacggccaccacaccgatgccgaacgacatcgaaccgtcgaccagcgtgctcttgcactccgcggtcagcatcgtgctggaattgcggatgcgccggttctcgcgccggtaatacaggtacagtcctaggcagacggccacggtcaggatctcgtaaatcaccacgggcccggtctcgatgcgcccgccctgcccaagcacgaaatagtcataggcgacgcgcgtcacatcgacgagagagaaaagcagcagcgacatcgtcagcatcgccttgcagatggcgtatatcggttccagagcgaacatgccattggggaagcgctcggtggtgcgcacggtgcgcgacgacaggtatgcggcgacgaggccggacagcacggagatggcggtgaaggagaagtccaggaacatggccttcagaccggtcatgaagaacacggccatgcctgcgagcacctgcaggatgttgatgacgatgcccacgatcagggctttgcgttcgatggttttctggtgtggcataggcgggccttccatattgcacggcatgtctgcgtcggcgtcagcgcggcagtctgcgtataggttgggtccgaaggataatcaaaacagctcagcgatccaataatccacggaattattgcccttccatggtaacggaaacgaacgattccgggcgtgtcggttcgcgctgagcgtgcgggaatccccaccgcccacaaagccaacggttctgtcgcatttccaccgctctctcgcgtcgatcccacgcgcagccgcgaccgccgaacggcgccccgcggcacctctccgtcgccgtgcgggccgcctcggcggcagcccgctggttttccgccgcaacggctagactggttcgcattatggctgcttttagttctttgacagaccggctctcgaatgcgttcaagcatctgaagagcaagggcaaactttccgaggcggatatcgacggcacgatccgtgagatccgccgcgcgctgctcgacgccgatgtggcgctcgacgtggtgcgttccttcaccgcgcgcatccgcgaacgtgcgctcggcaccgaagtgtccgaagcgctcaacccggcgcagcaggtggtcaagatcgtcaacgaggagctgacggatgtgctcggccagggcgtggaccggccgctgaacttcgccaagaacccgccgacgatcatcatgctggccggcctgcagggcgccggcaagacgacgctcgccggcaaactcggctactggctgaaggattccggccacacgccgctgctggtcgccgccgacttgcagcgtccgaacgccgtgacccagctgcaggtggtcggtgaacacgccggcgtgccggtgtacgcgcccgagaagggcgtccagtccgacgggggcgactcggtgtccgcgccgggcgagacctccggcgacccggtgaaggtggcccgcgattcgatcgcgctagccaagcagaagctgtacgacacggtcatcatcgataccgccggccgactgggcgtcgacgaagcgctgatgcagcaggcccgcgacatccgcgatgccgtgaaccccaacgagatcctgttcgtcatcgacgcaatgatcggccaagacgccgtccagacggccaaggcgttcgacgagggcgtggatttcaccggcgtggtgctgtccaagctcgacggcgacgcccgcggcggtgcggcgctgtcggtggcgagcgtgaccggcaagccgatcctgttcgcctcgaccggcgaagggctcaaggacttcgaggtcttccaccccgatcgcatggcctcgcgcatcctcgacatgggcgatatcctcaccctgatcgaacaggcgcagaagcagttcgacgaggaggaggcccgcaaggccgcccagaagatggcggaaggcgagttcggactcgacgacttcatggaccagctgcagcaggtgcgcaagctcggctcgatgaagtcgctgctcggcatgatccccggcatggcgcagcaccgcaaggaactggagcagttcgacgagaaggagatcgaccgcaccgaagcgatcatccggtcgatgacccccgaagagcggcgcaacccgaagatcatcgacggctctcgccgcgcccgcatcgcctatggttccggcgtaaccgtctcggcggtcaacgggctgctgcaacggttcgagcaggccgcgaagatgatgaagcgcatgagcaacaaggccatgggcggcatccccggtttcggaggccccgcggtaggcggcggcaagaagggcaagggcaagagcaagaagaagggctcgaagtccggcaatccgatgaagcgcgaggccgaggagaaggcgttgcgcgacaagctcgccggcaagggctccggttccggcaagtccggcgggtccgccttcatgaagaagccgcagaatccggctcttccggccgggctgcaggatgcgctcgacgcgaacggtggcgagcttccgcccaacttcggcggcggcctttccggtctgctcggctgattcggcccgtttttctctggcgccgggcggggatggacgttttcgtccatccccgcccggcgccaaatcatttgccatatcttcgcagctttccactcgccgcgaattcgcaacggctgccggtacactgaaagccattattcactcgttggaatgttaggtaaggagttcggcggtggacgtgttgtcgtggatactgctggcggcgtgcatgctatggtcggcgttgcggttcctgccagccggacgggaagcgcacatgccgacgatgccttacatgattgcgctgattcgttttttgtggataccgtacctggtcatcgcggtatgggccggtctggtcggctcgtggtggcagtgcggcgtcgccgtcgccggcatcgtgtcgatacttgccatgcaggttccgtattggacgaacatgccgcgggaacgatggcaccaccagcgtggaacatcccatgaaacagcgtcagacgaccatcgccagaccgcgcgatccgccgacgccgagccgaccgcgaacccgccgcaggcgagcggcgacacctaccatctgatgacgttgaactgccgctatggcaaggcgagcgccgacgccatcatcgcggccgtgcgggaacgacacatcgatgtcctcgcgcttcaggaactcagtacggatctcatcaagcgtcttgagcgcggcggcctgcacaggatcctcccctatcggcagctcggtacgccccgcgaaaagaccgacaacggcggcttcaacggcatctggtcgcgcaccaagccgaaacgcggcacgcatggcattgtctcgatacctgcggccgacgtgccgggcatcatgctgcaaaccgatgacggcacctccgtggcattcgcatccgcgcacaccaaatcgccgatgcgcggctgtcgggaatggtcagacggcatccggtccctgagcgcgctggttccgatgccgcgcaagtcggtcagcgcaggcactggccgcgcggaacgtgccaccggctcgaaaggcggacgcgacggtggttccgcatatcccgacgtcgatatcgcggtgctcatgggcgacctcaacgccgatatcgaccatgccagcttccgcgagctgctgcggtccggattccgcgacgccgcactgtcacaggctcgcggacatgtcaataccttccccagtcaggtgccgtggccgcgcatcgagctcgaccacatcatggccgcgacgcgagaatccgcgtcaggctccgccgccgagccggcacgagccgtcgcgttcagcggcgtcgaatcatccgtcgtggaagacaccgaccacctcgcgctgaccgccacaatgactatttgagcgtcatgccgcacggacagcatggcggatatgcgtcactgagcgcgcccaccgtcactgagcgcgggcacactcacagtgacgcacccacaaaacccttgcaatcactgggtttccgggttgtgtcacgctgtgcgggcacacgcagcgtgacgcaacccgctcacagtgacgcagaatgaccgagatggcccgcccccggcacgtcaaaacaacaatgccgcatgggctcccgtagaagtccatgcggcgaggcttggattgcccgactacagcaccgccatcgcgaaatccacgagcagcttgatgccgtacaggacgatgatgccgccgcacacgcggttgagcacgccgatgatcttcggattgaacttgtgcgcgaacgcgttgacgacgagcgtgacgccgaggaaccacatcactgaagcggtctcaacgcccgtgatgaacggggtggcctgctgcgcgctcagcgtagccgcaaacgcaccgagcatcaatgtgccgtcgatgatggcctgcgggttgaaccacgtgaccacgcatgcggtgccaacggtcttcagcagtccacgcagaccgagacgcttggcaggggcttcagcaccagcgaccggactcgccgtcgaagcagtcgcagcagcaacagcaccggccccagcgccgttctcggaagtcgacttcttcttcggtagcagcagtcccagaccgatgcgcaccacgacggcgccgcccaggccaagcaccacggtctgcagccacggatgcgcctgcatcaacgcgccgatgccgaaaaagcacgccagcgacagcacgatatcgaagaaaatcacgatcaccgcagtaatcaacgcgttgcgacgcgtacgcgtcaacgcggaattgatcacgaacagattctgcatgccgattggcgcgacatacgccaatcccatcgtcaagccctggaaatacagacccatcatcactcccgacaatcatttggttgggtcatcatcacccaaccaaaaccagccaatatgccatcagctggatttcctcacgcggattgcaagttatacaaaatccgccttattccaacacctttgccatattctacagattcgattacacttggcaaccagccaagaacagagcaatgcacccaaccaaaaatcaggcatcatgacacgcagcacaccattggacatcaactgggagccggaccgcagcagcggcgagcccataaccgaacagatcgtcggtttcatgtgcgcccgcatctcaagcggcgactggccgatcggatcaagactgcccagccagcgggtactggccgaacgcttcggcgtgaaccggtccaccatcatcgccgcgatcggagagctcgccgactacggcatcgtcgaaggccggcacggcgccggcacacgcatcgccagcaacacgtggtcgctgatgctgccgggcgcgccggactgggcggattacgtgtcgtccgggttcttcaaggcgaacaacgacaccattcagacgataaaccgactcgaattcgaccggtcgaaaacccgtctcggcaccggcgagctcgacccgcggctgttcccccgtgacatgtggcggcgcgtggccggcgaagccgcggccgagataagctcgctcgggtatccgccgccggagggccttgacgtgctgcgcgaggcgatagcggcgcacatggaggcgtggggcatcagctgcacgcccgggcaggtccttgtatcatccggcgcattgcaggcgttgcagatgatttcggtgagtctgctgtcggccggatccacggtctatgcggaggcgccgagctacatcaagtcgctgcaggtgttccaatcggccggcatgaaactcgccggcgtaccgatggacgagcatggccttgacgtggatgcgctggggaagctgatgggcggcgggtcgcagtccgaggggatgacggcggcggtaccgtccgccccgcagacctcactgccgccgcgggccaaggccacgcgcgagaacgacgcggtgctgtatacaatccccaccaaccacaatcccacgggcgtcacgatgagcgagccacgccgtcggacgctcatcgcctcatgcgtggcgaaccggttgccgatcatcgaggactgcgcataccaggacctcatcttcgacggggatacgccgcacacgctcaaatcgttcgatgagaccggcatggtgattacgctgggcagtgcgtcgaaggcgctggcgccgggactgcgcatcggctggatcgtggcggacgagcgcatcgtgcaacggttggccgacgtgaagatgcagatggactacggggcgagcacgctgagccagtgggtgttcgcgcggttcctgtccagcggcctgtatgacgagtacatggtctcgctgcgcatgcagctacgccggcggcgggacgccgcactggagacgctggagcgactgttcgccggccgtgcccactggaacgtgccgcgcggcggtttttacgtctggctcacgttcgacgagccggtgcgcacagggcgcctgttccagcgcgcaatcgagcacggcgtactgctcaaccccggcgacatctacgatttcgagggggacaactcgctgcgcctgagctactcctacaccacgccggaggagttcgcggccgccgccgaaaccctggcctctttggtataggcctcgatggcggcttcgggctggacaacgtccaagcaaacccgccgttatccgtctcgaaaccgcccgctgcgaccggccaaggtaccccatgtggccgtatctcgttttcaaggggttgatttcggctccgccggacatctatctgcgtttcaagggggcgccaaaacgcgatatccgaagtatgatcggcgaaataccaccggaatcatgcggttcttgggccacttatactttgtgaccaacccctcgaaacgcagataggcattcggaacaacacgaatcaacccctcgaaatgcagatagccccgaatcctccgccagtgaatgccgaccaggctttcaagcatcacgtcaggcaccttgcgcgccgatgttttttgccacgtcgaccccgacgatcgcttgccagctccagcgtgtcgggtatccacccctatgcgttataatttatcggttattcgtgatgggtggagccctctcattctgcctttcatgaggaacacgtgggttctcggttgaggtgccccacacacaatcgaaaatccgcaaaactagtattacaaggagagccattttggcaaccaagattcgtctgaagcgcatgggcaagaagttctacgccttctaccgcgtggtcatcaccgattcccgcaacaagcgtgacggccagtccatcgaggagatcggcacctacaacccgaacacccagccttcgaccatccagatcgactccgagcgcgcacagtactggctcggtgtcggtgctcagccgtccgagcctgtgctcaagctgctgaagatcaccggcgactggcagaagttcaagggcctcgacggcgccgaaggcacgctgaagaccgtggaagccggcccggacgccgcagctcgcgtcgaagccgtggaagccgaagcccagaagctgaaggccgcgaagtccgccgctgacgccaaggccaaggccgaagccgaagctgccgctgaagctgaagctcccgccgaggaagcgcaggctgagtgatcatgctcgcgcaggctgtggaacacctcatcaagaacatcgtcgattttcccgatgacgtttcggtcaagtcccacgagaacgcgcgcggcgaactcattcgcgtgcgcgtgaacccggaggatattggccgcgtgatcggccgcagcggccgcaccgccaatgcgatccgcaccgtggtgcaggcacttgccgaccacaaagtgcgcgtcgacatcatggatgtgcgcaggtgaaccctagcgtggagcgtcaacaacactctgacgaccctcagcagcgcgagttgctgagggtctgtcgtatcggacgcgcgcaggggctcaaaggcgaggtcaccgtgcagatcttcacggacgagccggaatatcggttcgctcccgactccgtgctgtacacgcgcgacggttcgcaggaatacgtcgtcgagtacgcgcgcacattcaagaaccgttggatcgttaagttcgagggcattgatgaccgcgacgcctccgaggcggcgaatggcatcgagctgtacggcgaggctgacgatcccgaggacatgctggaagaggacgcctggtatccgaaggatctggtcgggcttgaagcgcggctcgccgagggcaacgggctcggcctgccggccggccaggtcataggcaaggtcgtggacgtactcgacagcgcgcagacgctgttgaagattcgcctggcctcgccggttcgggacgccgtcaccggcgaagtgacggaatcgaccgcactggtgccgttcgtcgacgagttggtgcccgacatcgacctcgaagaggggtatctgacgatcgacccgcccggcgggctgattccgggactgtgattcggccccggtcacccttcagtgtccgacagctgcggctgtcggacactgtcatatatgacggcgttgttgccgggcgccgagccgagtccggcaacaatgcggcgcgcccggatgcgtagcaaggctgacagacgcgatttataaaatcatgcgattccagtcagccggcgccgacaaaccatgccacacatccaggcgtgtcgcgacgctcatgccgtcggactgcgggattcgctacgctggagaacatgaagatcgatatcgtgtccgtgtttccggagtattttgacgtgctgaacctgagcctgttcggcaaggcgcaggagaagggtctcgtcaccgtcaccgcgcacaacctgcgcgactggacgcatgacgtgcatcattccgttgacgatacgccggccggcggcggtgccggcatggtgatgaaacctgaggtttgggcggaatgcctggatgacctgctcggtctggcacccgcagtcatcgcgccggacgcggtatcttccgacgcgcacgacgatgattcggcctccgtcagtccgtccggcgcagtcaactcggcggaagcagccgatacgaccgatgcggccgactcgggccatgcaggtaatccgaccaatgcagccgcttccgtcacttccatcgtttccgataccacgagcgacaccagtgaagctggcgggaacgccacgccggttctcatcttcccgaatccctcggcgccgctgttcacgcagcgcgacgcgaccgagctctcgcacgccgaccatctgctgttcggctgcggccgatacgagggctatgacgcgcgaatccctgagtattaccgcgcgcagggcgtcgacgtacgcgaatactcgatcggcgactacgtgctgaacggcggcgaggtggcggtttccgtgatgctggaggcgatcaccagactgctgccgggcttcatgggcaatcccgattcgatcgtcgaggagtcgtacacgggcggcaacgcactgctggaacaccatcagtacaccaagccggccacgtggcgaggcatcgcggttccgccgatccttaccagcggcgatcacggcaaggtcgaccggttccgccgcgacgaagcgttgacccgcaccaacgacattcgcccggatctcatcgagcagctcgattgccggcagctcgacaagcaggaccgcaagacactcatcgcccttggctgggaggtctccggagcgcgtccgcgcaagctgcagtaagtcacttgacacacgtcatcagccactatccccgcaaaagttgagtctcatacgctcaactttttcactgtgggtaaaaactgggaatgtcaggacggaataccggtaggtagtggtgcaaggcaagaggaggagctccgagaggggttccgggaacggccacgatagaccacaccggcaaggccagtcacccggccggcgcggcaagccaacccgttccactccgatatgcgaggagtaccgattatggcaatgtttccggctttgatgaatgacacgatgttctctgacctgtttgacgacccgttcttcgagggttggcgctccgccgacaacagcgcggcgatgaccccgacgaacatgatgagtacggacgtgcgcgagaacgacaagggctatgacgtggacatcgacatgcccggcttcaagaaggacgacatcagcgtctcgctgaacaacggctatctgaccgtgtccgcccataaggacgaggacagcggcgacaaggatgagtccggcaagtggcttcgtcgtgaacgttacgtcggcacctgctcgcgcagcttctacgtcggcgatcaggtgaaggagaacgacatccacgccaactatcagaacggcacgctgtgcattcaggttccgaagatcgaggcgcagccgcaggtcgaaagcaagcaccagatcgccattgagggctgatgcctgatggccggccgtacaggtcggcggcggaaacaacagtcaagcagaaatcccgtgaccggcatgcggaacatgcaaccggtcacggtttttattggctcgttggtatttcgtccccaccccgtcagcgggagcgaccattcggcttacaggccgaacaccttcacgcgggagtcaaccggctgcttgtcaaccggagccgcggcctgggcgacggtgccgaacggcatctgcgcctgcaacacccagctgggcggcagaccgaattcggcggagaccgcctcgtcgatcagcgggttgtagtgctgcaaggatgcgccaagccccttctcggcgagcgcggtccacacggcgagctgcagcatgccggcggcatcacgggcgaatccggggaagttcgcagcgtaggtcgggaagttcttctgcagctgcttggtcacgtcggtgtcgtcgtagaacagcacggtgccgtggccggcggcgaaggcgttgatcttggcctcggtgcccttgaacgcttcgtcatcgctcacgaccttgcgcagcgtctccttgacgatgttccacagcttctggttggcgtcgccgaacagcacgacggcgcgctgcggctgggagttgaacgcgctcggcacctgcacggtgacatcctcgacggtcttgacgatctcctgatcgccgaccggggattcggaggtcagcacgtactgcgagcgacgggccttgagttcctcgatgaagttcgacatgatggcatcctttcgcgatggcattgcgttttgttgtttcactgtcttctaatagctcgattcgatacctcgattcgaggcattccatgattaacgatacgtgcgccatgcgatccacatgccgatgttctctgtcagagaatattagctaggtaacattcggcacggcggcgattgggccaaggccgcttcgggctcgcagcaacgggctacactcgcctcggccgctcactcatccgtcgcgcccgaggtctccgaggcctccgatgtctcaagcgcggactcgatataccacaccgcggtctcgccataatcgcgatgctcggcgaggacccatccctcgggcggcacgggctcgtcggaacgcgcggatcgctccaacacgatcgtcgtattcccgccggcgattccatgggcgaccatgtccgagagcaactggttgcagtcctcggtggcgaacgcgtacggcgggtcgatgaagatcacatcgaacgccgccgacttcgcggagccgccagcagcatcggcgttcgaggccgagcgtgcggcacccgaagcgacgtacttctcggctctggccctgatgacccgggccgtcatgccgcgctcccacgaacggttccgctgcagcgcggtcaacgtcttggcgatcagcgccgccgccggagcggaggactctaccgccaccagctccctcgcgccgcggctcaacgcctcgacgcccagcgccccggtcccggcgaacagatccaatacgcgggcgtcgtccagcacctgccatgaatccagatgcgagaatatcgcctctttggtccggtcggtggtcggccgggttccggttttcggcgtggtcaacgcgacgcccttgaatcgtcctgaaatcacatgcatgacaccattatggccgcaccggcgaaacgaccgcaaccgcaccaccggtcctgggtcgtacgtgccatatatcagacggctccgatacgcgactcagcttgctcacatgcctcatatgctatgatgctttgcgggtacccttgctcggatactcactgcgacccgcgtaatttgaccgtttgcgggtcgctttttcatctggacatatcttcgaccacccccagtcgctacgctcgacagccccccgccagcgggggctgtcgagcgtagcgagactggaggcggccccagccagcccactcgccagcctatgcggcttttgccgtggcagcgtgggcggagatgccgcacgcgccaacgggcaccggagcgtcgtcggcatcgtcgtcggcctgcacacgcagcatcgactgatgcaacgtcaatgacaatccaggcgtcaccgcgaatcccggctgcaccggcttatgggccgcaccgactccagccgcgacgggcgaggcgacgacggacgccgcaacacccaccgcgccgaggggagccgcaacaggaacgacaggagccgcaaccgccccgccagccggcgacacgaccacgcccgcgcgatggcgatgccgcccggcacgagccgaatccagcacgctctcgtcgaactccccggtctgccgcgatacgatcgccgcgcatgtgaccgcagcggacacgttcgccatcgtgctcggcatgccgacgatgttgctgaccggcaccagcggcaccagaagctgcaccggaagaccaaccgcggtgaacacggtcgtcgcggtcacgatcgcagtgcccggcacgcccgcggtaccgatcgacgacagcagtccgatcaccgcgagcgccacatagctcaccggcgaataccccagtccgagcgcgttgatggtgaacacggccgacagcatcggccacacaccagcgcatcccggcatgccgatggtcgtcccgatcggggtggtgaagttcgccacgtccgcgccgacaccgaccgtgccgagctgccgtatgctcagcggcagcgtcgccacgctggactgcgtggcgaacgccgtggcctgcgccggcagcacggccttgaagaacgtcaagggcggcacgtgcgccacgaatttcagcagcagcccgttgacgacgaacgcctggatgatgttgagcacgaagcccagcacgagaatgctcagcagcgcgagcagcgcgtccgccttggatgtggtcgcggccgtcgaggtcgctcccagcaccaccaccgcgtacggggtgagctcgaccacgtagccgacggccttgtagatcacgcccttggtctgctcgaagaaccgcttgacgacgctcacgtccttctgccgaccgaccgacacgatggcgatggccagcacggtggccgtgatgatgatgggcaccacacggttgccggacaggtctccgacgatgttcttcgggaagaagttgagtatgacctggtcgagcggcgctgtctgcgaggtgaggaaaccggcggtcgactcgtcgtcgacgagtttgacgcccgagccgatgtgcagcgggatggccacacccagcgtcatcacgatggcgatcagattggtgagcagcagccagccgaccgaccgcaatccgatgctgcgcagctttttcagactgccgacgtaggtgatgctggagatgatcgacacgaagatcagcggcgcgaccagcgcggtgatcaggttgatgtagatgttgcccagcaggttgagcgagtcgacctgcccgtcgaacacgaggctcagggcgatgcccagcccaagcgcgagcaccgtcagcaggctgaagttgagtttgaagaccgcgcgcagcacggcgatcagggcgaacagcaccacggccgacgcccagaccgccactgcggtgggatcgatgttggatagcgctcccatcagtcagctcacctcgccgaggtcgggcgggtcgagtcggagagagcctgtgccgccgcggcgtcgccacggttgcggctcagcgccagcgccccggcggcggtcagcgcgaggctgagcgcgacggatgcgatgaccgtggcttcggcaccggtgcgggagagcggctcgttgccggcgacgacgattttgcgggacggcttgttgccggccgtgctatcgttgccgccagcgttgtcggtgttgcctgcgaccggattgttacccgtgtcgccgctaccgctgccgttaccgttaccgctgccgccgttgttgcctccggcgagcgccgtgaccgcattggcgatgttcttcgtggcggtgtcggccgcgctgatggtcgccttcttgtcggacacggtcttttcggccgcggcgagcgtcttcttgaatgcggcgacccggtcggcggagtaaccgtccaggctcaccgtcttggcttgtgcgatttcgccgcgcaggttgagcagggagtagaagtggtcggcctgggcgatgtatgcgtcacggtcgttgttgaccttgcgcccgtagttcttcgccgcgctcaggtcgtcgccggtgatggagaatccgccttggatgatcgccttgtcgtcgtacgtggtgccgtaccagttgagcatgtattccctcgccgtgggctgcggcttggtgtcgacgttcgcggtcttgccgtggtagtccacgacctcatcggtcacggggccggccggctggtcggttccgggcagctgggcggcgttgttcttgttgtagtgcagcagcagcggcacctgcaggcgggtcgcgccgacgcccttggaatcgacgacgccgtggctgccgtcctcggtcacgaggttcggcaggtatgtgttcacgagatgcgtgtacaggtccgacagcgggtggctgccgttgttgtagttgtcgcggatgtggaacggcgagcctttgccggacgtgctgtcgaggatcgtatcgaacgtgtacacgtgcttgatgccgtatttgcgggcttcctggttcacgtagcggatcgtggcgtatgtgttgccgcaccaggtcgcgccgaagaagatgtaatggttgcctggcgactgcagcagcttctccagttcgccgtacgtcaccgatatgagcgagaagtccttgttctcgccctgcttgaacacgctggccgcgccggccgagacgttgttcaggtagtagttggtgtagaactggccgttggtgcgggtcgcggcgttcttcgcggtgcccagcacgcgggtcagctcggcgctgtcggcaacgttcgcggtggatgcgagcaccttgtcgccggtgttgtccttgttgtaggtgaacagggtcggcaggtcgacgacgtttgctgtgttcttgctttgcaagtcggtcaggccgaattcgtcgatggtctgctggaaccgcttggcgaatgcgtcgaccgcgttgttcttgtcgttgatgttgacgagcgtgtcggctccggcgttgtcgaggtgcgggtcgaaattgtagatcttctcgatgccctgcgccttggcggcggtgttgatggcgggcagtgcggccgtcgtcgcggagtcccacgtgccgccgatgagtatcacgaagttgcctttgccatagcgcaggatgtcttcgagacgttccagcgtgatgttctcgaacacgtgatccgaaggcaggttggggatgcccgcgtagtagtcgaatggcgtgtcttcctgggattgtgcggctgttgccgccgtggtcgtggtttcggcggcggatgcggcgttcccgcccgtcagcgcgaatccggtgagaccgagcgccgccgcggtgagcagcgccgcggctttagcggcgatggagcctctcgtgaggctgtggttggtgttggacattgttgtggttcccttctgtatttcttccgtatcgaattgcgttggtactgctgcgctgatggctcagcgggacgatggtccgtcgccgaggttgaagtcgtaccgcgcggtaggagcgccgccgctgtcggccacgttgagactcgccgatggcccggcggatggcccattcgccggcgatgcgatgggctgcagcacttcggtcggcgcactcgcgtcggcacgggcttcggttgcggcaatggcgttcgccgtcgtcgcgggggccggcgtcgcgccgtctgcgatgtcgaatccgtcgtcggaccggccgccgttcgctccggcgagcgcgggagcgcggcgcttgttgcgcacaatcagcgcggcgcccagcgtgccgatgacggcgagcgcgatgaccacgccggcgacgatgcgcaccaccgggctggtggtttcggcccgatcggtgaccggagaggcctgcgtggtggtttccgccgtatcagtgccgctgtcggtggtgccggattcggtcgtggtggtctcgccgccagcggtgtcggcggtgttgtcatcgctgttcttctgggaggccgcgtccttcgaggtctgagtggcggtggcatcggcgttcgtgttcgcggccgtgtcgcctgtgatcccggctgtgctgcccgtcgtgctctggccggactgtgtgccggtcgactgcgcgggctgcgactgttgcgcggtggtgttgcccgtggagggcttcgtcgtctgggtggccggcgagcccgaggactgcttcgccggggccgactgcttcgggttgctcggcttcgtggcgggggcgggcgtcgccggctcctccttctgggcgtgctccttcttgtagttcgcgcagtagctgtcgaacgcggccttctgcgctgagacgtcgatgccgcctccggggttggaatcgtaggccgaaccgccactggaacagcaggcgaccggattgtagttggtcgagcacaggtcgcacacgtcgccggccgcgtaggccgtgccgagcgcgaattgcaggccgccgaccgccatagcgcctaccacggccgagccggcgagtacgcggataagccggcgcttcacgggccgcccgttgcgtggcgcttcatgacgagctgatgatgtggacatggatattcccttcttcttgtcttccgcgccgtttttggatacggcgcggcggtacagtttggtggcggcgaatcgcgatatacgaaaacctgcgatgcggcagaatccgcatcgccgcgaatgatccggcaaccgtcggcgtaatctgccgggagtgtgaggaatcatgccggacggcgaatcacaatcatcacgatcgcgccggcaaacatccgaaacggactatcgagcggtctctcaccgctcgcgcatgatcggcagtccgcccgacagtgagctgacagccgatgccttcacgccttcattgacacgcataacgtactccttgctcagataagacacctgaccggggtgccgccccatcatccggggccgggcctgttcgcgggttcccgcgaacgttgacatcatcgtaggcaccgcgtcgccgcgttggcaaacccgcggttatacatagttgttatggcctcgtatcaaccctatatttgttcacgatgacagcagcgacaaccgttatggcgaatatcacgacattgccgatgatcagcagacggttcatcgtgtacagcagccatgcgatcagcagcaggtcgacgagcagcgcgacgatgcacaacgccgcgagcccggattgcggcacgcggccgagcaacggcagcgagcggaatgcgcagagcgatgagccgtcgcgcagtatcaggcgcaatgcggcgacagcgaccatcgcctgcaccacgattatcagaatcgtgacgctcgacgacacggttttcgaggaattcccggcgatcagcgggcactccgcggcgatcatgcccaccgaaagcaggcgcacgggagcgccggtccgagcggaacgctctcccagttcgcgcggcaaccatccgtccgcgcaggccgaggcgaccggatacgccacgcagccgaccacggcattgagcgtggtgagcagggcgaacgcggagccgcccaccacgaacgcgaccgtcaccggagccgggatgaatgcagacaggctgacggcgagatcccgattcgcgacctgggctatcggcaaggcgccggcatcggccacgcagatcagcgcatacgtcacgacgaccagcaacagcgagacgcgcatcgcgcggggcaccgtcacccgcggacggtccgcgaccgcggcatagttcgccacgccggccaccccgttcatcatgaacgtcatgtacacgcatgcgaacaggaacgccagaggtgagccgagaaacgtgtaatgcgcgagattcgcgagccgcacgtgcggcattgtcaccgcaacgtacgtgcccaacgccgccgcgagcagcacggccatcaccagttgggcgatggcggcgatgcgggcacccagcatgtgcacgccgaggaacagcgcgacgaccaacgccgcggtcaggcgtgtcggcagcgtgggcaggccgagcagctgcgccgcggacagcgcgtacgcggagatgtcgaacaccagaaaacacaggatataggcgacgatgccaccgaacacgggcggcagcagcgtgccgacctgctggtactggccgcccgggtaatcgccggacgagctggccagcagctgcggcaccagcgcgaacgcgcctcccagtccaccgaccagcgcggcgagccacaatccggtgcccgtgatgccgacgccgatgccggccatcgacatgacccccagaccgacgacattgcccgcgccgaaagcggccagatgaaccgtgtgcagtgaacgtgatgatgccatgatgcccctccccggccgaaaccttcatgacaactgaaccacatcatgccggcgatgagaacgccgttcccatatgaaaaatctatactgtgttcaagcgccacattgttcgatcgcggatggcggggccggggctcgtgtccaacgaccctatccgcggcgcatatctcccgtcgcgcgtcagctgctggtcaggaacgtctcgttgccgcgggtgaaatcaagcaccgcgccggcaagctcgacctcgcccgacagatcggggtcatcggcgagcaaccgccccgcacgttcgcgcgcgtcggcgatgatcttggcgtccttgaccacgcgcagcagtttcagaccggacttgccgcccgactgcgcatcgccgagcacgtctccggcgccgcggaactccagatcggcctgcgcgatctgggcgccgtcgagcgtgccctggatgacctgcagccgctgctgcgcgggaccgccgtcctcagcccgcgaaatcaggaacgcccatgaatccgtgccgccgcgccccacgcgcccgcgcagctggtgcagctgcgaaagcccgtaccggtcagcgtcgaagatcacgatgcagctggcctgcggcacgtccacgcccacttcgatgaccgttgtcgccaccagaaccggcgtggccccatccgcgaaatcggccatgacctgctgcttggtcgcgtcatcgtcgcggccggtcagcgtcgcgaaacggatgccacggaactgcggcagcgatgacagcctgcgctcgatctcggccacggaatgcagcggcggccgtgacggagcaccgtcaccatcctcctgcgatggcgcgctggcggatgtgttggcggccgcggtggcggattcgcgcctgtaggcgtcggaatcgtcgtacacgccgatctgcgatgccccacttgtatcgtcatcgccgtccgattcatcgtcggcatcgatacgcgggcagacgacatacgcccgctcccccgcgtcgatgcggccgcggatgtgggcgaacatggagcccatcatgcggccgtcgtcttcaggcacgatgaacgtgcggatgggcttgcgcccacccggcagctcggtgagccacgagatgtccagatcgccgaaccaggtcatcgccgccgtacgcgggatcggcgtcgcggtcatgaccagcaggtgcggcacgacatcgtttttggtgcgcagggattcgcgctgctccacgccgaaccggtgttgctcgtcgatgacgacgagcgcgaggttcggggcctggaacgtcttggagaacgcggcgtgcgtggcgacgatgatgcacgggtcgccgctggccgcgagcgcgagagcacggcggcgggcggccagtttcatgccgccggtcagcaggatgaccggcacgtgccgcgtgttcgcgtccgactgcgcgtgcgccgcgccgtcttgtttcccgctgcgtgccccactgtgtttcacgggatgtttcacggccgcgcgccccttggcatctccgtcatcggcagcggattcggtggccttgatcaggtcggccgggtcattgggagacagggcatcgcgggacgggtcatcgcacgtctcgacgccgtcaatcgcgcagagcatggcgctgatggtcgcatgatgctgctcggcgagcacctgagtgggcgcgacaagcaccgcctgatggccggaacccgccgcctgcagcatggccgcgaccgcgaccacggtcttgccggaaccgacctcgccctgcagcaggcgctgcatcggatattcgcgggccatgtccacgccgatatcatcgatgacctcccgctggccgccggtcagcgggaacggcagtgattcgatgaaccggtcacgcagcgccacgcccgcacaaggcagggccgcatccttgcggacattgctacgcgactggagcagcgccgtctgcgagacgaacgcctcctcgtagcgcatcgtgccgatggcccgtttgaaatccgcggtgctgagcgggtcgtggatggccaggaatgcttccgcgcgatgcagcagatgattcgattcgcgcaccgattcgggcaggacgtccgggatcgcgcgggccaggccgacggccacggcgtttcctgaccgagactcggcatccgctggagcggttccggcgccgctgatgccgccgtcttccatcggtttcattgtttgcggggcttccgttgccgcatcgcccgggagatcctgcccggttccagccagcaactcgatgcattgcactatcgactcatgaatgtgttcgctggagatacgagacgacgcgtgatacaccggtcggggtctgctgatgcgacgcaggcccgcttcgacggtgtcggcatcgtatttcagagcgctcatctgcacgacaccggagtattcgccatcagccggaccggagccgggagcgaccgtcattatttcgggatgggtgaactgcagttgaccgttgaactcgctcggctcgccggcgatcaccacaatcgcgccggaacgcagccgcatgctcagccaatcgacatactgcttcttgtacgagaagaacaccaaacgggcggcggcccccgcgacatgccgggaaaccgcgaaatccccgtcatccaccacggcctcgagccggtagccccgccgaacgttcatcggcacgacccgcatgccgcgcaccgacgcggagaacgccattctctcgccgatacgggcctcgcgcagtgcccgcaggggcaccggatcggcgacgcggaacggatagtaggtcaacgcatcgcccaccgtcacgacgccaaggcttttgagcgcgccgacacgccgcttgttcgtcatgatcgacgacatggtggtgttcaacgtgatgctcatacgtccctattgtggtgtgccggcgggacggcatcgcattgtcccctccgccagcggatataaagaggccccggagtcttgcgacttccggggcctcagtgaaacgttatcgcgcgatgtcacgcaaccacacgctgaaccttgccggccttgaggcacttgacgcacacgcggacgcgaacgttctggccgtcaacggtggtacgaaccggctgcaggttcgggcggaaggtgcgcttgttgcggatatgcgagtgagaaacggtgtatccgacctgcggacccttgccgcacactgcacaacgagctgccatgatggactcccttaataaccttgatgttcaagtcttccgtgttccagcacggatgcttgaacacacaacttcacaataatagcgccaaatacaaacaaatgcaaatcaagcgtgtatcattgcggctttcacctacacatccacacaatatcacccgtcttgactattgccgcatccagcaactcttcataaaatcacggtaaaacggttactgtatggcatacgatacatgcaacgcggcaatcgtcaaggaggaatgatgctcaattcacttaaaggcctgctttcacgcaaaaacgacgtgccctcccccacagtgatctcgttgggacaggtgtgggtcgacatcatgatggacatcgacgcgattccccaaccgggcggattcgccgtcgcgaaccataccatgccgtcggtgggcggcagcttccgcgtcatgcaggcggccagccggattggggcggcgaccaagcacgcaggcgtcatcggcaacgggccgtgggcgtcactgatccgcaaggctctcaacgacaacggcatcgagcacatcggccaggaccgcatcgacgccgattccggtttccgtctggtgctcaacgacagcgagcgcaagacgttcgtcgccacgtatggcgccgaatcacaaggcaacgagaacacgttcgactgcgtggagcccggcgagggcgatgtggtgcacatcagcgccaacacgctgatggatcacagcgcgtcaggcatcgacgccttcctgcatcgcaccgcttcggacccgacgacgcgcgactacagcatcgtgctcaatccgaccaacacgctgcacatggtcagcgaccacctgctggaggatctggtgctggtgcggcccatctggtcctgcaaccgtcaggaggcccgcacgctcgccgaccggcttggcgtgttcgtggacgattccctgtcgatgaccgtcggcggcggattcgacgactcgatgaaggcgctgtgcaacagcctcggcgccacgctgcgcgcgccgctggtggttcgtgcggggtcgcgcggcgcgtgggtgcgcacgccgggcggcgaagtcatccatgtggaggggtatccgacgaaggcgacgcacacccgttcggcgggctcgtgccacaccggtgccatgtgcgcactgatcgcccgcggctggtcgcttgtcgatgcggtgaagatcgccaacgcggccgcttcgctgggcattcagcgttccatcaacggcgttccggactgccccggctatgacgaggtcatcgccaagctcgaggaagacgagactccggccgaggccgcgaagtagccattccccgcagcgtcgcccggccgatatggattgttgcgcaacgctgtcgttccgtttgcgtccttaagcgcgcgccgaacggacgactctgcgcacatagggacgcaaatcgggtgttttgcgtccctatgtgcgcgcacttgtcgtttcggcgcgcacttaaggacgctattggaccaatcaccgtaccgatgaccgctcaggcgcggccaccccacggcgtctggccgacaatccccatatcgcgggcgagcctgcgatgcagttccttcgtcaacggaatcagatcgctttccagcggataattcagaaaaacactgcggcaacggcatgtaattcacccgcaaccatatgtagattcgtccatccatcacgatcagattcggtctgtacgggctcatcttcagcagttcgaccacgtcggcgggcacgccgccctgctcgctggcgcgctgaaacatcttgcgaccctgatagatggtcgcccacatgagtgggcctcgtggcaccgtgcacgagcataccaggaacacgatatcggtggcatagctggggttcgcgtccgatatgaactgcatcacgtcatagttgaacgtgatccagccgtccttgccccatgtcgtatgcggcatttcgctaccgaccgtcctcagcttggaaatcttggcgaaccacgccggagggaagtgcacgtcctcgtccagcggcgtccaaccgcgagcgaacatatccgcccgccgcgcctcttcgatgggatcgggcttgcgccgcgcataataggtgtaccagataacgaacgccgaccccgatgacgatcgccacgatcgacgcggcccattgcgcgcccgccccgtccaacccgtccgacccccgccggcccgcaacaattcacccgcaattcatatggaaacttggtatgccggaaacggcactttacgatatatatgaacacgacgtcaggagtccccatgaacgacagcatcgcagccaaacccgccgatgccccagcagacagtacagcggccggcacagagccggccctcaccgccaccgcgaaactcaccccgcgcgagaagaaatggatcatctacgacgtgggcaactccgcgttcgtgctgctgtccaccgcggtgattccgatctacgcgaaatcgctgatgcccgcggacggcaacatcgtgtcggcctggggctacgcgcagaccatcgcatcgctggtcatcgcgctgctcatgccgctgctcggctcgattgccgacgtgcagggcatgaaaatcaagttcttcctcggcttcttcggcaccggcgtcgtcacgtgctgcgcgatggcgcttccactgacgtggctgccgttcctggtcgtgtatatcctcgcgacgatcggactcaacggctcgctcacgttctacgattcgatgctgatcgacaccacgccgaacgaacgcatggacaaggtctcctcgcatggctacggctggggctacatcggctcgaccgtgccgttcatcgtgtgcatcgcgttgatcttcggcggcccggcgctgccattcggctggacgacgaccggctgcacccgcgcatcgttcatcatcaccgccgtctggtgggtcgcgttcacgatcccgctgatctccagctaccgtcaggagcattaccgcgccacacgcgaccagctgggaacggccgtgcgcggcaccttccgcgagcttggcggcaccttccgcaagatagtgaggaacaagccgctgtggatgttcatgctcgcgttcttcttctacatcgatgcggtgaacacggtgatctcgatgagcacctcgtacggcgccgagctgggcatcgactcgactcagctggtggtggcgctgctggtcacgcagttcgtggcgttcccatgcgcgatcctgtacgggcggatggccgggcggttcggctgcaaggcgatgatcgtggcggcggtcgtggcctacatgtgcatcgtgttcttcgccgcgttcttcctcgtgtcggccgcgcagttctggatcctggcgatcctcgtcggcatgttccagggcggcatccaagcgctgagccgctcgtattacggcaagatcatccccaaggaccacgccaacgagtactacggcttctacgacatcttcggcaagaccgcgagcattctgggcacgttcctcgtggccaccaccacgtcgatcaccggcaacgcctccctcggcgtgctttccatcgccatcctgctggtgttggcgctcatcttcctgctcctgcagaaggacccaacgcaagcgtaatgtcacccatcaatcagcaacaggaacgccgaagcagcgataaaacggcataccctaccgcccgagccgcgacctgaaacaatttagccctgcacaacgcacatattttgacagggtggtagttgtcgcaaattctgcgacaactaccgttggtaaatcgaacgctataatcagaaactttcagatgctgagttccatgcaataccccctgtgaccgcaatgcgggcaggtaagcttgcgtgtcttgggcgtgtgtgcggcgaatacgaactctcgcatacccggctggaaggtctcatggcaagccggacataggtactgcacgcgggagcgatagtacttcatcgccgcaacagtgagcgcaatcgccagcagaacggcgaccggcagcggccaccatacgtctgtcatcacaccaatgacgaggcatgcaatttgcaacaaagtcgcgggcaatgtgattgccagcatgaccaaatatgtggtgcgcagggaatgagtggttgtggtgttcataacggttgccatgtcggttaatgttgacgatacgaagtcagacgccgagaccgtcagtgctttgcgcagctgcaagcagtcatcaagacgttgcttctgctcggcgatacccgactgcaaggatgccgtctgctgatccagcaaatcaaccagcacccgttccggccgctcgtccgacagaatcgagcgaatctgctctagcttgaagccgagtcctttgagaaaaaggatgacccgcatccgctcgacctctgcagtcccatacagccttcggccgccgtcgctgatctcattgggaatcaacagacctttggcgtcgtagtactgcacggttcgcacactcacaccagtgagtttggcgatgtcccctgtggtgtatcggctgtccgtttcatcgtccatcgacatggcccaacctcctttcaccaagcaatatgccgcattacgcaacgtcacaagcaacatatgacgcaacgtcgaccacaaaaccttcacatataagcggactgtagaaagacatcgaccatcgcaattgtgcactggttcacagtgaataccccgaaccagttagacggcagaacagaattacagccacacctgttcttcaggctttacctcgccgaccacattggccacacgcatggcatcattccgactcaatctaccggtgaacccctgtagatccgaccggaggaaccgcaccagctgcgcgcagcgagcggtcgtcagatgggtaagcccggcatgctcatactcgggcagttgcacatcgcccgccccatgccaggttggattgctggtcagtttcacagccactccaccgtcgtcgtcggcttgtatgacgatggcggccacgtaatggctgcgtgatttcgtcggatcatcctcgaaccgcacccgcatgcgatacacgtcgaagacatgcaattgctccggaaccggcatcaattccggaatatcatgattattcgccatcacgccacgccttgggcagtacggcaacaccgtcggcgccccggcttggattcaacaccatggcgttcggcacttcgaccaccggatacccctgttcgtcgaccccacggtacgtaaccccattggcggcaacatgtcccgcgtgaggcagcacgggttcaggcgccttcacctcgaacggaatacgacgctgcgacaccaactgcacgctggccatattcacgaacgtattgaaattcaatcccatggaatcaagaatggcgttcacttcggctttgagatcatcatccatgcgaacagtggtagtgctcataatgaatcctttctaaagccaattgtattactaatgacttcttttctcaatataatccgtaggatgcttaacgcttttgcatcatgaccttgacatcgggacaatcccacgcgaaaccaatctctgcctttgcgctcatcagctggggagctcacggtcacactcatgcgtcgcagaccacgagcctcgctcggcgtgctgtctatcgcggtgctgctgctggtcgtggcgctcgtgttcctgcttctgcagaaggatccgacgcgagactagagacgcctgctaagagcgggccgcatgcgacccgatgaaggcgcgtacggtatccatgtactcgtccatgcgcaccaacagcgcgagatgaccgccgtcaccatgtcggcgtgcgacgcagcatcgatcagcaaatcggccatatgccgctgatacggcttgctcagcaactgcttgaggacatcgcacaggccctgcatcagccgccgttcgccagacgacaggtcttgcgtcttgcgcatcacggcccacgccatcagacgccggtgcagcggcatcgatatcaggcgaagcgtccgcttccacttgcgatggcacgcgccagttcggcgttcgtcgcgaaccgctcctgataatcgaaggtgatgaccgagcggtcctcgacgaaccgttcaaaatgcaggcagaacagtcggacagcccgattccgcccggcaggagcacaatcgttgcgcgggcggagggattgcgatgataccggtatgcgaagggttcgccatccggcaatcgcatggtttgcaacggataccgctcacgagacgcggcgagatcatccatcggccgtcctttccttgctatttcgtccgcccgggctgcccggcgccttgtccgtcgtcgttgcgcctgcgataatccttgaccagctggatgatgaggctcgctatgacgcacagcacgccgccgatcggccacggcagccagaacaggcccacggagctccagtcgtcatgcagcatccacggccccagaaacagtaggcacagggcggttatcgtggccagcgacatgatgatgccgcataccgcaccggtcagattgtcgtagaaatcatgcccggctgcacgctctttcttgccatcggtatcggccttcttgttgtagccgtcgatgtcgagcatgccgtgccgtattccgcagtaaacgaaactgaagacggcgaccgagtacagcatcagcatgatcgcgttcggccatccatcgctgatgcccaacacgtcatcggcgtacacagtcaccgctatgccgatcaggattgccgctataccgcccacgatgccgaccaccagcagacgcgtctcgcggctgcgatcctcatcggtgtagaaatcctcgatatacggatggcggcgtttgaactcggcgtgcgacatgccgcccgggaccagcatcgccagcccggcgatcacacctatgcagatgcacaggaacgtgaggaagtcattgagccgcgtcacgccgaggatggagttgcttgaatcgaacagattgcagataccgaccgccgcgatgatcgccgcaacgccgccggagatgagcagcgcgaaccggcggcgatgctcgtcgtagccggtcaggtcctgcggcagggtggccgtattggcgtgcacggcggggcggggcgaaccggttccgtacggtgtctcgccggtcggcacgcccgtgaggcttggctcgatggcaccggccgcaccgagatgcgcgggctcgtcggcgtcgcctatacttcccttcgcgttccccgcatgtgcagggctcccggcatcttcaccggtcctgcctccgacagtcgtgccgcagcctgttgccgatgcgccgtgcgagtccggccggctggtgctcacgctcacgtcgccgagcacgaggtcgtcgagcgtgcagccaaacagatcgcagatcatgagcagcttgtccatttcggggtaggccttctcggattcccatttcgaaatagcctgccgcgagacgccgagcagcatggccagtcgctcctgggtcatgttgcgttgggcgcgcaggtattgcaggttggtgcggaagctcatcgtcaaatcccttctcaagtgattccatcatgtcatgttcggccgatgaccccactatggcacgccgtccacgccatccgccaccatcttacggttgcaatcgccgaccatgccccgcaaccgtgcgcaaccacaggttgcatcggcggaatcccgccgttttgatgtcctatatcacaatcctcacgaagtcgattttccccgcctcaaccgccgccatgccgtatcgaggtcgagcgagcggcccggcagcttgggccaggtgtccaatccgtccccatatctgtgcgggattaagtgcacgtggaaatgcatcaccgactgcgtcccatgatgacccttcccggtggcaagatatgcaacgaatcgtcctcaatgatacaggcgcgagtatgataccgggccaatcgggcatcaagcgaaagcaagtctcgggattccgggaatccgcatcatgcgcacttgtgcgggaatatgagtcatcctcgcacaaacatcatcgagaacgatcaccgcactatgcgtcgtacgaatcatcatcacgcaccgaatcatcgtcgtcgggcatgaccgcgacggtcctgacctcggttttcagcaggtacttctcggcgaagtccaatgtggtggacaccatcacaacccccttcttgacgtgcgaaccatcgatatggcaccggcgaagccccttgccgccggcacccaccatcgaagcacgtcgcagggcgcgacacaagaccgcgggcatatgaaaaaactatggctcgctcaaccgacgctctcaaaactcgcagatacaggccgtcatcgggcagctgggccagatacgggcgcagaccggtaccgcgataccagtcgaggatcgcctcatacccaggcagcgcatggtagtagttcgtctcccacgcgtcgacgtgcgcggagagcggggcgagcagatcatagtatgcgcttacgtcgaaattgtcgccgccgagattgtagtagcggcgtatctcgctgatccactgccgccatttcggctcgcacgcggtctcgcgcatgatgatgtgcggcggcaggttgatgttctcggtgaattgcgccgacgcgacgccgccggcgttaagccgtcgcagcatggagggcagcacccgttcatgattcggcacccattgcaggcaggcgttggagaagactacatcgaaatcggtgtcgagctcgtcgagcgacccggcgtccagcacatcgaaatcgcagtcggggcggagcttgcgcgccgaggcgatcatgtccggagagctgtcgatgccgaggatcctcgcctgcgggtataggctcgaaaaaacaagaaacgcccctcccggaaggagggacgttctgttctgtggagctaaggggattcgaacccctgaccctctccatgccatggagatgcgctaccagctgcgccatagccccgaaaaccgaccaccgtagcggccgtgggtgatgtaggaatcgaacctacgaccccttccgtgtgaaggaagtgcgctagccgctgcgccaatcacccagtgcacaccgaagtgaacttcggcatccgtgggcgatacaagattcgaacttgtgaccccttccgtgtcagggaagtgcgctacctctgcgccaaccgcccgggtctgcgtgccgaccggccgaatcgcttcagccagccgaatctgcgagcggacaacgggactcggacccgcggtctcaaccttggcaaggttgcgctttaccaactaagctatgtccgcaatgtcaccttgacaggcaacaggggaatacattacccgaccgcctgtacaaacgggacaaaaatcgcgacacgcctgaaattccgcggaatcggtcaccgctctttgttgctgacgggcagcccccccccaaaaaaaaatggcatttatgaacagcaggttgcacacaccgaacgccacggtgttggcccgcgtgcccttgtagatgccccaactcatcaccgtcatcgggctcatccatgccagcgggagcaacgtccatcccaacgcgaccatcgagatgatgttgaggatgaatgcagcgagacgcaggttgcggtcgccattcgtcatcgggtacgcgcccggcgaatacggttgccgtccggcgtcacctgctgcgccggcgcgaaatcaccggtccattcctcgccatcccaccaacgcatcagcgagggatcgcccgatgggtccggataccagcccggcggcatgttcatgattgctcccgtccggctcgggccacttcgctccggctcatgccgctcgcctgtatctcgcccgcgcctcgcctattccgcccgtcaccttcatcggccacgaatcaccgcgccgcgccaccgaaggcgcgatactggcaaacctgcccccatcgtacagccccggccacgcgcgacgcacataatgcgacatcatcgcgccgcatgctcggtgtccctccccgacccctccccccccccgaatgccgcctgtcgcgcggtttttgtaccacgctgagagtattcaagagagtatgacagtaaattcctcgaccatggtcaaagagttcaccaatccgctgaaggaaccgatcgacgacgatatcaacctgtttgatttccttgaccgccgcgcccagcgcgacccggacggctcgaccgtcgaatacaaggcggacggcggctggaagtcgttctccgcgacgcaattccgcgacctggtgatcgccttgggcaagggtctgatcggcttgggtgtgaagaagggcgacgccgtgtcaatcgtgtcgcgtacgcgctgggaatggaccgcgctcgacatggccatcatggcggtcggggcgctcaccgtcccggtttacgagacgaattccgacgctcaggtaagctggatcttcaacgattcgcaggccacgatcgcgttcgccgaggacgacgggcagcgcgacaagatcgaatccatccacgatgaggtgcagtcgctgcgcaaggtgttcgtgatcgatgccggcgcgctcgaagccttgcaggcgtatggcaaggaagtgagcgacgaggagttctgggcgcgcaagaacgacgcccacggcgacgacctcgcgacgatcgtctacacgtccggctccaccggcacccccaagggcgtggagctgtcgcaccgcaatctggcgttcctgtgcctgtcggccatgcagtacatgccccgcgcctgcgcgtggcccgaccgccgtctgctgctgttcctgccgctgagccacgtgttcgcgcggttcatggagctgctgagcttctgcggcacgctgacgttgggactgagttccgatatgaagacgatcgtcaaggatttcgagtcgttcggcccgacgctgctgctggcggtgcctcgcgtgttcgagaaggtgtataacgcagcgtcgcagcgcgccggcaagggcatcgccggcaagatgttcctgcgtgcggcggacgtggcgcgggattggtcgaaggccgagcaggccggcgagaaactgccgtggcgggggcgcctcgcccacgggttctacgagttggtggtgtacaagaagatccgcacgattttcggcccgaacgccgacttcgccatcaccggcggcgccccgatggacgccaacctttcgcacttcttcaacggcatcggcatgccgctgcttgagggctacggcatgacggagacctgcgggccggtgtgcgtgagcctgccggagaacaatcggatcggcacgatcggcatgccgatgagcggtgtcaccgcgggtatcgcggacgacggcgaactgtgcgtacgcggccatctggtctgccgcggataccacaaccatcccgatgtgaccgccgagcagatcgtcgacggctggctgcacaccggcgatctgggcgacatcgacgaggacggcttcatttcgatcaccggccgcaagaaggatctgatcatcaccgccggcggcaagaacgtctcccccggcctgttggaggccgccgtgatgacatcgccggttgtgaaccagtgcctggtcatcggcgaccggaagccgttcgtggccgcactggtcacattggatctcgccgatgcgaacgcgtggctgaaatcgcagggcgctcaggaggagtccgacctggcgtcgctggcccgcaatccgatcgtgcacaccgaagtcgagcgtgcggtgaatcaggccaatgagggcgtgtctcgcgccgagtcgatccgcaagttcgagattctgcccgacgagttcacacaagacaacggcatgctgacggccagcctgaagacccgccgcgcgcagatcgtcgcgcactaccgagaactgatcgacactgtgatctacgtgccgaagaagaagtaggctcacccggcctgcagtcgccacgttgtttcctgtttgcttgttccagtgttcgcgcatgcggttgctgttggctgctcccgctttgcggttgcagctcgcgtgttcgggtccgttgtatccgtcgcgccggtcgttatgtccgaggtcccgtgcttggccgcgggtgacgggcaggtggcagtgggtgtatgagcatccacgtagtgccatttattgtttgcctagtcctgcggtcgttaagattcactgcgtgtcgcgtgttctcggactgcatatctctcggcgtcaagcaggtcgccgaacgcctcggcataaccagtggcggcctgctcaacctcaagctccccgaacccgacgccatgataggccgcacgcgcggctggctcccggagacgatagacggatggaacgcgaagcgtcccggtcggggcgtcggcggaggcagaccccgaaaaaacaagtgactggcatacgcggttggcttcgaaccaacgacctgcggttttggagaccgccgctctacgtctggtgcgcaccaagcggtatatgcggcgttcggcgcgccgcggcgaccgaaatcgtctgtgcatcaacactaacaaccgttcgcgcggttcgctagaggtcgtgaggatttttcgcctttcgcgctcttcccgagcatgccggccgcgcttgggccgtgcagccggcttggaatccagtcggcacagggtatccgcatgggaagctgcgctgcgtttgcgccggctgctttcgcgcatcggcatgactcatttcgctcgcgacgcgccggccgggtacggcgcggatgccgaatcgccggcatcgccgcggcgtccgcaggcgcgttgacgctggccacgtcggcgttcatgttccgattcgtccttgacacgcaggcgccgctttcgatgatgaaactggtcagggccggtaaggttcccggcgccaagctggagggcgtgcgccgtgatgcagccgaggaggcaagggccgcatcggtcgacggtcgaccgattcatcagcgatgcgctggccggatgagccgtaaagcccgaccggctgggccatttacgggctgtggagggcgaacagaacgcgaaaatacgggttgaaatagccgaaatccgtaattccccgtgtgaaatcgccgtttttcgagctcaaaacggcgatttcgcacggggaattgcccagaacggctatttcaacccgtaatttgacgaggatgatggggcagatagggggggggcagcgattgcggttgaacgctttcacttcgcgctgagccttgcccggctcatggcttacattgtggtcacatcactgccgtcggagctgtacgaggaaccggaaccgctggagctgctgccggagccactggaaccactgccgagctggctgtccgactcccctgagccaccatactgctgagactgtccattgccgaattggccgccgctgggcagctgccccatgcctccgggcatctgcatctgctggctgctgcccgtgccatcttcgtcgtcggtcagcgcgttcaccgcgagcgctccaccgacgccgcccacgaggccacagaccagagacaccacggcgagcaatgcccacgtcttaccgctcaacgcgtgttcgccgcccttcgagcctttcagtgtcgggacctgaccgcccattgctccaggcaccggcccccggccgttccaatccgcacacaacggcatccggccgccctgcgcgttcgcatctggtgtattcgcgcctcgcacgttcgcgccctgcgcgttcatgttctggccactcaccgcttgcatatttcccggctgcggattcattgcctgcgtcggcgcattctgcgcgtaccacgccgcacgcgatccctcgccgtagctccccggcatcggaccgttcggcgcatagccggaactgcccggagctgccgcgagcctatacccagccgagccgtatccggcggttccgcatccagcagccccggtcccggcagcccattcggcgtctcccagaccagccgcacgattccccgcatactcgtctgtaccgccgttgtctgccgcagcccggccaccatcggcccgaccagccgcggaaccgggctccacgccccagccgcccgccgaaccgttagtcaccgaaacatcagccacagcggcgtcattcacagccgcttgacgctgctccgaaccggtgacgttcgccgccgcctcgatagcgacgccctcgatggcaccatccgcgctgttgccgctctcgccgccattcgcattgttgacattgttgctgttgttgctggtcatgatgactcctttgacaactgactgatgaagtgattgctgatgttgatgtctggcacgccgccatggttatgccatcgtccacgctgtcgatgtgccgaaccggctgtcgaactcgctgcggtcgatggtgtcgctcgacagctccgtgtcgctcccggccgagaccgaggtctaatacgagccggtcaccgtgacggtcacgtcgccgctgccggagaccacggtcttgccgttcgccacgatggtgacggtgttgccgtcgccgccgccggaagcgacgttgagcgcggaaatggtcgtatccttcgtcaccacccacgtggacgtgccgtcgacattcacagtgatgggggcgtcgctcgccgtgcccgtgccggagccggccgccgcgttgtccgtgagcgtcgccgcgtcggtgtcgaaatcaagctcagtgttctgcagcaccacatcggcggtcgtgttggtgaagtagaacatcgaccctgatccgatggcggagctgagtgtggaatcgaccgactggaacgtggcgtgctcgccggtgctgccttccgcatcgcccgaggtggactggtagatgatgatgccgttggcgatcgggtcggatgcggttttgccggtgaccgtgctttccaacgtcgaatccttgatcaggatcgtgttgaggccttccatgccggcgatctggctgccggatgaggttccggagacgttgttcacctgaatgtcgccggtggaatacagcagcggggagccggagccggcggtgctcagcgtcgcatcggcgagagagatcgatccgccgcctcgatcggtggcgacgatggcgctgtggccgccctgcgtgtccgcggtgatcttgttcgccaatatcgtgccgccgtaggtcgcgtccagcccgcgtgaattgtcggccatggtctcaatcgatgtgtcgttgacgagcgccgtcccggaatcggtggcgaagacgccgttcgacctggagctggagacggtgatgtcggtaccgtcgatgacggcggtggagtcttcgccgacggtgagcgacaccgagtagctgccggaatagtcgtattgcatggtgttggcgctgccaccgaagttgccgctcggcggctgcatggttgaggcggagccagcggaaccggccgagaggtgccgaatcagcaccatgccgccggcgcccgcgcacaggccacccgtgagggcgaccatccgcctcgtcgcgattaccggcggtcgacgccgccgcgagccgccggggctcgcatggggttgcatgtcatggggtttcatggtcgtcgtcctttccttggattgactccattgaacgacggctttcctagcggcccctgtgtctgacgttgaaccgtcctgcaaccttgcggaacggttttcgaatgttttctgatgctttctggatgctcttagacggaacgcgctctcaaaactcgcagatacagccccagaatcgacattttgttgctgtatctgcgagttttgagagcgcggtttcgcctacaatccgtattcctcgcgcgcgaagcgctccagcaccggaatcgaccgcttcaccttgtcggtgtcgatgcagtaggccatgcggaagtacccggacacgccgaagctgtcggacggcaccaggatcaggtcgtattccttggccttcatgcagaaggcgttcgcgtcggcttccagcgccttcgggaagatgtagaacgttccgcccgggcgcaccacgtcgaagccgatcgaggtcagcgcatcgtacagcaggttcatgttcgtctcgtacacgctcaggtcgctggtctcgtcgatgatcttcgccacggcgagctgcatgctggagctcgggcagttgtggccggtgccgcgcgagatctgcccgcacatcggcacgatgagttcggcgtcggtcgcccgcgggttgactgccacgtagccgatgcgctcgcccggcaggctcagcgacttcgaccaggagtagcaggtcagcgtgttgtcgtagaacttggccgggtacggctgcgtgccgccgtcgaacacgatctcgcggtagggctcgtcgctgatcaggaagatgtcgtgaccgtattcggcctgcttcgcccgcaggatacccgcgagccggtcgagcgtttcggccgaatacaccgcgccggagggattgttcggcgtgttgatgagcacgaccgccacctcggggttcagcgccgcctcgaacgccgcgaagttgatctggaagctctcgatgtcggcgggcacgacggtcagccgtgcgcccgcgccttcgacatacggatggtattcggggaagtatggcgcgaacgtgagcacttcgtcgccgggcttggtgacggcccgcagcgcgtgggcgagcgcaccggcggcacccgtcgtcgggaagatgtggccggccgtgtaatccatgccgaaacgccggttgaggctttcggcgatggtgcggcacgcctccgggttgcccagcgacgggctgtatccgtggagcgcgaccggatcggcggtctcgtacatgtcgatcatcgccttggtgaagctggacgggcacggcacgctcgggttgcccagcgaatagtcgaacacgttgtcgtatccgatttcggtgccccttgcggtcgcgtattcactcagggttcgaatgaccgatttgccgccgagcatggctttgtatgtttcgttgatcatggcacaacctccccgttggactctggtttcgtttttaccaccgaccacgcacaacagggcatgtcgccggttgttgttgggttcgcgcgggttgggaaccgggtatattgacgggtaaccggtcacccgcccggcccttagcggctccggacgacaagcatagccccgccgcggcggaaaggaggtgcacgacgcccaacatcatcgattatgcacgttccgagacccgcccgttcggcgtcgacgcaccgttcaacgccgtcgacgcgctggtgctggcgtcgctcgtctatcaggacatgccggcatgcgtgcggactctggccgatgtcgaggcacgatccggcacattccgcagacgtctgagcagcatcgacgtgcgccatccagtgcgctcgattcgccatttggccgccctggagttcggcgacgcaacgctggcttcggtgtcggaggcgctgacccccgatgattttcatgtggagagcggccataatggcctcgccgacccacgcctgacgcaggagctgtacgccgccatcggagtcaatccgcgctttgcctgcgttcgcgtggacgcatccgatgagcatttcagcgaggaacagcagatgcagttcgctgccgtgaccatgctgctgccgggcggcacgctggcggtggcgttccgcggcacggacgactcgctcgtgggttggaaagaggatttcaacatggcgtttcgctacccggtgcccgcacagcatgcggcatgtgagtatgtgtgcgccgtggcgcgcctgtggcgcggcccgatggtgctgctggggcattccaagggcggcaatctggccgtgtatgcggcgatgaacgcgcccgagccggtgcagcggcgtgtcacggcggtgtattcgctggacgggccggggttcccgtcgcagatcgtcggcagcgatccgtatcggagcgtcatgcccctcatcgtgaagatcgtaccggactcctcgattgtcggcatgattctggagacgcccgagccgatgcgggttgtacgctccgaccagaagggcgtgatgcagcatctgacgttctcctggcaggtctcgggcaatgatttcgaatatctgccgcaggtatcgccgagttcccagctgttcaaccggtcgttgaacggctggctggaatcgttgagcaccgaggaccgcgagcgcgcggtggacgccctgttctccgtgctgcggtcgagccatgccgacagcatttccgatctcatggcggccggcctgaaggccgttcccacgatgatcaacacgttcgtgggtctgtcggaggcggatcgccgtcatctgatcgaggcgatggggctgctcatggccgcggtccggtcccgttcctcgcggtagccgtctcgtgcccgaactctgtttcgccaaccgagaaaaatggacagttcgcctattttccgatcatccgcctcacaatccgccctacaataatccatatcacacatatagacatagtgcccaataaacgatagccgcacgtcacgcaggaagggaaccatcatgccgcgcccacgcaaggattccgagatactctccgcgaccgaacgcctcgaaaacgcgttctgggagctgctcgcagaccacgaataccgcaagatcaccgtcaccgaagtcgtacgcgaggcgcatgtcaaccgcaactcgttctactaccattacgccagcctgccggagctggccgattcggcgatcatgcacgccgtggagcactcgaccgtgcaggcgccacgcgccgacctcaatcccgacatcgaatggaggcgccaatgctccctggtgatgaacgacccagttcagcggcagcggctcgaccgtctggcactgctcgccggcagccatagctcgcccgagctcatcgagtcgctgaaggacttcggccgtctgatgatcatcaacgacctccagctcgacgccgacaacctggatctgaaaaccgacctgatgctcgacttcaccgtcggcggtatcctcgcggtactgcggcggtggccggagctgagcaagaaactctcggtcgacgacctgctcaatgaggatgtcgccgtgctcgccatgggagtgtacctgtcgatgtcgaaggagaacatgctggcctactggagccgcattttcaaaggcgacattccaggagatttcaaaaccgcccactaaagtggcttgcagagcagtcgccgccgcggggtgcgcgacgcgaacgcgaccctggaggcgacatggatcagatactgcaatggttcgaggcgaacgccgggaaaatcatcttcctgctggtggcgatcgtcgccgcgctgttgatcaccaagggactggcacgagtgatgcgcaaggtgctggatcggacggacatgccgagcgcgtcgatattcatcaacatcatgcgcgtgctggtgtggatactggccgcgtccatcgtgctgcagccggtgttcggcatcagcccgacaacactgatgaccgcgctcggcgtcggcggcatcgccgtgtcgctgggtctgaaagacaccgtggcgaacgtgatctcgggcttcgggctgatgctcggcaaggtgatacagccgggcgatctggtgtcggtcgcggggacggccggcgtggtcaaggacatcacgtggcggcagacagtggtgcgcgagcgcaacggcaacgagatggtcatacccaattccgtgctcaacaccgcgtcgctggagaagctcacgccgtccaatgaaggatgcgtgacgatgacgttcaccgcgaaggccggcagcgacccggcgcacgtgacagaggcggtgaagcgcgcggtggccacggccaccgtcgaattcgcgcaacccggcagtgaaccactcgtcaagctcaccggtttttcgccgtacggcatcgaagtgcaggcgctggcgttcacgcgcgacggcgtgttcctgtccaccatgcgcgacgccatggcccgcgcgatagctggatgcgagttcgtggagcagcgcgccgcggtcggcgaataggggtcgcggcgcgttcggacttacgcgcgaatccgggcaccacagcgcctacacacgcaccatgcagcgtcacgctgtgcgggtcacgtcacgcagagcgagcgcacagagtgacgcatactccaaaaacgttgaaaaataaggcttctcacgaaccgtcacgctgtgcgagcgctcgccgcgtgacgtgacccgcacagcgtgacgcacttatgacgcattgaggggagaccgggtattgagcccggcctcccttcatcgcgactcggccattatgcggccatcatccggccatcacttgtcttcggtgacgtcttcgaccgtgacgtcggcatcggaaccggcatccggatcctcgggcatggtaccgagttccagatgctcgccaccggtctggtcgacgagcacggtgtcgccgtcgtgtaccttgccggcgagcagcatgcgcgccagctggtcgccgacctcggtctgcaccagacgacgcagcggacgagcgccgtacgccgggtcatagccggtgttggcgagccattcgcgagccgcgtcggtgacgtcgagcttgatgcggcgatccgtcagacgcgaggccacctgagcgacctggatgttgacgatgccgcccagctcctcacgggtcagcggatggaacatcacgatctcgtccagacggttcaggaactccggcttgaagttcatgtgcaccgcgtccatcacggccttcttcttggcgtccgcatccatgtcctggttcaccaggaactgcgagccgaggttcgaggtcatgatcaggatcgtgttcttgaagtccacagtccggccttggccgtcggtcagacgcccgtcgtccagcacctgcagcagcacgtcgaagacttcggggttagccttctcgacttcgtcgaacagcaccaccgagtacggacgacgacgcacggcctcggtcagctggccgccttcctcatagccgatgtagccgggcgcggcgccgatcagacggctcacagacgccttctccatgtactccgacatatcgatgcggaccatggccttctcgtcgtcgaacaggaagtcggcgagcgccttggcgagctcggtcttgcccacgccggtggggccgaggaacaggaacgagccagtcggacggttcgggtcgctgatgccggcgcgtgaacgacgcaccgcgtcgctcaccgccgcgatcgcttccttctggccgatcacgcgcttgccgaggtagtcctccatgctcagcagcttctcgttctcgccctgcatcaggcgaccgacagggatgccggtccactcggagacgatgccggccaccgaatcggcgtccacatggtcgggcaccatcggctcgggcttggtctcgcccgtcgcgccgtcttccgcatcggccttctcagccgcgtccagctgcttctgaatcgccggaatctcgccgtacaggatcttcgacgcctcggccaggttgccctcgcgggtgaacttgtcagcctcgacgcgcttggcgtccagctgggcgcgcaggtcgccgaccttgttgtggccggccttctccgcatcccagcgggccttgaggccgctcagcttctcgcgagtgttcgcgagctcgttctgcagcttctccaagcgctccttgctggccggatcctcggccttcttaagctgcatctcctccatctcgtagcgcgtgaccttgcgctgcagttcgtcgatctcctccggggaggagtcgagctccatgcgcaggtgcgcggccgcctcatcgaccagatcgatggccttgtcgggcagctgacggccggaaatatagcggttcgagagcgtcgcggcggcgaccagcgcgtcatcgccgatcgtcaccttgtggtgcgcctcgtaacgctgcttcaggccacgcagaatcgcgatcgtgtcctctacgctcggctcgcccacgaacacctgctggaaacgacgctcaagcgccgggtccttctcgatgttctcgcggtactcgtccagcgtggtcgcgccgatcaggcgaagctcgccgcgcgccagcatgggcttgagcatgttgccggcatccatcgagccttcggccgcgccagcgccgacgatcgtatgaatctcgtcgatgaacgtgatgatctggccgtcggcgttcttgatttcgttgagcacgctcttgaggcgctcctcgaactcgccacggtacttcgagccggcaaccatcgaccccaaatcgaggctgatgagcttcttgttctgcagcgtggtcggcacatcgccggccacgatacgttgggcgaggccctccacgacggcggtcttgccgacgccgggctcgccgatcagcaccgggttgttcttggtgcggcggctcaggatctggatcacacggcggatctcctgatcacgcccgatcaccgggtcgagcttaccctccttggcgcgggcggtcagatcggtggagtacttctccaacgccttgtagctgccctcagcgtccgggctggtgaccttggcgccgccgcgcacgccggggacggccttgcgcagcgccgcggccgtcacgccgttcgccttgaggatgtccgcgctctggttcggcgcggatgcggcgatgccgatgagcaagtgctcggtggagacgtactcgtcgcccatctgctgcatctccttctcggcctgtgccagcgccgccgtcagctggcggctcgcctgcggctgcgatgtggtggacccgctcgccgccggcatcttgaccagagcattgcgcaccgcggcgccaatcgcctgcgggttgccgcccgccgcctgaatcagtccctgaatcacgccgttttcctgacgcagcagcgcatccatcacgtgcagtgtctcgacctgcgcgttgcccgcggcagacgcgctctgaatcgcatcaccgatgacttcctgggccatggtggtgaacttctgttccatatcaacctccgtatgtctcatgcgccttggcggccgcggcccacgacatccgaaccgccccgcacagcgctttccgtctgtgtctgatacgcacaaccgattcggcacccattctattcccgaaagttgagcgcacgcgactcaagttttgcactgattttgaagcgccaaaacgcaatgtggataactcaaatccgtgcgacacgctctcaaaactcgcagacacgaaacccgaaaccgccattttccgccaaaacagttctcgtatctgcgagttttgagagcggtcatgtttgagatcaacgaagaaccgccccgccgcgactgtcacgttcaaaaccacgcggcggacgcgcgcgaaagacatcattccccgcgtatggcccaatacggacgcctcgggcgcaaccatcgaggtgcatgggctcctatgcacctcccccgaggcgctgttcgcccaaatggccaaagagctgtccctcgaagacctcatagaattcggcgactcgctggtatgccgcgaccccgcacgcagacggaccactctggccgaactcagagaattcatccactcatgcgactcgttccaagggcaaaaacaatgcatcagggcactcacccagattcgcgagaacaccgactccccggccgagacccacttgcgcctgctgctcaaacggtatggattccccgagccaatcatcaacgtcccggtcgaggcgacgggcaatgccgcgcacggtcccgcaatttcggacggcctgcggccgacccaatctggcctcgctgtcgcttggctcgtgcgccgcgacagcacactgtgctgtcgcctagccgcgcacgaccacgttgcggagggaaccgatgccggctacgtggacgatgggctcgtcgccgggatcgaggtgaccggaggcgttcggggtgccggtcatgatgacgtcaccgggcagcagggtcgagaacgaggaaatcgcggcgatctgctcggggatgccgtgaatcaggttcgcagtggtgccgcttgccatcggcacgtcctcgccgttgagcgtgaaggagatcttcgcgtccttccagtccagctcggtctgaatccacgggccgatagggcaggacgtgtcgaagcccttcgcccgcgtccacatcggatccagcccctgcaggtcacgcagcgtcacgtcgttgacgcacgtgaagcccagcacgtagtccatggccttctcgaccggcacgttcttggcgatacgccccataatcaccgccacttcgggctcgaagttcatatcgttcgaatacgacgggatgacgatcggatcgtccggcccgatcaccgacgtggaaggcttcgagaagatcaccatgtcttccggcgcgtgagcaatctcggagtgcccgctctcgtgcatgaactgcgcgtgcgcctcgtagttcttggcgagaccgtacaccttggagggaatcaccggcgcgagcagcctcagcccatcggcgtcgagcgcgtaccgctcccctgtgggcttgacgggcgcggctccgaacgggtatccgtccagttcgatcaggtagtccttgccgtcggccgggtcctgctggacgaaggcatagcgcggcttgtcgttgagtgaaaaacgtgcgattctcatacccaccagtgtaaaccagtgcgagtgcaatccttacgaagaacgcgcatacgaaaagcggggcggccaatcatggccgtcccgccttgtcggattctcgcgagctggacccgcttactccgtgtagctcttgtcgaacagcgtcttgccgctttcggtatgcaggtacacgcgcaccttggcgttgccgccggtgtcgcaggtttcgttgagcgtctgcgccaccgacttgaacgtgctgtccatcccgtcaaggctcgacgtcatcatgtcgcccatgctgctgtacgtgtcagacagcgtgtagtcgtacacgagcgtgttgccttccgcgtacgccttgatgctgatgcccatgccctggtacgacgaggtcatgctgtcgagctgcgactggatttcgctggagttgacgaactcttccagtgacggcttgccggagctggaggatccgttgaagctgtcgttgttgagatcgttgttggtgtcgtcggccccgttctgcaacgcgtcgtcaaggttgttcagatcgttgctgctggatccgtcggagttgccgttgctggagctgtcgctcttggatttgctgtcgccctgcgtctgactggtggacgtgttgggtttcgcgtcggcgctgctgtccttcttgccgccgatgacaccggtggcgaacagcacgactacgacgatgatggcgatgacggcaacgacaccggcggtgatgccggcgatgagcgggccgcggctcttcttcttcggcggttcctgctggtacggattgccgtagccttgcggcgcgattgcgggcggctggttcccgtattgcgggccaccgtactggttggcgccgtatggctgtccgtacgcggcggtcggctgctcgccgccgtacggtgcggccggctgaccgtaccctcccggagcaccgccggcaagcggctcaccgtatgcagcggtaggcgcgccggcaccatactccggctcgggctgctgaccatagggcgcggcaggcgcattgccgttgccgccctgcggccctgcaagcggctcaccatacgcggcggtaggcgcctcgccaccatacggagttccgccatcgggctggctgaaggggttcggaccggcttcaggctgctgaccataaggagccccaccctggttgtatgcggagccagcgcccgactgtccgtacgctcccggctcctgcccatacggcgccgcctggtatccatacggctcggcgccgccctgcggcccggcgagcgactcgccgtacgcggcagtcggcgcaccaccataaggagccccgccctgcccgtacggggcggctggggctcccgtcggcacgcccgccccctgcccgggcagaggaacgaccggcaccggcgggaaagcctgcgttggctgcggttcgggcgcgccttccgcgcccgcagcattgttcggatcaccatacggagtctgcggcgctccatctggatacgtgttgctcatatgtcccccttttgcagagagtcccgtcgaccgggtcaaatcattgttaccgcaaccggccacatgcaacgctgtatgcacctgatcggctaatcctcagcgtacactcactttccgtgatatgcacggtattgaccggaagttcatgttcatctcacggcaagttcgattcgcacggcgagatccctcgaaaaccttgcaagtccgccttcgaggacctcaccggcgacgccgccgacaccccccccgtgaacccgtcgcacctcacccacgcatgcgccgcggccacgacgacgcgtgccgcatcggcttgaacggcagccggcgaatccgcccgatcacgccgagcagcagccatccgccgagcagcccgcacaccaccaccatcgtcatgatggtgcgcgtgtcatgcaggtcggacgggtccggcgccggcatcgggatcggctcgcgatgcccggatatcagcaggcgctgcgtgttgacgccgtacggcgtgcacgtcatcagcgtcactcggtcctcgccgggcacgatcttgagttgcgacgtgtcgtccgggttgatgacggtgatgcggtcgacctcgtagccgagcgtctcccccatcacttcgatgtagaagaagtcgccggttttcatctcgtcgagccgcgtgaacatcatcgcgttgacgagaccgcggtgcccggtgatgacggagtgcgtgccgtccccgccgaccggcagcgaggagccgtacaggtgaccggcaccggaggccagcgcggtctgtgacgtgccgtggtagatcggcaggttgacggaaattttcgggatcttgatggttcccatcacttcgtcgcccgagtcgagcagggactggtattccttgtctttggaggcggcggagtcctcgcctttggctctcgacccgccttgtgcggcgctgaacgggtcgatggcctcgcccagcacgggttgaccggatctggcgagttttgcgttgtatgcgcgggcggcggcgagggcgtcttcggcttgcgggtatggccagccagcgacctgctgtgcgctgttgcgtgaggtttgggcgagcttgagcgagctctggtattggagcgctaggggatatccggcgatggcgacagcggctatgaccagtatcagcgtgacgatgcgcatgatgatgagctgtatgcgcagtcgtttgcgttgcgcgacaaggtcgaagatgtcggtcgcctgattgaagctcagcatcgagtacgggagctgcggctgcacggcgggtttgtgacggctgtttcggtaggatttgcgggaattattcgaggatcgctcgtcattgtccggcaggctgcgggtcatcgttgaccgtgcgggcgcatgggaggatttggcggctgggtcgttgccggatgaggtggccggccgtttcgatccgtgtctcctcgatgccatgcgcatcctcctgttgttgtgccggccgtcactgcaatcgccgtgaaacgaattcgtgtatgtactgtgttgcccccggcaggggtgctgccgggggcgaatggttacagcaagccgaagccgccaccatgctcgtgcgggatgcacgtcatgcggcggcttggcctgttatcgtgtcagtcagtgcagcgcacggctggtgcggcgagacttggcgtacacggtggcggcagcgccgccgagcagcgcagcgatcaccacgaacagcgcgatgcccgcagcaccggtcttcggcagttcgaagacggacttgacgttggtcaccttgtagtcggcggcgctgtccttgggcgcgagaccccaggagtcggtgccggcgaaggtgacgttgccgttttcctcgatggccacggtgaacgaggccttgaagtcctggtatccgtcggcgaccgcggtctcggtcacggtgtagctgccggccttcagtccgtcgaacttgacgacgccgttggcaccggacgtgacttcgagcgggtacttatcgctgttcggcagcacgccgttctggtcttttgcgacactcagcgtgaacttcgcgcccttgacggcctcaccctgggcgttgaccttcgtgaacttgaagccgaagatcttggtgagggtttcagtgccggggatgggggtgccatcattgtcgacgagcttgttggtcaccgcgtggtaatcctggcccttgactgtctcggcctcgtcattgacggtggcgttgtaggtgatggtgatctgcttgccggcgtacttggccgggtcggtgatcttcaccacgaaagtattggtgccgtcgcccttgttggcagtcaggttgttttccaccgtgtaatcggtgccggtcagcaccttatcgccggccttaacggtcagtccggcaaagtcgacggtcaggcccttgcttggcacatctctgaactgcagggtgaagccggtcgggaccggattcggaatcgtgtagcccagttcaaacggcacggtttcgcccacggacgcgctcttgctggtggtggacttcgtctgggtgccgctcaccgtgctcttcatgtccacttctgcggtgctatccccaagcgacagaacgccagcgttaacggagccggtgctcacgatcatcgggacggcctgagtcagggtatcggtcgatgcgttgccgtccaggaacagatacacgccagcagtcagcgcggtcttgttcgtggcggtccaaccatccgtgtcgctgccagtcgccgtgttcagcgcgaacggatccgcggtggcggtgaacgggttgttggcctgcagcgcatccgcgaacttgcgcgtcacggacggatcattccacggacgggtctcggactgatcgaactgaacctgcgtgacgttaccatccgtacccgtggtcgctttttgattcatagcccaagccatcaaatcagtggtgccatcggtcggcacgttctggaagccggcggtggtcagagccgcagccagcttcgtgcgattggcgcccgcagcggtcttcacaccatacaccgggttttcggcagtgccatagttcacgtagtccgcgatcttgtatgcgcagccgggcgctggtcagctgctcttctttgggcgctttgaacgtgactgttgcagcagtgtccactgtcgtctcggccgcgttggcggcaccggtgccgaacgccatgccggcgagaagggtggccgcagctgcgacacccgcgaaaagcttcttgaacttcatgagaaactcctcttcctttcgttgttttgtatattgcaactgcggaagcggcagtcgttgaggcttccgcagtccgcaaatcttgagttgtcgggggcgactggtcgccgcccccgtgtgccctccccgacgagggaggagggcggagcatccgccgcaggtcagacgagccgacgcttgcgccagatgaagtatccgattctgaccagtgccgcgagcaggccgaagccgcccccatacacaagccagtcacgagtcgtggcgccgccggtcatcggcagagcggacacggcaacgaaggtgttggtgatcgtgaccgggtacgtcttgacgttgtcgaaggtcgtcatgttgttgttatccggagccgcccacaggtcgtcggcagtgaaggttaccaactggttctcggggttgtaggacgccgtgtagccgcccacgctggactcctccacgcggtaggtgccaggggcgaggttctcgaacgcgccagcccactgaccctggttgttgagggtcacggcccggttgatgtccttgcaatcctcaccttgcgcattgcactgcttcaacgtgacggtcaccgagccattcccatgcttctccgctccatcggaccagttcttggtcacctggatcttgccggtctttacctgcaggacggggtgggggtactccacggaacccggtgtctcggtggtctggtcgccgaccgtgttgacgacggtgtaccccagcttcgcgccgtgatccgcattcgaatggaagccgggcaaattggacgaagtatggtgaccatccgcatcagtgttgtcggcaccaagaacatccttatatccggtcttgtcgtcattctgtttgttggcggcgtactcgttgtaggccttctgcgtcggcttgaccttgaacgtgaccgtatacgtcacgccatcctgaagctcatagccgtccgcgaacgtgaccttcaccgtcttgcccgaaacggtaaccgtgtaatcgctctcgttgagatcgacactattaccgtctttagatgccgtcaccgtcacatcattcgagccgaagtcagcattaacgaactccgcgtagtccgacagcgtatcggtgatggacacgttcttgtacgaagacttcctgttgatctgaccgatgatatcggcaaatgccttgttcagctcatccgtgctggtggcgctgtaatacgagcccttcgtctgatcggcgaagccacgcatcttggtcggatcggaggacacgccaaccgagaacaacgtcgcatcgccacgcctgttagcctcggcaacagcggagctgagattcgccccatatcgatcactgctgccagaaccatgaaccccggcaggaagacccctgcgatcatcgtcatcataggtcggacggccccaccaatcagtgccggtccgcacggaactcgtgcggtacgtcgggtcgccgtctgacatgaacacgatgtacttcttcacgcccttacgaccggaagtcagcttggcattggcggctttaagcgcggcctcccaattcgtgccaccatcggcgcgcagaccattaacggcactgactatgtccattgcgttgtcggtgaagttcgacacattgcccaccgtcgtcgagaaggggaccagcgccatccggatgttgctatccttgccctggttctcagacgtcagcagatgctgcgccatgctgttgacggcagtcttcgcaacctcaagacgagagttgtgtcccatcgagccactcatggaactggaggtgtcgaacaccacgacgatgtcggccggggacacggtcgtctgcgacgagccggactgcgtgccggtcacgttcagggacaggtcataggtgccatcattgttcgccttgatgtacttgcggtaccggggcgccgtgacgaccgtgttcgtcaccgtggtacgtggcacctcaccgaccgacaccggctccgtggtcgcagaatccttcttctgcgtcaccttgacctgaccgccattggcgctcaccgcatacgtgtcctggtcaacgttgatttccgtcaccttgtacttcgaggactcggtgatcctcttggcgtcgctgcccaaaagcacggcatactggcccgccttgagcgtgatcacgccattggaatccgtggtccgggtttcaccgtccttggtgccggtggcggtgttgtacacgtcgtatttacccgtgtacaacgtgtaatccttgtcactgtcggttccctcatagttgacataagcgttgaacgtatagttcttgtccttgtcagcttcaggaacgttctccgtctccttgccgatttgaatatggctggagtcaagagtcaccaaattgaagtcaagcttgcagttggaaccactatggccacgctcgaagtagtacatgttcatctcgtgactggtgtagttcttgaacgtggtgtaggagccattggaggctttgaccatattggattccatccaagcggtgatctcggcatccgacttgccttggtccttgagcgcctgagtaaacaatgcctgcaacgtggtcgtagtggttttattgctgacaagcgtcaccacaccggtcgcgaaatcaatggagccgctggcggcatcatggatgccaccgatatccaacacaagcatgccgtcgacgaacagccacagatcatcgtcacccgtgaagttgaacgtcatcggggaaccatcaacgagtttgccttctttcggttgcatgaacttcgcgtatgcggtcataccgaaggcgtaccgggcgccgcgcactgaatgaaagccgatccgcagctgacttttatccgcattgaacggcaggaatttcggaatccacgcgtcagttctctcggtccatgttgctgaccggtcaaatccggtaccggcactgttcagcgcggcgtacgtcgtattggagtcgtacacatagtggcccttggcctcttccgtcggatcgaacagccccgtcagcccattgccgccattggtatatgccttggcccactcgctttctgtgaacaaatacgtcatgtcggtctgtgcattatttttattggtcaccatcgtagagaactgcggaactgcatcagcgccggtcttggtgaggttcgtcttgacgatgcccggagaggtttctgcactgccagtccagccgttccaatccttaccttttccgttgaagtagttgaagtagaatgctgcagccgcctcatttctgctggtaccgcccgtggcatagttcacgttctctttgccagcggcctttgccgggcccttcggatcactgctgtcccaataatcgaataggttaatcttcactttgccgtcgttcgccgcggcgcgaggcgcagccgacgctttgaccgtggcggtctgccccgaagcaccagtcccggcgcgatcggtcagggcagatgacgcctcctgctgagcgctgtcgccctgtgcgatgccgctgatcgggccggtgccagcctgtgatgcctgcgtcgtggccgactgcgcggcttcgggtacggctgtccccacattgtccgcaatcgcagtgccggtgacggcaagtccaagaacagtcgcgacggatacggcggccgcgatcaggcgagagcgcatcgccctcgtatgcgatggtttccgattctgcttagtcacgataagcatcccttccatcatttccaaaactcttcatccggcgttcagcagttcgacaaagactcacgattgcgactctcaccgtcgcagcacgcgcaaatcatcgacttccatcggcctgttaactcctgaccgtatccgcacccaaaaatcgacgcaatcccccgaaacattgaaataacgccgaatacatgccccccccccgcagaaaaaccgctttcacagcccttgcggcataaggtcctcgggaatcagtccatcccccccttccctacggggaaaattcttgggaaatataccgagatgcggcttagatcaaggcctgaggcctcttacataacggtataccgctgtatcagcgaagtgtctgctcccgccaaagcacaacaagactgagggaggctctcgtcatgagattacgcagactcttttgcgttcctaagtgcgcgccgtatcgacgagtacgcgaacataagaacgcaaaacgtgcgatttgcgttcttatgttcgcaggctgaacgtttcagcgcgcacttaggaacgcaaaccgctcctgcccgcttcgcaagagccagccagcgggggcagagttatatattgcttctgacagtgggctgaaccatcggctaacgtcatttaccatcatctgccgatggaacagttccgtctcaatagacccgaaactatcgctcgtagaacacgccgaacgaggggaacccatgacgggccggcttcagctcctgcagcgggatctcggtgacgtccactcgttcgacatcggcatagcgcggcccctgcttcagtgccgaaatcagacgggcgaccttgccgcgttccccctgcgcctcgacctccaccgagccgtcgtagcagttgcgcacccaaccgcccaggccgagcttgccggcggtcatcaccgtgaaataccggaatccgacgccctgcaccagacccgccaccacggcatggacacggatatcatcactcgatgacaccggcacggcaccctctgcactctcgtcaggccgcgcgccgcggctcacccgcatatcatcacgtttcatgaccgcactcacctcacgttgccgtcagccgacaccaatacccccatcgtatgcccaccatcaaacggaagtcgagaagccggcagcgcagcgcgggcgctacagcccggcccctttccgccgaggcctgccgcaatccgtcagataaacgcgcgttcgccgaaaatcgccgttccgacgcgcacaatcgtcgcaccctccgcgatggcgagcgccatgtcgtgcgtcatgcccatcgacagttccgtgcagtgctcggtgccgggcgcgcgagaggcgagaatcgtgtcgcgcgtgccgcgcagatgcgcaaagcaggcgcgaatcgtggcctcgtcatcgacgtgcgcgccgatggtcatcaggccttcgagccggatgccgtccagctgtgcgatctgtgcggcgatgtcgacggcagcctgcgggtcgcaacccgatttcgatgcctccccggactcgttgacttccagaagcacgccgaccgtgattccacgggcgacggcacggcgggcgatgcgctgcgccagttcaacgccgtccaccgattcgatggtgttgacgtcggggaggattttaccgatcttgttggcctgcagctggccgatgagatggaacgggatgtgttcggcgtcagacggtcgagtggtgtcgccgtcacctgtgccgagcgcaaatccccggtccgcgcacaggcgacgcagtccctcggccttggccatgacctcctgcgggcggttctcgccaatcatgcggatgcccgcatcgatcgccgccatgatctcgccgacgtcacgggtcttcgtcgccgccagcagcttcaccgaaccgggagcgcgaccggccgccgactcggcttcggcgatggcgtcaagcacgcgatgcacgccatcgcgaatctgcgtcgcccgcgtctcgtcgatgctttcattggtcagatccttgtgatccatgtaagcggtcatcatatgctccctatccgtcttgctgcaccatatattagtatgcccacggatgagggcgaatcggctagagaaaccgggaacttccggtgtggcccccgctggcggggtgtcgagcgatgcgagactggggggggggcgaagcgcgaaacggctccgcacgcagcatatagaggaggaatctcacaatccgatgctgaacgggtcgtcggggatggaacgatcctgcgaatctgcggcgagcgcatcccacgaaaatccatgcaacaggtcggcagcagcgcacggctcgggctcttgctgcaatccgagcagccacgcgcaatagccgatcacctgatgcgccgtgacgccatgtttgcgtaacgttcccatatccagcgaccgttcacgcttggcgagccgccgcccggccgcattgtcgatcagcggaagatgtacaaaacggatatcgcgatgagccgcggcaacgccgccatccgagctatccccgaagccggcgtcgagcagccgctcacggatgtacagctgcagcgcggcggatcgcaacaggtcacgcccgcgaacgatgtcatccacacccatcagcaagtcgtcaaccgtgacaaccagctgataggcgaacagaccatccgcccgtcgcaccaccgtatcacccaaatcgcgcggcaaatcgaatcggcagttcccgaacacgcgatcatgcacggtgaccacggcacgtgcgtcgccggcgacaggcatggcgatgcgcagcgaatgccgatcaccattcgccaagcgttgctcgacctgtcgtggatgctcggcgagcgcgcgccggcatgtgccgggatacatgacgaaacggtcgccctcctgcggcgccgaggccgcacggatgtcggcgcgcgaacagaaacacgggtatatcagcgcagtggtctcggtgccgtcaacgccatcacggccaccgaacgcggcagcgtctcgcaagtcaatgccctgaagcgcgcgcaacgcctgctcgtagatgtcgagccgccgcgactggtataccggctctccatcccagtccagtcccaaccatgccagatcgtccatgatccagcggtccgcgtccggcagcacgcgtggggtgtcgatgtcctcgatgcgcagcagcatgcgccctcgcccgccgtccgcatcgcctggatcggctgcgccactcatgccatccacgcgattcacgttattcaggcaatccgcatcgcccgctccaccgcccgtccggcttgtacgctctggaccacccgcacgagccgacagccacgcgcccagcatcgcatacacgttaccgatatgcattcgtccggacggcgtcggcgcgaatcgtccgatcaccaccgcgcccagagctccgagtcgagcggccattcgttgatcgtgcagccgcgcaacgatatcgattgctgctgcatcagcggcgccggcttgcctgcctgctggcatacggtctcattgtcgcgatggtcgagccggtgaccggtctcatggttgatgaccatcgtgcgataattcgccagattgccgccgcccttcagccagctgtcggtcggctcgcgccagcggtcataattgatgatcacctgattgccgacgcggcagctgtactgcgacgagcaaagcgacgagaacgatttcatatactccgccgcagccaggatatacgtcatgtcgcacttgctggaaccgctctccacgaacgtgagaccggcacggggccacccacgcgaatcattcagcgtcgcgtacaccgtgcgcccgaactcgccggtatcgccgacgctccccttggtggacacgcagtaatggtattcgtggcggggtttgccgctggccgccgcggtctgctgcgccttctcgagaatctcgcgccgctgcgcctgcgagaacggcttcgaggggtcatacccgtttgactgtgcctcggaattagtggatttcgcggtggccgacgatttcgcggaatcgccgcccttctgctcccccgcagaccgcggctgcgctgttgcacctggctgcgcgatggacgaccgctcaccgcccatgcccggcacgcgaagtacgctcgcccgcaccgcaagaacaaacaacacgagcgccaaaatcaaccccgcacatacggcaatgcgccgggcgcggaacacccgacgcatatcgtcaccacgcaaccgctgcaacttcaatcactcccagcaacgtcataggtcaagccgcgccgccccgcgaaagcgcgagcacaagggcacgcttttcgcaggcgtctctccctgcattgtatcccgtcagccgtggggccgcgcaacacgcgtggcgtcacgcgagcccgccgcggctcacgcggttcgcgcaaaaatcacgcgaagaagaacacgtacagccacgcgccgacgatggcgcccacaatcggagcgacgaccggaatccacgcctctccccaacgcgaggtgcccttgttcggaatcggcaggatcgcgtgcagcagacgcggcatcaggtcgcgggccggattcaggccggggccggtcgggccacccatcgaggtcaccaagccccatacgatgaagccaaccacgatcgacgcggccgccaaatccttcgaaccccacggcagcatcaggcagcacagcgcaccgaacaccagcaccagcgtgccaaacatctcgttgaggaagtagttgatcttgtcgttgtcggcgtcggtcgtgcagaacgtgccgaggatcgcttccgcgtcctcggtctccttgtagtgcgggtaatacgtcaggtacacgatgaactgtcccagcagtgcgccgagcagctgcgccacgatgtacggcagcacgtcgctccacgggaacagaccgttgatcgcctgggcgagggtcatggccgggttgatgtgggcgccggacacgccgccgaacatgagcaccgggaacatgacgccgaaaccgtagcccatggcaatgttcagccatccggcgtggtggcccttcgtgttcttgagttcgacgttggcgaccgagccattgccgaagatcatcaggatggcggtgccgaagaactcggcagccagcttggtaaagagggaatattccacggcttcttcttttctctccaccgcatcgcagacatggctgactgctcacggtctctggatgattggatttctctcgtactcccggcgactcaatttcgctgggtgcgaaagcaaacgacgtgattgtacactttaccccttgacgaacggcgatacgggcggattggacggcagaatccccggtgattcacaccctgccctgccatgcacacttgggtgcagtcatgtggaacccattggaattactcgcgacacaccgtacgcgacacgccgatttgcatcgcagcgagttccgagtatagttatcacttggctcaagaaatgaccaacgcccctgtagctcagttggttagagcagctgactcttaatcagcgtgtccagggttcgaatccctgcgggggcacaagcaaggtcggaatcgaaagattctggcctttttttgttttcgtcgagagggtgcgcccgagtcaaatcacccctaattcgccactggaagcatgcccccgcccgggtgatcctcgcaatccgcccctatctgcgtttcaaggggttgattcaggccgcgacgaacatctatctgcgtttcagggggttggtagcaaagtataaacatcacgcaaaccgcatggtttcaatgagcaaatgccctatatactccgtgcatagtgttttggccaccccctgaaacgcagatagatgttcccaggcagtggaatcaacccctcgaaacgaagatagcagcacatacatcgtggaatcacgccgggcaaggccaaaatagacgaagatgccggtcgaatgggacagccgttcgaccggcatcaatgccatgcgttggccctgagccgatcagggccaacgcgactcaggaaatccgcgccttagatgtcgcgacggcggcgaaccgccacagacacggcgcccgtcgcaagcaggccgattgcggcgatggcaacgacggacaccgaggcgtcagtcgcggacaggcccggcttcttgttgccttggtcgtccttatcaccgtccttgtcggtatccttgcccggctccttgtcgggctccttgtcgccaggctcgacgggcgtctcgccggacttctccttgacggtggccacacgggtcacggacgcctcgctaccggccgcatcgctcaccgtgtacaccaacgtgtacgcgccgggcttgctcgtgtccaccgtgtcaccggacaccttcacggcaccggtcacatcaccgtccacatcatcaaccgccttcacacccgccatcggatcaaacgacgcaccgaactccacggccacgtcatccgcaccggaaatcaccggcggcacggtgtcgaccggctcggcctccttcaccgtcaccttgagcgtggcggtaagcgaggtatcggcggcgtacgtcaccgtgatggtcttttcgccggcggtcgacgagtcgaactcggagaccgtgtattcgccctcgccgagctcggcggcgtgccgtcagacatcgtggcggcgacggccatgccgctcaggtcgagcgcgtcgccgatggcgtattcggtcttggtcggctgagtggtcacggcgatcgacgcgacgtcggacacggccgcggagtcctcgacgagcgtgacgttgtcgatgtacgcgaacgagccggaggccagatcggtctgtgagatggcgacccacagcgcggcatacgggtccacgtcgagcggcacgatgaacgacccgctgtagtgaattttgccgccttccttgctttcggcgtccacggtctcgctcagcacggtcttgcggtactggctgaacgagctgacggcgccaagcgacgcgaggttggacttgacctgcaccttgagcgtggacggggtgtcgtcgttgctcttgccgagcgtcgcccacaggccgagacggtacgtcttgcccggcgtctcagacagcgtgtgctggttgatggtgtcgcccttgtacggggtgagctgttcgccgagtttcgccgcgtactcgccggagactacggcatcggtctggtttagttcggacttcgggcgccgagtggcaccaccggcgtcgttgttcttcgtgttgtcggcgttgccgagcgtccacggcgatgccgcggcgcatgtatttttcgtaatcggccgcgttcgcatcagtgttggtgacttcgaagccctgcactgtgatgtattcggagttcttcagcaggatggtctcgctgacgcccgcaccggcgatgatgggcgcggcgccttcgccgtacgctccgatggtgatgggcgcgtccttggtgcctttggtgttgatgacgcgcaggccggtcttgaccgaggcgctgtcgatggtctgggtcgcgctggtgcaggtggcgccggccttgagcagcagggactcaccggctttgagggtgatgccgttcgccgctgtcaacgagttgaacggggctggcttggcttccgtctccgttggcggtcgccgcgcagtcgacataatatgatttggccgggtccggcgtgctttcctccgcctgtgcggcacctatgccgacaatgcaggacgacaacagtgtcgctgccgccaccgcatacgcgaccgttgttcgtttgatcgtgggcatgtacttctgctcctcacgtccccgtatgtgtcgccgtcatggccgggctggagtccgttatgaggcggggagcgcaccgcaatctcgtcattgcgattcgcccgtgttcggccggcgtgtcctctctggcgcgtaaccggtcacgatatggtgcacaatattaacaaaaagatagaccagagtggggcttccgcgtcttgagaacgcccatcctcgcagcaaatcattctcattaagaaaggtgcgagcccgccgcaactccaaatgaacatcaatgtccgcaaatccttggaaaacaacgttgtctcatattgttcacttgtgcgtaaatgttcgcaatcctcgcaccttccttattgagaatcattcgctgcgacttggaacaatacaaaaagcccctcgccgcgcggagcggcggaggggctgatgcttaagctcagacgataatctgtctgatgggccggagctactcggcgacgaccttcacgaagaaggaggcggtgatctccgggtgcagggcggccttagccgggaagtcgccggtggtcttgatcggctcgacctcgatggccttcgggttgaccgcggccttgtcggagagagccagcgcgatctgctcggcggtgacgctaccgaacagcttgccggactcggaaaccttggcagcgatctcgacggtagtgccctcgatggcggccttggcggcgacggcatcctcgcgggtggcgacggccttggctaggcgagcgcgcttcatctgcacgatctgagcttcggcgcccttggtccacgcgaaggcgaggccctgcgggatcaggtagttgcgggcgtagccggagcggacggcgacgacatcgccggagtggcccaggttggcaacggtctgggtgagaataaccttggattcagccatttcctatcctccctaactcagcgaccggtggtggcgtacggcagcagggccatctcgcgggcgttcttgatcgccttggagagctcgcgctgttcctgcacggtcacgccggtgatacggcgggaacgaatcttgccgcgatcggagatgaacttgcgcagcagcgcaacgtccttgtaatcgatctcggtgaccttggcggccttcagcggattcggcttcttcttgaacggcttgaccggcggttgcggcctcttacgtgacatgatgttctccttgaaaattacgattgaatgcttgcttctggattgttacatgcgtcgcgcggcttcatatggccgcggacgggcatcagaactcgggttcctgcgaatcgccaccgaaatcggacgagccaccgaacgaaccgaaggacgagccggcatcgccggacgtgccccacggatcggtcgcgggcgcggcgctctggccggcgttgcccgcagcggacgcgccaccctgatagccaccgctgaagccgccattgccacggccaccctggtagccgccggcgttgccgccgaaaccgccgccattgccacggccggcgaatccgccttggccgttgccgctggacgtgcgcgtgacctgcgcggtcgcgtaacgcagcgacgggccgatctcatcaatcgtcatctcgatgacggtgcggttcgagccgtcctgcgcctgatacgagcgctgctggagacgcccctgcgcgatgacacgcatgcctttggacagcgtgctggcgcaatgctcggcgagatcgcgccaggcggagcagcgcatgaacagcgcattgccgtcctcgaactgcccggtgttgcgattgtaggtacgcgcggtagaggcgatggtgaaactggcgacggaagcgccgtttcccgtggtcctcagttcgggatctgccgtgaggttgcccaccacggtgatgatggtttcgcctgccatgacttaccttcttacctttggttcagcgagtcgcgaacaatcagaaactcatacggcttacttggcgtctttacgaagaatcttcgtgcggacgacggattcgttcaggttgagcacacgatcgagctcggcgctgacctcgggagtggtcgtgtagttgaccaccacgtagttgccttcggtcttgccgtcaatctcgtaagcgagcttgcgacgtccccaaatatcggtgttctcgacggaaccaccttccttggtgacgagctccagatactgctcggtcaacttcttcagaccgcgctcatccagctcaggatcggcaatgaacatcagttcgtacttatgcgcagacatcacccacctccttcggactagtcggccatggactatccatggcaggagtgtgtatacgcgctgctgaaaacagcaacttctctaagctacgccatgcccgcgacagcttgcgggggctgtcgcgaagcgactggggagtaatccgtcctactgcaaatccacgaccgcgcaatccgcggcaccatagccgttcgacttgcaccatgcgtcgccggccttcaccgagtcgaccgtatcacccgacaggatcacgtaatacgcggtcgaagcgtcggccttcgtgtacgtcgggtaatcgccggaccagatcaggatcgcgttcttgtgcttgatgcgctgctgcaggaactgctcgtagatgtccacgtaatgccaggtcttgccgtcggccttcatgtcttttttcttgctggacagctgcgtggtgtaggtggtgtagaagcgggatgcggcggattcgtcatgcttgagctgccagctcaacgcaagctgcgcgtaccgctcggcgtcctcgctgtcgatgtcggagcccgccaacgcgtcgccgtccgcactgcccgcctcgccggggccgctctgaccggtctgcaggatgacctcggcgctgccggtctcgatctggtcgtacgggcgccagtactgcctcgtggtgaattcgagcgcgacgttggccgtctcgccattgaacttgaccggctgcttggagaagtcgaagacggccgaggcgatgacattgccttcatcgtccttgatgctgaccttgacgtcggattccttgaactccgccgtgtcgccgtccttcgtcaacgcgcagttggaggtgagctgcagctgcgcgacgagattggcgtcgctgtggtcgacggaactcagctcggcatcgggcgcagcggtgcagggcttgtcgtctttcgcggccttgctgtcgccgaacttggtcttgccgctctgctgggatgtcgactgcgtctgagccgattgggtgccggaatcacgcagcatgaaccaccagacgccgaatccggcggcaagcgccacgacgagtacggcgatgatgatgccgacgatcagcgcggtcttcttcttgcccttgccggcggactctccaggccgtgacggttgggctggcggctgcacggcctgcggcgggaagacggcaccgggctgggcggcaccgtattgtcccgcgtactgctgaacagcctgataaggctgtgcaggaggcaccggctgggcggtcggcaccggctgcgcgggctgcgggccggcggacagctcggcaccgcactgctggcagaaccgcatgccgggttccgactgctgaccgcacaccgggcacacggaacccgcctgcacggctacgggcgccccgcagttctcgcagaatctatcgccctcaacgacattcgcaccacaacgggaacaccgcataatctctcctcatgactatcctgcgctcaacgttacactgcatgacagcattcccctgcaaatatactgcgatacggaccccaaatgacgtccgcaaccatttgaccgagatgtctttttagatatgtaatttgaagactgacgaaatttcgaagaggagattatcatgtcggcaaccaaaggttccagataacattgttggctgttttgctgactctcgccgcatcgttcgtatcgatgtcacccaagcaggcttctggctttgactccacatatgaagtcgtcactgatgcagacggcagcaaaatcatcatggccaagcccggctctgtagcagccatagaaccatcgaccggcaaacttctaaacgtgattcctccttcatccatgaatgtcaacgccatcaccgtaacaaggggatgcacaaacaagaacgctggatgctggacaagcggtagcgcacttggggatatgcaattcgccggaaatggagctgtgtccggcacttggccgtatagaaatgcgtactacaccgggaacctgcatggtcttgtgatctatcaatacaaaggtgcgaccatgagttcgccgaaaccaggaccgcatttgtggatacgcatggcaacaatagtgctgtcacggggaagagtgtcacccgttggtaaaaagacattctcatacgttgagataatgcatatcggagtaagaggagtaagaatggggcatattccggcatcccgtcgtacggtgacgatggccatcgccgtcatcgccgtcattacgctttccattgcgatgctgtgcggatgcggcacggcacggaacacgaaccaagcaacggattccggctcgggcgggaaacgtctcgcctcatctttgcaggcttatgcgacgcagctgctcggccaggactccggaatgggccccgcgcagaaagcgacactgcgcaaggccgcgacaagcggcaaaataagtctgtccgattacaaggccgcatggagccgatacatcacgtgcgtccaagacaagggctatccgaggccgacactgaaaacttactccaacggcatccagcagccgcagggagacgtacttccttcagataaagccgatgaccttgactacatccaaaaaaaggccaaggacttgaacgcgtgtggaatcgccaccgtggattcggtggacgcgttgtatatggcacaagtcggcaatcccaatctgtatgcgtctcatgaggagggggcagtcgattgccttaagcgcgccgggctggtgccgaaatcctacaccatcaaacaatacgagaaggaggcgaacgcaatgggtcacgccgctcccggagagaccgtcaacacgacgtatgacatgaagaaaccggaagtgctggcatgcctcgccgccaacggcaacgtattcatggacagatgacgccacaggcacagagaatgcactggcatgttttcgcccctatcggatatcggattacctgcccgatgggggcgaaaacataccttatatgccccgcccaaataccgcgaataagctgctgaagatgacgtggcgactatacaataaggagggaagagcaaaccaagaaaggggcttgttatgatatgtcctcactgcggcgccacgctgtccagcgccgcacgattctgcacgcaatgcgggcagacgctcgcggtcgccgcagcaaacagcaacgacaacgtcgaagattcgaccgtgctcggcaccgctccacacggcaccgcagccgcgcctcagccggaagcacccgctcccgtcgccgcattccccgaacccgtaccggctccgcaggccgcggcaccgcagcccgagccggcacccgcattccccggcgcggaacagcccgcagccgagccggccttcccggcggttcccgaaccagtccccgcacaagaagctcctgcagctcccgtcccggcggcagaagtgccagtcgccgctccggccggagaagttcccgccgccgcacctgttgcggctgcagcacctgctcccggcacttttgctgcgcccgcgcctggtgctcccgtccccggcgcacctgtccccgttacccccggcgcacccggcgccccggttcagcccggcgctccgcagcagttcgtccccaacccgatgttcaaggagctgttctccgcgcgttcgctacagaccgccgcaatcagccttgccttcggcttgatcggcgcgatggcgctggccctgatcggttccatcttcttcttgtcggccggctcatcatgggcgtccaagctgagcatggtccccggcctgtcccacatgatgagtgacgccagcggttccggcacggtgacgccgaacttcttccagttcctgattctggtgatggttctgggcgtatccggtcaactgtcgcccaacatcaccggaggcaacctctccatgtcgtccttcggcgtgtccggccatctatggatgcctgtcggtctttccggcgtggcgctggttctcggcaccgcgttcggcgcatactggttcgcgcgtaagttcgccatccggttcaagtggaccggcatcgtcagcagcgtcatcgtcggcgtcgtgatgggattcgtctatctgattctcgccgcgatcttcccgctgacgctgggagccggcagcatgggcggcattcaggccaaggccatcctgaccggcgtctccgcccgtacgtatttcatgacgctgctgctcgccgcgatcggcgcgttcttcggctatctgctcgcccagtacgcctcggattccaacaacgtgttcaccgcggcctggaagtgggctcaccgcacgcgcggcttcgtgcgcacgctgcttgatgcggcgttcatctacgcggtcgtgttcacggtgatcggcttcatttgcctgatcatgctgtccagcaacctgcacaacggccagatgttcatgctgttcccgattctgctgccgtacctttcgttcctgacgttcgcgctcggctcgttcggcgcggtcggcatcacggccagcggtaatatcgctaacctgtcgctgttcggcatctcgaaccagtacgtcggctccatcagcgcaccgtggcagctgtggctggtattcgtggcgttccttatcaccacgttctacattgcgttgcgcgccgcggcacgcaacatctatgatccggcatatgcgggatggcagcactcgtggaagtctccggtcgccacgctggtgatctggctgatcgtcacgttcctgttcacgtccgcgacgctgggttacaccatgcagtccgatacctatgacgcgtcgctgaacatcgcggcatggtacttcctcgtcgcggccgtatggtcgttcctgatcgaggtggtggcgctgacattcggcccggccatggtgctgtcgatgggcggcgcatggaagctgttcgtcggcggcacggtccgcccgacgcccgccgaggtcaccgcgtatgcggcggcatgcggagcgcactttggtcgcttcccatcacaggtcgccgcggccgccggctacacaggcccgcagcagtccttcggcggacagcctggcgccggcaccggagcgccgaccgcacccgcagctggcatcccggttcagggcgttcccgttcagggcgttcccgttcagggcgttccggttcccggtgctccggttcagggggttcccgctgccggcaccgacgccgcggcctttcaggcccaaggtggtgccccgactgtccaagttcctgccggcgctcctgccgctcctgcagctgcacctgtcgcccccgctccggtggctgctcccgccgccccggctgcagccaaggccatgaccccgcagcagaagaagctggccatcatcatcagcgccatcgtcggcgtgcttgccctgctcggtatcgcttacgcagtggtcaactccaccgtgttcagcgccgataacaccgcgaagagctacctgtcggccatcgcgtccggcgactatgacaaggccaacggcatctccgacccgcaggtcgccaacggcaagcgcacactgctcaccaatgcggcttccaagggcgacaagaccacgatcagcaaccagcgcatcatctccgccaccgacaacgcggacggctcccgcacgatgcggatctcgtacacgctgggcggcaagtccatgaccgacattctgacggtcgcgccgaacggatccaagttcctgatcttcaagaactggaacatcacgacgccgctggtcaaggagatctccgtctacgcgtcaccggccatcaccaacttcaccgtcaacggtgtcaaggtcggcgcgaagaacgccacagcatccgattccggcacctacaccttcaaggtgtatccgggctcgtacacggtggaaccggtcacgtcgaagtatctgaccgcggattcgacgacgctgaccacctcctccgaatcctccgcctcgatctctgccgagccgaccgacgctctggcagacgagatcaacgcgaagatcaaggacaagctggatacctgcgccaagtccacggatgcacagcctgaaggctgcccgttcagcatgtacggttccgatgacgactaccgcaacatcgcgtggaacatcaccgaatacccgaccgtcaccactgatgacctcagcatcgactcgggcagcttctacgtgtacggcggcgaagccaaggtggcgtacgagtacaagaactatgacgactcctgggagccgacggacagttccaccagcttcagcatcagcggacagttcacgctggacggcgacaagctggacatcacgctggacgacgactgatcggaatgatttcgcccggcacggggcacctgctgcgcgcaccgtgccgtaagtggaagaatccgtgagcatcgcaacccgccgttcctcttgggacggcgggttcttgtatattggataaggtttgtgtacggcaacgtatcaccacggtgaacggtaacgaaactatcgacggaaagagcggaaaaacatgtcggcgatccttgagggcacacccgataagcgactggccttggtgacgggccgcgcatatcctgagcttgccaatgaagtggctcaatatctcggcatcaacgtgctgcccaccaccgcatacgacttcgccaacggtgagatgtatgtgcggttcgcggagccggttcgaggcgccgacgtgtttgtgctgcagtgccacaccaacccgatcaacaagtgggtgatggagcaactgctgatgatcgacgccctcaagcgcgcctccgccaagtccatcaccgtcgtggcaccgttcctcggctactcccgtcaggacaagaaacatcagggccgcgagccgatcaccgcccgcctgatgttcgacctgttccgcaccgcgggagcgaatcgtctggtcaccgtcgacctgcatgccgcgcaggagcagggcttcttcgatggcccggtcgaccatttgaccgccatgcccgtgctgatcgactacgtgcgcagccacgtgcctatggacaaggcgacgatcgtctcccccgacgccggccgcatcaaggtttccgagcagtgggccgctaagctgggcgggctcccgctcgcgttcatccacaagactcgcgacatcacgcgcccgaaccatgccgaagcgcatggcatcatcggcgacgtgcaggggcgcgactgcgtggtggtggacgacatgatcgacaccgccggcacaatctgcgaggccgtgcgcacactgcgcaactccggcgccgcctcggtgactctggtcgccacgcatggtctgctgtctggcccggccgtggagcgcctgcgcgattgcggcgcccgcgaaatcatcctgatggacactgtgccagtgccgcaggagaagcgcctggataacatgaccgtgctgtcggtggcgccgctgctggccgccggcatccgctccgtcttcgaggaaggctccgtggcgacactgctggagggcctgccggaggacatgcgcccgagaaacatctacgcctgaaatataaaacaaagggctacatatctgcccccactggcgggggcaaaatgacgcggtcctggccatccataacggattgaacacaaaatagggaggccgccacagggcgacctccctatttctatttacttatatcactcggcgcgcttgcgggcgatgaacaccgcgccagcggcggcgaccagcatcatgccggccatgccgatgacggcgacgttcgcacccgtcttggagatggcgttgccgttggcatcggccttctccagtgcggcgatcgcgtcggcgagggccttctgcgcggcgtcgatgtcagcctgggtggcgttgtcatcggcgaggacgctctgggccttggcgagggcgtcacgcacggcctgggcggacttcttcgtgtaaccgctcagatccagggccttggcctgatcgatggtggcctgcaacttgctcttgtcggtcgtctccgggttcggagtcggcttggaggaggcgggcttcagggccttcatcgcggcgttcagcgcgttgtacgcggcatcgacgtcagccttggtggcgttcgcattgttcaggacggccttggcggcatccagagccttcttgaacgcggcccacgaatccttggtgtacgcggattccttgagcttctcggcatcggcgaccaggccggcgagcttggaggtgtccacgcgctcttccagggcggcgatggcatccttcaggttctggtaggcgagagccacgtcgtacgcggtggcgttctcgtcgtccagcaccttcttggcggcgtcgcgcttggcgacgagcaccttccaggtgtcggcggtgtaggtggcctcggtcagggcggaagcgtcatcgtacaggttctgcagatcgcacttgttgaccttgacctcggggctcggcacgtcgcgaaccgtggtgacacgcagctcggcagcggaggcgtacgtgttcacctcgcccgcggactgtcccgcggtttcgagagcggtgatgcgcaccttggtgacgttcttgaccgcgtcgaacttgaccttctgccagacaccgctggtcgtggtgaacgtgccattggtgacgacgtccttggtggtgccgtcggacagcgtcagcgtaatcttgtacttcttgatcttgccgttcgcgttcgcgccgccactgcgggccatgtaacgcagaccgtcgatggtcgtcggctcgttcaggttgaactgataccaggcggtaccggcggacactgcgttggcgctccaggaggtgtgccagtgagtgccggcattgccgtcctgggcgaggcttgccgggccctcattgccgcccgacagtgcctgctggctgcccgcctcgacggtgtaggcgtcggtcgccacgtcgtacgcatcgttcgagtcgtcgcccggtgcgttcttcatgtactcggccagcgccacagccttgttgtaggcggtggtgtagtcgggcttatccttggcgatgagcgcctcgatctcggccaccgtgttcacgtacgtggtccagacttcggcggagtagtcgccgctcttgccgtcgtaggtgtccttgacttccttgagcttcgcctcggcgtcggccttggtgtgctcggcggatgccacgtgctcgaccttcaggtcatcgaggacgaagtccttgtagccaccgaagttggcggcggaatcggacgtgttctgcaggtcgggagcggtggaggtcgagtagatgccgaaccagctgtcgccggtgatggaaccggtgatctcgaactcggccgtgccgtcctcgcccagggccttcttcaggttggtgagcttgacggtgctggcgttgtactcgccgtcaccggtggcgatggcgtagatgtcgtcggagccggactggtacttgaacgacaccttgtaggtctcgcccggttccagcttgacgttctgcgggatcgtctggtagatcagcgtgcccttctggatcaggccgttggccttgacggaccacttgccgtcgagcacgtcgtccatcttcttgacatcccagccggcctgcgtgaacgggtcatgcagctcggacaggtggatacggttgtcctcgacgccttcggagccggagaccacgaacggccagatgccctgggcattgtcctcgaagtcgttggtgagcgtcttcagggtgccgtcagcgttgagcgtcaggcccttgtaaccgttctcaagcacgcgcacgtcatcgaagtacacatggtcggtgttgtcgcatgcgccggagtgcgagagcgtcaccttgacgtcgccgctttccggagccacgaaccacacgtacatgttctggaagtagctgctgccgccttcagtgttcgagtacgtgttgtggccgtacgccttgatgtagttcttggcgatcgacttgccggtctcgttggtggcgaggaccttggtgccgttggtcacggtgatcttggccggggagttggtgcggttgtccacgcccacgtagatcgcgtaacgcttgcccgcggtcaggtcggtgagcttctgggagaccttcacgtcaccggtcaggcgcagcatggcgttgttggtgccttcgacctcggccttgccggtgccggagacggcccagttgtccttgagggtgttctggccgccgttgaagccggcgtccacgacgtgcatgccttcgctccacttgacggagatctgcttctcggagcccttggtcacgacgtacggggtctcggcctcggcggtcagcgagatcttgccgccggagacggcgacggtcttctcgttggtcttgccctggtcggtgagctggtacaccttgacggaggcgaggttctgccaatccttcggcagggtccactcggtggtgccgccctgggtattccagtggtacagcttctcatcggaggacttgacgagcttgccggtgttcacgtcccacagccacggcagcaggtaggactcagtgcccttgacggtgttgctgttgcccggggagaccgcgccggacgccacggtgatgccgttgagcgtgatggtgcggttgcggtacgcggtgttgttggtgtcgttggagccacgggacaggacgacgacgttgccgtggtcgtccttcagcgtgatctgctcgttgccgttgttgacggaggcatccttcacggaggtggcgtcgagcgggctgttgacccagcggacgaccttgaagtgctggatgaacttggtggacacgtcgtgcgtgtacaggttcctgatgtacgcggcgtagtcgttgcgtccctgccagccttcgaagtccttcatgctgtagccgccgagcagcggggcgttcgcggcctggccgtacgacgggtagtcgccgacccagctgtccttctggtggttgcgcaggaagcgcatgacctgagaattctcgcccttcatggcggaaccaccgtaggtaaggtcggcggcccagtgctggaaggttgcgtcatactcgttgccggcgccccattcggtggtcatacgccagccgttctggttgatcatttggctcatcttgcgggtttcccacgagtcctcggcgccggaggtgttgttgccccacacgtcgaggtagatgaagtccatgttgtcgccgaccttgctcttgaggtcagcgaagcgggacttgcgcatgccggaggcgagatcgtagatgccgtcgatgccgatgccctgatccagccagttccagccgtagctcaggccgccactggagttgcgacgcaccatgtcctcgctgaaggccttggcttccgggtacatttcggacgcgttgacgtgcacgccgaagcgggcgccgtacttggtgcccttctccatcagggtgttcatgtccgcggcgccgccggcgcgggtgttgatgtcgccgtagtccggatggccggagtcgtggccttcgttgccgtagcccttgagcagcacggactggccgaggccgtcggtgttgagggcgaccttcttgacgttgtcaagcgtggtcaggaacgggttctgcgcctgggagccgaagttcatggcgatgcgccatgcgaccagctcgggcacttcctcggacttgtatgggttgttcatgatgtcgcggtatgcgatcgcgccatcttcccagttgaccgtgccgtcctcgttctcgtcgccggcgatggcgacggccatcttcggcatgtcggtctcttcgacggtgtaggtgttcttcttcgtgtcggtcacgacgcggtggtagtaccacggtgcagtgcccagaccgaaggaggtggccttgccgaccttctgggtggaggtgagcacgcgggtgttcctcgcaccgccggcgacggtgttgccgacggtggtgccgtcgtgctcggagttggaccacaggccggcgctcaggccattgcccgagacgaagccgtaggtgtagtcgttcgcattgctgaccgtggtgtcggcggtgatgtcgaagttggtgtcaccgggcctggcagtgtcggacgacatgcgggcgccggtgaactgggcgccgtcctgaccggagcgcacggagatgaggctctggttcgggaacgcaatcgtctggaccgggttctcctcggcctcggtcttggcgtcatccgccttgttcacgatcttggtgacgttgagcttgagcgtattgtcgacgaccttgatctgcacggtgacgaccgcgttgatcttgtcgccgctcttgacgttcagcgtgtactgggcctcggtcgcgctgaccttcttgaaggtcacgtcggagtccttcagcgtcacgtcggtgccgttaatggtgatgacgcgcacgtccttcggctggccgtacatgatcttgccgtcgagcttcttcatcgtgtagtcgtacacggacgggaagttcttcttcacgcgcacgtccatggcggcggtggagagcgtctcagtagcgacttcggccgacttgttcagcgtgatgttgccgactgaggcattgccatcggcgacggtgacggtcttggtggcgtcatcgtagccttcggcggacacggtcagcgtgtagtcgccggcggcgaggccggtgagggtgaaggtgccgtccgccgcggtggtggcggagttcttgccggtgacgacttcggcgccggcgatggcggcgccgctggcgtcgacgaccttgccggtcacgttgtgcttggcgacttcacccacggtgaagtttttgaagtagacatcagtgacttcgctggtgccggagtaagagccggccttcatggcgagcttgtcggtcagcgcggtcatcgaggagtaatccacatcgaacgccttctgtccgtcaatagtcagcgtggcaaccttggcggcagtccaggagacgttgacggtgatttcagcgttcgcggcaggggcagcgacacgtgtgccgctgtaccaatcgccattgccgccgacatacttctgccagaaccagccctccttgtcatagcccaggaacagggcgttgcccggatccttgtagccgaggtagaagccgaaacggttcgcggaaccagcctgcggggacttgaccttgatggagaactctccagcccgagtcaggtcaatcgtcttgccgctaatggcgacagccggatagccactgctgctggtggcattgccgttggcggaggtggacttgaaatgagtccatcctgcataatcgccagtgccggctgcaagaatttcgccgcctttggcggtgttgcggtcaatcgtccagccgttcacggcagcatcgtccgcgacggtggcgacatcgttggcgttcgcgtcattggagctagccgctgaacggagcgcgagagtctgcaaatcacttgcagaaagcggcgcggcggacgctgtgctgcccacccccagtggggcgacagcgagtgcaaccgcaagggccactgaaaccactcgttttctcatatttccttaccttcatcatggagcactaaggcttaaccttgagcggatacgcatgacggaagcccgacacgcgcgtctcagttttctatgataacactcttaacaaaatacaagaacgtgtgttgttaacattattaatttccaaggaaaatagaaattttcgccatataccaatgggtatgcgtgaaaaaacctgtgcaaatcccctcaaagaacagtgatttttccccgtcgcggcaacactgtctcgcggaagttttccgctatttgttaacttaccttacttattggagcgctggaagagccaactggccgatgcgatgctcactggaggtgatttgcgttcatatgttcgcgccgaaacgacgatcctgcgcacttacggacgcaaatgggtctgtttgcgtccgtaagtgcgcgcacttgtcgtttcggcgcgcacttacggacgctaatgccccccagtcgcttcgcgacgggggcacgcactatataaaaagactatttgctattcggaacgaacgactcgaagatgtggcggtcgaaatactggtcgcattcggctagttcgtctgcactgcgaaccgtccacgacaccggtatcgcgcccatccagcgtgcggcccgcagctgcggagaggggccgccatgccagtcgaacgccacgaagtccgggcgggagatccaatcgaacgccaacagcccggccagccactccttggccccggcaccggtgagcgacgccggctctgccaactggccgcggcacacctccggacggtgctccttgtaccagttgaccgcgcccggatggaacgactcgatcacatacgggccgtcatacgcctgcagcagttggtcgcccttctccatcagctcgtccgcccgctcgccccacgcggcgttgtcggtgaacttgtactccacgatcaccggtacacgtcccgcgatcacgcgcagcacgtcgacgaacagcggcacgtgctggtagtagccctgcggagcgaactgtgcggcggccaccgggtcggcgacgggcgccgcctcggcatcccccggcttcgcgggcgcggggaacagcgggatgcgcgacagctcctcatacgtcaggtcggcgatcttgcgcggatctccggccacgcgcaacaggttatcgtcatgcacgaccaccacgcggccgtccttggtgagctgcacgtccaattcgatgccgaatccggcctcacaggcggcggcgaacgcagccagcgaattctccggggcgatcgagccgctgaagtcagcggtcccgtatcccgcgcgcaatgcgcagcgacgcgccagcgccacatactcgccgctgtgcgccgcatactccggcgtcagtcccgatcccgcgtcatgcaggccacgatgcgcataccatacgtccggaaccgacggcacgaaatgacgctgcttgtcgctgaacgaacgcggcttgatggcccagaccgcggcgcccgcggctacggctccggcaagcaccagcttgccgccaacatgttttcccatagtgtttctcctaaccgtgccgtcggtttctatcgcagcacgccgtcgatcagcttggtgatcaggtcggtatagccgatgccggtcgcctcccatgccttcggatacatggagatcggcgtgaaaccgggcatcgtgttgatctcattgaccatcacctcgccgtccggcgtcacgaacgtgtccacgcggctcaggccggcgccatccaccgccttgaacgccttgaccgcggtctcgcgcacctgctgcagagtctcctgaggcagattcgccggcacctccacatggctcgccgacgaatccatgtacttgctgtcgaagtcgtagaactggtcgtcgccgctgttgcgcttgtcgagcacgatctcgcccggccagctggcctgcggctcgctgccggccttcgggcacagcaccgcgcactcgatctcacgcgcgtcgatgccctgctcgatcaggattcgccaatcatgatggctcgcctcgaacacggcggcggccagctcggcggcgtcaccggcatgctccaccttggtcacgccgaagctcgatccggcgcgggacggcttgacgaacagcgggtacgccagtccggcctcctcgacccgagcgagcagaccatcggcatcagcggcgaaccgtgacgccgcgtcgaagccgcgcgcgtccacggtgatgccgggagcgaccggaatgccggcggcggccagcagcaccttcgtgtaatgcttgtccatgcacgcggcggacgcgagcacgccgcaaccgacgtacggcacatccatcatctccagcagaccctgaatcgtgccgtcctcgccatacgggccgtgcagaaccggcagcaccgcgtccacgtgccccagcgagctcagcgtgccgtcgtcattgcgggcgaagaagccatcctgcccgagcgccacgtccagcacgacgtcgcgcgagccgggagtcttctcgacgaccggcagaccgtcggccatatcccatccgcgcgggtcctcgccgtccacgatccactggccctgcttggtgatgcccaccggcaccggctcgaaccggtcggtgtcaagcgcgcgcagcacgccggcagtcgaaatgcaggaaatcgaatgctcgtcggccttgccgccatacatcaccacaacgcgaatcttggccgtttcagccatgtcttcctcccatgccatgttttgcacatactgggtcatagcctaatacgtgcgatggcgcaccgccccgtaacaattcgcctcttgcaaaacccgccaaactcagcagggtgggcaccggtgagattagctttgccgatggcgcgaaccaccccgtctcgctgcggggcatatgctaacgcctccgctggcgggggctgccgagcgcagcgagactgggggggggttaatgcagcctactcctcggtgatctcggtgccgagtagttcggagagcatctgctggcaggatatgccttcgttcagcacgcggctcatcgcgtaggcgagcggagtcggcacgtcgagctcgtcgccgagcgcgaccacggcgtcggtggtcggcacgccctcggcgacgccgttgctcaccttcgtggcctcctcgacgctcaggcccttgcccagattcgcgccgaacgtgtaattgcggctcaggggcgagccgcaggtggcggtcagatcgcccacgccggcgagaccggcgaacgtcttcggatcggcacctgcggccttgccgagcgcggtcagctccgccagtccacgcgtctcgatcatcgcggcggtgttctcgccgtatccggctccacgggccatgccgactgcgagcgcgacgacgttcttcaacgacccgcacatctccagtccgatcacgtcggaagtgatgaacgccttgaagtaactggtcgtgcaggcggacgccaccttgcgcgcattgtccagattctcgcaggcgacgaccgtggcggccggctgacggtcggcgatctctttgctcaggttcggtccggaaaccgcggcgaaacgctcagccggcaggtcgagggcctcgcggaccacttcatccatgcgcttcttggtgttccgctcgatgcccttcatcaggctgacgacgacggcggtatcgggaatcaggtccttgaactcggcgagcgccacgcgcgcgaactgggcggcgatggcgacgacgatgatatcggcgtccttgacggcctgcgcccggtcgcccgtggcggtcatgttgtcgggcagcttggcgacggacggcagacgaacggcattgtggtgccggtcgcggatgccctccacgatttcgggctcgatggcccacatcgtcacgtcattgcccgcgtctgccatcacctgaccaaaagtggtgccccatgcgccggcacccaatacagtacatttcataacccactaccctactccagccccggatacgagacctccatgcgcacgtcgcgcaggtatgaacgcgcccgcgcggcgtggcgctgcgcgggcgtctcggatgtccgtcgtgttcgggaatcagtcggtaacgcggctcatcgtacggtaatcccagtagccggagggagcacgctcgccgcggatctccgccatgacctgcgtcatgcgcacacgtacccggcgggtcagctcgtcggcgagctccacgggaggctcatcgccccacgactcgctgtcgaccagcagatcagcgtaatccagctgcgcgtcgtagcacatgacgacgttcttgcgcggccacggccaccagtggttgatgctcgccgcaccccacgtcaccgcgcagaacagcggcacctggtatccgagccggcgcgatgcctccagtgcgatcacgccgacgccgttcttcatgctcatcggccatttcttcgggtcgcgggtcaccgtgccctccggccagacggtcagcgggcggccgctcgtcagaatctcgaccgaggtctcctcgatggcccgtgccttgccggaccggcgctgaaccggctgcatgcctacaatctggaaccacttgccgatcagaggccagtgcgccatctcggccttcgccatgtagcgcgggcgacggcccatgtggaacagcgacgccatcggcacgaacacgtcgaacatggtcacatgcgtggccgcggtgatgaacgggccggtttcagggatgttgtcgagcccccaggcgtacgtcctgcagcttgcgcggaacacgacatcgacgcccttgagcagccgtgaggtgcccttggggttctgcgcggcgatttcggcctcgttgatcgtgcgatcagggccggtcggcaggtcgcgcatcggatcgacgagcgtgtgcgccttggcgagcctgctcacttgtgcattggacagcggcttgaccgcggaacgcggtgacggttttcctttggatgccatgagagccattgtacgtgcgtggcatgtcgtggcacaaatggtgccggcaacgcaaaacggcggccggaaaaccgaccgccgttcatgcaaacaacgtctgacgacttactgaagcttctccacctgatggaagccgagttccaccggcgtgtcgcgcccgaagatggaaaccagcacggtgagcttctgtgtggtgggttcgacatcggagacgacggcggccatcgtggcgaacggcccgtcgatgacggtgacctgatcgccgacggcgtaggacacctcgacaacgcgcttcttggccgcggcaggcttatcgccggccttcttgagcgcttcggaggcgatcatcggcgccagcatggcgacgacttccttgcgggacagcggcgccggatccttggtcgggccgacgaagccggtcacgccttcggtctcgcgcacgatacgacgggcatcctcgtcgggccacatgcggatgagcacgtagccgggaatgcggacgcgggtgatgaccttcttgcccttgtcggtgtgcttgtcgacttcctccatcggcacttcgatctggaagatcttgtcttccaggccaaagctagtgacacgggattcgacgttcgtcttcacgcgcttctcgtaaccggaataggtgtggagcacataccacttgccttccagggtgcgcagcgactttgagaactcctcaacggcctttgcgcccgcgtcgagctcttcggattcctgctcgtcggcgtcgccggacgcttccgcatcgttttcgacggtgtcggattcaacggcgtcatcagccgcggcgggctgttcttcggcattgtcattgatggaatcaaccgccgcgtccgcaaccggatcggcttcaacggccgtgccggccgaatcgggaagatccgccagtgcgtcgaggttatcgagattcacttcatcagtcatgcgtaactttcaccttcagggtcgatggatcagccgaacacccacagcacgagcttgcccagaccgaaatccatgcccgtgacgaggagcatcagcaacacgacaaagatgaacacgccaagagaccagaagaacagttccttcgcagtgggggtgaccaccttgcgaagctcatcgataatctgcttgatgaacaggccgatgcgcatgaatacattcggcttgaccgctttctccgcattgcttgccttcgccatgttcatccttttgtgtgttggttgcaaatacttggcagggaaggcgggactcgaacccacaacctacggttttggagaccgttgcgctaccaattgcgccacttccctaggtgaactttgcccactgtacccggcacgcaagactacgtgtccgttacttggcaaaaccgccaagaggccatattagcggggattgccgatttcgtccaatcgcgtgtctcgaccggcgcgtaatcggcgtgccgcggcgtgcgcggcagataccgcgcacgacctcttgcaacggtttcagccgacccagcggcggaaccggcgcatgccctcagcgagctggtcatcggccagcgcatacgagaaacgcaggtatccgggggcgccgaacgcctcgcccggaaccgcggcgacatgggcctcgtccagcagcgccgcggcgagttcggaagacgtgttcacgacggtgccgttctcgccgagcggcttgcccagcaggccggtcacatcggggaacgcatagaacgcaccggtgggcgtcgggcagtggacgccggggatatcgttcagggcggcgacaatggccttgcggcgggcatcgaatgactcgcgcatcatatgcacctcgtcgagcgaacccgcgacggcggcgagcgccgctcgctgcggaacgttggaaacgttggagctcaaatggccctgcagcttggcgacggccttggcgacgggcgcgggggcgaccatccagccaactcgccagccaggcatcgcgtaggtcttggcgacgccgttgagcaccagcagctggtcgcggcattcggggacctcgacgccgacgtatgcggtcttggcgccgtcatagttgaggtgctcgtagatctcgtcggagatgacccacacgtggtgctccacggcccactcgccgatcgcgcggatcgtctcgcgactccacacggcaccggtcgggttgttcggggaggtgatgatgatggccttcgtgcgctcggtccgagcggcctcgatggcggcgatgtcgggctcgaaaccgcggtcggcgccggcgaacacctcgaccggtttgccgccggccagcttgacggcctccggatagctcgtccagaacggcgtgggaatgatgacctcgtcgccgtcattgagcagcacctggaaggattcgtacacggcctgcttgccgccgttggtcaccacgacctgatcggcggtcacctcgtagccggagtcacgcagcaccttggccgcaatcgcctcgcgcagctcgggcaagccggcggtgggcgtgtacttgtagttgcgcgggtcgttgcacgccttgacggcggcatccacgacatccgcgggagtcgggaaatcgggttctcccgcgccgaagccaatcacgtcgacgccggcggccttcatcgccttcgccttagaatcgacggcaagagtcgcgctcggtgccacattgttgatacggtcggaaaaagtctgccagtcagccatagtcatgccatccatgctaaacccagagcacgaaaaaacaacagaccccgactacgctcggcacggcggctctcgttgcgcgacgaatcagaccagcacgagattgtcgcggtgcaccacggggtgagcgaactcgtcgcccaggaaccgcctgagctgcgcggtgttgcggccgagcatctgcgggatctcctcggagtcgaagcccgcgagcccgcgagccagatgcgcgcccgcctcgtcatcaatccacaccgggtctccggcggagaattcgccgtgaacctccacgacgccggcggcgagcagactcgcgcgcccgcctcgaaccgccttggccgcaccggcatccgccaccaaggctccacgcgggtcggacgcgaagccgatccacagccgacgcgatgaaccgcggtgcttcaccggcgcgaacaccgtgccgaccggatcgcccatcagcgccgggccggtgttcgtcgcgctcgtcagcacggcgggaatgcccgacacggccgccacgcgggcggcatccagtttggtgaccatgccgcccgtgccgaccccggacgacgaaccggcgacctgcacgtcgccgatcgtgtcgatcacattcggcacaaagccgatgcggcgggcgcccggcgtgctcggcggagctgtatacaggccgtccacatccgtgagcaacaccagcgcatcggcccggacgaggtttgccaccagtgccgaaagccggtcgttgtcgccgaaacggatctcgttgctcgccagcgaatcgttctcgttgacgatcggcaccacgccgagttccagcagacggttcagcgtgcgctgcacgttgcggtactggaccgcgcggatcgtgtcttcggcagtgatcagaatctggccgacccgaacgccgaaacgaccgaacgcggcctcatactgcgccatcagcagcccctggccgaccgcggcgacggcctgctgcgtcgccacgtcactcggacggctctcgaagccgagcgggccgaaacccgcggcgatggcgcccgacgacaccagcaccacgcgggcgccctgcgccgaggcggcggacagcgcggccaccagggagttcagcttcttgacatccagatgcccggacggctgcgtcaacgagctcgaaccgactttgacgaccatggtccgtgcgcctgcgatggcgcggcgcacatccgattcagtgacggacaacacgcactcccttcccgatcacgtatatcttgaatcatcacagacgccggtgtcataggacgccgccgttccacgctgcggccgccgcgctggtggaaccgcagacgaatgtgccagccatcctcagtcgctccgcgccagcccccgcgggcgggggctggcaatgaagctgactgggggtggccaggcgtcaggccaggccgccgtcattctcgtcgccgtcctcgccgcgaccgaacaggctctgctcgtcgtgacggtcgtcgtcgacgctcggatcggcccagtgaccggcctgacgttcggccatcatggcctcgcgcaccgcggccttggcgtccatcatctcgtggtactgacgacgacgctccgcattggtacggcgacggccgcccggctcctgatcctcaagacgcagatcgcggccgcgggcacccagctgagcgccgtcaagcatctccgcgccggcggcgatggtcggatcccaatcaaacgacacggcacgctgccccttgccgatacgcacctcgtcacccggcttcgctcccagccggcgcagctcgtcctcgacgccaagcttggcgagtcggtcggccagatagccgacggcctcgtcattgtcgaaattggtctgcaccacccaacgttcgggcttcgcgccggtcacctcgtaccagaaaccgccatcgccctccttgcgggccacggcgaaatcggcagtgccgttcgcagccgcacggcgacgattcgaccgatcctccaacggattgatgacgacacgcgcctcctcctcggcctgctcgcggctggcgacctcctgccgcatgtcggcgaccatggccgccagcgcaaagttcagctccttcagcccctcatgagaagccgtggagatctcgaacaccttcaatcccatacgttcgaagtccgggcgcacgaaatcggcgagctccttggcctccggcacatccaccttgttgagcacgatgatgcgcgggcgttccggaatcgggatggcgcccagcggcagttccagcttgtcggcgtattcggcgagctcatgctccagcgcatggtagtcggaaaccgggtcgcggccaggctccagcgtcgcgcagtcgatgacgtgggcgatgatttccgtgcgctcgatgtggcgcaggaactccagtcccagacccttgccctgcgatgcgccgggaatcaggccgggcacgtcggcgatggtatagcggtggtcgcctgcgacgacgacacccaggttaggcaccagcgtggtgaacgggtagtcggcgatcttcggcttggcggcgctcatcgcggcgatcaggctcgacttgccggccgacgggaagcccaccagcgctacatcggcgatggatttgagctccaggatcacgtcacgttcctcgcccggttcgcccagcagagcgaaacccggagcgcggcgggtcttgttggccagcgccgcgttgcccagaccgcccgcgccgcccgcagccgcgacgaacttgtcgccgttatggcgcagatcagccagctgctcgcccggacgcttgggacggccttgagcgccgaccgcggcgaagatcacagtgccgagcggcaccggcaggatcaggtcggcgcccttggagccgtccttgacgtcgcccagacccatcgtgccgtcgccggcgttgcgatgcggcatgaaccggtagtccagcaggctggtggcgttcgtgtcggccacgaacactacggaaccgccgttgccgccattgccgccgttcgggcctgccaacggcttgtacttctcgcgcctgatgccggcggatccattgccgccgtcgccgcccttgacatgaacggtcactctatccacaaaatcactcataacgctctaccttaccttgacccccggttctccccaggttcgctcgctccgcccgcagcggagcagctccggtcgctctgccccccccaatccgtgcggaggtcttcacaagtgctcaaattacgggttgagatagccgattccggcaattccccgtgtgaaatcgccgttttcaggccccaaaacgaccatttggcacgggggattccggataacggctatttcaccccgtaatgtaccggtgtaccagaggagggtggggtggctcctcggagagtgatgtggtgcctgatgagggaggcgcggtaccggaggggacgcacgggggttacaacacatgacgcgggaaacacgatacatgatgagagggcacggcacatgacgcgcgaatgtgggccgtcgccgcctatgcgcaatcgaatggatgccttgcactccaccgtatgctccgccatcatccggatttcccggcggaataggctcatcgcgaattcgcagatgtcgcgagcccagaccccctacacttggcatatggggacgcatcattcgctggacagacttttcgccgttgcacggcaggagcgacgctgcgccattccctccaccaacacggacatacaggcaatacgcaggagagtgaagaccggcgccgtgctgagagtcttccgcggcctgtacgcagagcccgcgtattgggaatcgcttgatccgcatgaacaggttcgccatatcgtacgagcgctcgccatccaacatcctgattgggtgttctgcggtcctacggccgccatcatgcacgggctcgactgctcctatcggctggcattcccaatctgcatcgtcgcgagccccggcgcgcatcatcaggacaccaggcacatatcgcatcacgcgatcacgcatccggacatcaccgtggttcagggagtgaaggtcatcagcttgctgcagacactgttcgacctcgcggcatgccagcctctgcgctacgccctcgggccagcggattgtgcgctccgcaacggcctcgtgagcgaatccgtgctccgggcgtatccctccagcgtgaaatactcacgcaaccgcgccgccgtcgagcgcgcgttcgcgcttgcagatcggcgtgccgagaacggcggcgaatccgaggcccgcggcatgttgcatgatgccggctgccctcctgacgacattcaggtggaattcccctgtctcgatcatcccggtcgtaagcatcgcagtgattttctctggaagcgtgaagacggctcggtaatcgtcggggaattcgatggcgttcgcaagtatgtggatccgcatatgacttcaggccgggaaattcgcgaagtagtggatgaggaacggaaacgccagcaatgcatgtcgcagtatgcgatcggcatggtgcgcatgtactacagggatcttgacaatccgggacgaatcgtccggcagctcagagatatgggcatacaaccatgacacgcgtgatgtcggggcgcgcgccgcactcgtaacccacacatgtgggccagcaggcataagcccggaaaggccgcgtgatcgcagcgacaccattccaagccccgataagcgccgccatgcgccaaaacacgggttgaaatagccgttatccggaattccccgtgccaaatggtcgttttggggcctgaaaacggcgatttcacacggggaattccggataacggctatttcaccccgtaatgtaccggtgtaccagaggagggtggggtggctcctcggagagtgatgtggtgcctggggagggaggcgtgacatcgcatggcacaggcgtgacggctctgtggggatgcgccgtgcggtgcgggcatgccgggaatgcgctagggcggcaaacaaaaaagccgcacccgggtgggatgcggcttgacgcttaatgcggtattgctcaggcggcgatgacgtcgacgaccttgcggtcgtgacggacgccgaacttcacgctgccgtcggtcagcgcgaacagggtgtgatccttgcccatgccgacgttctggccagggtggaagttggtgccacgctgacgaatgatgatgttgccggcgacgacggcttcgccgccgaacttcttgacgccgaggtactgaggcttcgaatcgcgaccgttgcgcgagctggaagcacccttcttatgtgccatgattcagatccttcctgtattggctcaggcgatcgccgtgatcttcacggcggtcagcttctgacggtgacccttgcgacgagtcacgccggtcttgttcttgtacttcatgatgttgatcttggggcccttggcctcgtcgtcaatgacttcacccttggcggacaccgcggcgagatccttggcgcccagcgtcaccttggcaccatccacaaccagcgcgaccgggaattcaacggtctcgcctttcttcgcctcaagacggttgacgagaatcacgtcaccgacctcgaccttttcctgatggccaccggccttcacaatcgcgtacatgcttcgttccttgctatggtgttataaaagctacttgcctgacgcacgcaagccgctggtcagacaccagcaatctaatctacactgacccatgtactaacgcaaatcatatttccggcgtgtcaggttgacacaccggaaatcatgattcattcagcgcgtcgggtcactcatcctcgtcggtgccgttcgcggcgaccgccgcggcggcgatctgcgcgagcttggccttgatatccggcgaggagccctgcggcacctgcacatccgtaccgcggccgtgcttgttggtcttgatgaacggatcgccacccttgagcgcatacggatcgtcgtaatccgcgctgacggtcggctcgtcatgcaagatgaacccgcggccatggcaggtcgggcactcctcggagaacgcttcgaccaggccctggccgatgcgcttgcgcgtcatctgcaccagacccagcgacgtgacctccgccacctgatgcttggtgcggtcacgcgccaggcattcgaccagacgccgcagcaccagatcgcggttggcgggcatcaccatgtcgacgaaatcgatcatgaccatgccgccgatatcgcgcagacgcagctggcgcgcgatctcctcggccgcctccaggttgcatcgcgtcaccgtctcctcaaggctcttgccgcggccgatgaaccggccggtgttcacgtcgatcgtggtcatggcctcggtgcggtcgatgacgatcgacccaccggaaggcaggtacacctgacgctccatgcccttcctgagctgcgcgtcgatctgccacttgtcgaacacgtccttgccctgatgctcggacggatcccacttggacaacttctccttgagatcgggcgccatcgtgtcgaggtattcctcgatgcgctcgtacaccttgtcgccctcgacgattagctcgccgaaattgtcgttgaagatgtcgcgcaccacgcggatcgcgacgtccggctcgccctgcagcagcttcggccgcttgccgtgccagaactcctcgcgcttggcgttgatgcgctcccactggcggaccaggctctccagatccttgacgatcgcctcctccttggcaccttcggccgcggtgcggataatcacgcccatgtccttcggcgcgatcttcgagacaatgcccttgaggcgcgaacgctcgcgctcgctcagcttgcggctcacgccggtcatgccgccggacggcacgagcaccaggaaacgcccggcgagcgtgacctgcgaagtcaggcgagcgcccttgtggccgatcggatccttggtgacctgcacgagcaccgggtcgccagatttgaacgccagctcgatgcggcgcggctgcccttcgaggcgggtcgcgtcccagttcacctcaccggcatacagcacgccgttgcgggactggccgatgtcgacgaacgccgcctccatgctcggcagcacgttctgcacgcggccgaggtagatgttgccgaccgtggcgacctcctggatgtcggagacgtaatgctcgacgagcacgttgtcctcgatgacggagatctgcgtgtgatggccgcgttcgcgcaccaccatgagacggttcacgtgctcgcggcgcgcgaggaagtcctgctcgaccagctggctctggcggctgcgctcgcggcggttgtcgcggcggcgctgcttcttcgcctccagtcgggtggagccctcgacgtcggtgatctcgtcgatgtactgctgcttgcgcgagcggcgcacggtcatctcatcgtcaccctgctcgtcggacgcgcgggagcggcgacggcgacggcgacgggtgacgttggagtcatcgtcttcttcctcgtcgcgtgtgcggcgggacgacggcttggctggctcatcctgctgcgccgcggactggctgctgtccgactcgccgttgccgcggctgtcgtcggcacggttctgacgggagcggcgacggcgacgggatctcgtgcccgaatcctcggagggctcctcgtcgtcgaccggcgtataggagatgccgtcgagctccaggtcctcctcgatctgctccacttcggcggccgcacggcgctcctgcgcgttcaggcgacggttgcggcgcgacgaacgcaccggctcgtcggcctcgccggattcgtcacggctgcggctgtcgtcggtatcgaagctgtcgacgcgctcgatgtggctcagaccgtcgatatcgcgacgggaggaagcgctcttgtccttgtccccctgcgcgccgtcacgtgacacacgaccattgcgcgagcgacgggacttgccaccgccgcggctgtcgcggtcgtcatcctcgcggtcgtcatcgcgcgcgtcgcgcacgatttccggcacgggcagcaccggctcctggaacagcacggacgtcatcgcgtgagcgcgcggcgcaggttgcggcagcgtgctaacgacatccagggcgcgggacagatcggcggaatcatcgcggacgatgatatcggtgccggtatcgacgccgaggtcgtcatccgacggctcgcccggaacggccggcgaagcgtcctcgcgcgaggagaacatggcggtgcgacgacgcacgcgggtgcgccggggttcggcctgatcggcgtcatcgtcatggcgcttcgtcgctttcgaggagcgcgacgcggaccgagacttgccgtcggccttggcgtgccgcgcatcatccttcttttcggaatcggccgatgcggcggtctccggctcgttggcctccggcgattcgtcggccgccttcgagcggcgacgacggggaaggggctgctccaccacgggttccgcgaacagcggagcggaatggtcctcgaccttcagcgcgaccgcggcaccggcggcaccggcgccacgaaccacgcggcggccaccgcgacgacgacgcggcgccgcaggcgttttatcggccgaatcaggcgactgggccgcatcggcgtgggtaggctgctgttcttcggtttcgtcacgactgaaaccgttatcgttcacactaggcacgatactcctcacgacgtgctgcaccacgtcgcacactcatggcctcatgcggtctcacaccacgctctcaccgtggccgcgctacgcttgcgcccgcaggaagcaaatccgttaaaagtccgtgtgcgtgcttcggcggacaccagcgctcgcgcatcttcatgcatgcgaggggatcgacgcctttcacgctcaggtggtttgcagaaccaccatctttaagtatggcacacaatttgaccggccatgaccatctcaccatattcaacgttcttttggcgtggcgacaacgctcagcccatgcttgtacgcagacgctttcgctccgcgaacggtgtcaggatccgtatcatcgtcaccgatgcggacggcgacgacatcgtcgacaaaacctgcagcgccaactgacagcgttgtgcgggcagccgtccgcacactattcgatggcacggatgccgacatccgcgcccgaaccccgctcacgcgcggccggtgagccagtcctccaggatgccggccatggtcgccaactcgctttcggcgatctgctcgtcatgcttgtgcgcaagcagcgggctccccgcgcccaggttcaccgcgggcacacccagcagcgagaaccgcgcgacatcggtccacccgagcttcgccagcggttcccgtcccgtacgctcacgcaccagcttcgccaacgacaccaccatcggcgcgtccatgcccggccgggcggacggcgactcgtccttcatctcgatgccgaagccctcgaacacgccaccggtggcgacatgctcgccattgccgagctccgcgccggcatccgcgcccatcatcagtgtcttcgcctgcggcagcgtcttgtcgggcgcgaaccggtagttcacatggacacggcattcgtcggggatgacattcgtccccttgccgccggaaatcagcgtcgcgttcagcccctcgcgataatccagcccatccaccgtgatggtgcgcggctcgtaggagttcaggcggttcaggacatcggcggccttgtgaatggcattctcccccatccatgccctggccgaatgcgccgcgaccccgtgcgtgaccacgtcgaatcgcatggtgccgttgcagccgccctcgatgccgcagtcggtcggctcgccgatgatcgcgaaatcgccggcgagccaatcgggatgcgcctcggccaccttccgcagaccgttcttctcggccgcaacctcctcatggtcgtagaacacgtacgtcaggtcatattgcgggtcgaccagcgtggcggcgaggtacaggaacaccgcgtcggatgctttcatgtcggtcgcgccgcggccccacatcacccgctcgccggggtgcgccgcggcgacgtcctcccggatcagcgggtcgccgggcaccagccagcgcggcgggaagttgtcgatcaccggaaccgtgtcaaggtgcccggcgagcaccacgcgccgaggcctgccgagcgacgtggacgcgaccaccgtgtcgccgtgcctgtgcaccgtcaggtgcggcttcgaccgcaggaacgcctccacggcgtcggccagcggcttctcgtcatcgctgacggaatacgagtccatgatctgttcgagcagtgaggcgagcgccttctcgcgcgtgccggtcgtgtcgcaggtgatcggcgcgatcgccgagcgcgggtcagcaccggccgctgccatcgtcgttgtcgtagtcatgctgaccatcctaacggcagcacgtcccgtcggagcccgttgccgggccggaatgagacggtcgaactccccgtcggcggcgagaacaagcgcgcgacgcgcagcatgccgtgctaccgtggctcgcgagacgggtttcgcctgcgttatgagacagaacctcgcgaaacacatgcgtatggcagtatggggtttgccagcaaacggaaaagggatgggaatatgccgggtctattaaatgcgatggaaggcttctgcgtcatcggcatcgtaatcggagtcggatatgtggccgctcgaatgcgcataggcgggccgagcgcccagatggtgctcaaccgtttcagcttcttcgtgtccagcccgtgtctgatgttcgcaattctgtcgaaagagccgatcttcgagatcttccattcgtcgatcatcgtggcgttcttctccgctgtactcgtcggcgcgctgttcctggtgctgaacaagctgttcttccacttggggccggcagacgcgaccgtcggcgcgctgaactcactgtatctgaactcgaacaacatcggcctgcccatagccacgtacatcctcggcaacggagccctggtggcaccgatcctggtcatgcagcaggcgatcttcacgccggtcggcctgacggtgctcgacgtgaccaccaagggcaaggtatcggtcaaggaaatcctgaagcagccgctgcatcagccgctgctgatcggctccctgggcggcatcctggtttcggcgatcgacgcgaagatcggctggttccccgtgccgaacttcatcttcgatccgattgacatgatcggggactccgcggttccgatgatcctgatggcgttcggcatgtcgctgcacggcaccaagccgctgcagcagaagggcgaccgcccggcgatcttcaccgtagccgtactgaagaacatcgtgatgccgatcatcgccttcctgctctcctatttcgtcatgggattccgcggcgcgacgctgtacgcctgcgtggtactggcggcgctgccgaccggccagaacgtctacaattacgccgcccggtacaacgttggacttacgttcgcacgcgacggcatcctgatgagcacgatgacgagccccatattcatcgcggttatcgccgctctgctgagttgacgctctcaaaactcgcagataggggggccttttaacgagaaaggccccctatctgcgagttttgagagcgtgcgatcagtcgtcggcacgccagtcggtgagattcaggctggcggcgacacggttcgaggcgaatgcgccgacggagaccagcgcataacacaacgctatgccgccgaagaagctgagcagcgtggcgggcttggtcatggatgcggcgaacagcgggaacatcagcagcatcgagcagccgccggcaacggccaccaccgtgttgagcggggtcagcacctcgatgaaacgcgcacggttcaacgttttcacgtccgtcccctccaacaccagcatgcggtattcggaaacctggtcgtagacgctgcccgcttgcatcactccggagctgacggccgccagcacggccgcgaatccgagcgtcagcaaccctccggtgccgatgtcgcggatgaaagccagtcccggttcgggtacgccttcgacaggcgcggtcgacgatgcgccgatgaacccgcagatcgaggtgatgccagcgatgaacaccgccagcgcgatgcccgacacattgcgccatgcccgcttgggattgtcgaggatgcgccgcatcgcgatcatcgtggcggcgtccttagggcggcgggaccgcaacctcgcccgtgcggtcaccacccatgagccgatcaggttcactagagcgaagcacagcgcgatgaacccgataatcaccgcatacatcgtcacctcaccgtaatgcagcaggccctgcgggttcttgaacagcacgatcgcggccaccagcacgaccaggaacacgattacgcgccacttcgtgggcagcggctgggcggtccgagcggtgacgcccagcggggtgatggcgacccgacgcagcgtcagcaatgcggagatcagcgccaggaccgtgaccaccaccagcacgacgatcagcgacagggatcctacccacaactgctcgaacgtgaacctctgatcctggaaattcagcagcatgatcagcggcatgatcgcgaaatagccgacgatgccgatcaacgcgccgatgagcgcctgtccggcggcatccaacgcggtcagtctggtcacctgactggtggtggcgcccgcgaggcgcagtgccgccaatcgcgcgtcccgccgcgatgccgccaatcgcgccgccgagccggcgagcgccacgaacggcacgatcagcagtatgcaggcgaaggccgccagcatcacgtacgtgctggcgtattgcgcccagtcgtgctggtccttgagccgtccggcccacaccgcccatgtgcccggcgcgcaggtcgacctgtcaatcaggcatttcagcgtatggtcggcggacgcgcgccagatgaacccgtgcacgccgcccagcacggtcaggaagatggccgtcgccgccgcgaacgcgacgatggccaacgccgatgtgtggccggaaccgccgcgccggcctgggcggtggaacagccgccatagtgcgaacgtgctcattgggcgcctcctgcgggaactgccgggtgcagcgagactgagggtggttcagcgctctcgggccgcccccagtcagcctgcggatgccgaaccccgccagcgggggcaaggccggcttcggccgtctggctgaggcggccgtcctgcatcgtcatcgtgcggccgcagaagccggcgacgttgggatcatgagtgacgatcaccacggcagcgccattatcacgcgcggcttccatgagaatgctcatgacctcgcggccggtggcctggtcgagcgcgccggtcggctcgtcggcgaagacgaccgccggctgtacggcaagtgcgcgggcgatggcgatgcgctgcatctgcccgccactcatctcgccgggccgctgcgaggccagctgccgcaaacccagccgttccagccacagcatcgccgcatcggtggcggaacggtagtcggcgccgtccagcatcatcggcaacgcgatgttctccaccgccggcaactcgggcaacagctgtccggattggaacacgaagccgaacgcaccgcggcgcagtttggtccggtccgcgtcgctcatcgcggtcagattcgcgccttggaaggtcaccgtgcccgacgtcgggcggatgatgccggcgagcgcgtgcagcagcgtcgacttgccggaaccggacggtcccatcacggcgaccgtctcgccgggagccaagtcgaagttcacgtgattgagcgctagcgtatgcacggcgggcatggcgtagccggttccgccggccgcatacggatgggggccgccggttccggcgcctcgcggcatcacgccggtgacactgtggtccgcctgcacacgggccatgcctgcggtgtagtccatgaccaggtcacgggcctcgatcaccggtgtccacgactgagaccgggcgcgggactgagattgcgatgttgctgtgttcatgcctccgagattacgcaggcggcacgcgaccggccatcgggcggcggtatgagccttgcggcgaaccggttctcccctcatccggaaggattaggggaagagagtggtggcactaccctgagcgcccacagggccgtgattgcagggcccgaaggtctgtcgcgaagcgagactaaggcccccagtcgctcgtctgcggtacggctcggcagccgtgaatatatattgcattatatcatgtagtactatgcgtaatataatgcatattttgttgtgattaaggtggtgacttacatggacatcaaggaacgtgcggaggcgttacgagagatctccacgccgggctctcgcatcgggttgaccgagttgtcccgttcgaacgcatggcgaaaggcgctggagcagcggggattgctggaaatcgtcgaccgcgccgacacagccggctatctggtgtccgtggactctctcaacgagatgctggatgtcatcaatgcgctggaatccgaggtcgaacacctcaccatacagcagatgttcaccgcccgaggcgataaggaacaatgggagaccggctccgaactgtcacagtcggcgcaggaaagcctgaagcggcgcaaggagaagattcacgcgttcctttatggcggtcgctgatggccgccgactacgcattattggagcaagccattgccatcatctcgtccgtccgcggtctgtatatggatccggatgcacttgcggatgatgtgattcttctggcatatgtctggcccgacgaaggcgaattcaagatggcggtggccagagttcaccgaaccctgacacagctcgtggagggcaacgtagaaggaagccctctcaagtacggtttcagcgggtggcgttccttccacttccaacatcgacgaggccaacagtcgcgcgccgacatgcgcatcgtgtatatgcccctcgacacgggaattcgcgtcaaaggattcggaaaccgccaccttccatccgacgacatctaccagcgtttggcgcaactgcagtaaccgtcacgaacaccgtgcggcagcggccagcgcgtgcaggcgctcggcgaagcgcggccagtctgtgcgcatcgcggtcaagagcttgcggtcgggcacttcgtcgatcggcacccattcgatttccatgctctcgtcatcgttcgcccgcggcacgacccggtgaccgggcttctcgaacgcgaagaccgtggtgtacgcccatggcccgtgatcctcacggtaggacccgaccacctcgatgtcttcgggcgtgatgttcgcctcctcgtagctctcgcgcagcgcaccctcgatcgggctttcaccgtcggccgtcgcgccgccgggaatgccccatgtgccgccttccgcgctccacgcggcgcgatgctgcatcaccacgctggtcacttcgccgctcttggggtcacgccgcgcgagcagcacgccggaggcaccgttcaatccccagtgcttgcgcccgcatgcgcagtcgatccagccgtcgccgggctgatgcacgttctccttgggcggcacgactccgccgcctccggtcttgtcttcgggcgccgattccccgcgggccacgttccacaggtcggtccagtccacgccgagcttgccgacgagtcggcgaagcagcggcagactgatgccgatgatgccgtgcgggtcgccgtcgatgccatcgatgaacgcgccgccaaaaccttccagcgtaaacgatcccgcgacttccagcggctcgccggtggcgatgtatcgttcgatgtcgcggtcgctgaactcgccgaaccgcacgacggcatgactcgcgccgcgctcgacgcgcccggacgcgaagtcgatcacgcagtgcccggtccacagctcgccggtggcgccgctcatgcggcgcagtcgctcacgcgccacctcgacgctgtgcggtttgccgtagcattcgccgtcaagcaggaacatcgaatcacagccgacgatcagcgggccgccgctcgcccgagtgagccccggctgcatggcaatcacattggatatcggctcggtgacggtcggcatgtccacgccggagaagtcacgggtcatcgcgatcggcgccttcgaatagtcaagcggagcgccactctggcgaggtatgtccgcgacgttcatctcgccgcgaagctccgcggcctgcaacgggtacgcgatcacgcgctcgcccgtcgcgctcgcggccgcgtcggcgacatcgcggtacgcctgatgcacggcctgcgctttggcctcggccaaaatcatcacgcgctgttcgacgttcagctggtcaacggtgacgccgcgctcggcggcggctttttccagcgcagccggctcatcgacatgggacacgcggatggtcgggcagatgccggccgcatacagcacatcccggcgcggctgggacttcgacgccagaatcatcggaatggacatgatcgtcacctttcttttgccgccgcaccagctgccgcaccacccaaccggcaacttcgcgctcccctcatctccggcccgaggagcgggcgaggaggcacgtgcggtattcctacttacgctcgacctgcacgccgaccgtgtcgatgggcaggtgcagcaccttccaatggccggaagccagctgttccgccgcgacctcatcgatgtccgccacggcgtcgccgtgatgcagcaccagcacgcacgggccggcgccggacaccatggcggcgaaaccacgggaacggaacgcctgaatcaggtcccatgacggctgcatgagccccttgcgatacggctggtgcaggcgatcctgcgtggcagcgtacagcagcgcgttcggctcttcgccggacgcgagcgcgcgcgggttcatcgccgcggccatcagcgccacgcgcgacacgttaaacaccgcgtcgcgataggcgacctcgccgggcagcgcctcgcgcgccttctcggtggacagttcgtagtcgggcacgaacacggccgccgtgacgcccggatcgaccgcgtacttgaccgtgtggaaaccgccgtgcagcgggtctccaccggggatcggcaccgagccgaccccttcggccgtgtcgaagttccatgagacggtcatgccgccgtacaccgccggcgccacgttgtcgggatggccttcgatggcggccgccagctcgaagatggaatcgcggttgagccggccctcctgcgcgaacgcggcagcggcggcgatgcccgccacgatggcttcggcggacgaccccatgccgcgcgcctgcgggatgttgttgtgcgcttcgaggatgaacccgaccttgcccaggccgaaggtctggcatgccttgcggaacgtggagacgaccagatgggtctcgtcgcgcggcagcgtgtcctcgccctcgccatagatcagcacttgcgcggcgcgattggacgggtcacggctgagcgtgaaggtgagttcgtcatgataatcgagggcgaggccgaccgtgtcgaagccggagcccagattggcgcttgtagccggcacgcggaccttgacctgtgtacagattggttccatgattccttgattcagcgattccgcccccgctgacggggaggggagcaaacgatagtgagatcggggtggtttcgcggaaacgccgcgaaaccacccccagtcggctttgccgacagcccccgacagcgggggcaggcaaccgtatgactagtcgagcacgcgcaggatggacggctctccggtgacgaagtccagcgtgcggacggcttcgacagtctcacgcagcgtgacctcgtcggtcagatgcgtgacgatgcgcagctgctggatctcgccgtcataaccaggatcggtcatcgtcggcttgagatcctgattgacgccgttgatcgacacgccgtggtcggcgaactccttggcgatggcggcgagcacgcccggcttgtcgtggatgaggaaccgcacggcgaacgcggcgcggctggcgctgatcggcgccttgggcagctcgtggtacatggggatggacgggccggtgcagccttgagcgatgtggcgggcttcggtgaccacgtcgccgacgacggcggaagcggtcggagcgccgcccgcaccgcggccgtagaacatgaggtcgtcggccgcctcggccttgacgaacacggcgttgaatgagccgtgcacggatgccagcgggtgcgattcgggaatcagcgccgggtagacgcgcgccgacacaccggcctcgccgttctccacgacggcgagcagcttgatgaccttgtgctcggcggcggccgcggcgatgtcgtcggcggtgatcttcgtgatgccctcgacgctcacgtcatcgatcgtcacgttggtgtggaagccgagcgtggccataatcgcggccttgttggccgcatcgtagccttcgatgtcgccggtcggatcggcttcggcgtatcccttggcttgggcgtccttgagcacgtcatcgaactgcaggcccttggtggtcatctcgtcgagaatgtagttggtggtgccgttgacgatgcccagcatgctggtcaccttgtcgcccgccagggattcgcgcaacggcagcaggaacgggatggcgccaccaacggccgcttcgaagtagatgtcgacgcccttggcctcggccgcggtgtagatttccgggccgtacttggcaagcagcgccttgttggcggtgaccacggaggctcccgactcgatcgcggccatcacgaacgtgcgggccactgtggtgccgccgatcagctcgacgacgatgtcggcgttggtggcgaccttcatcgtgtcggtcgtcagcagagacttgtcgatccaggggaagtccacctcatcgggatccaggcaggccacgccgaccagctcgatcggacgcccgatgcgggcagcgagttcgtccttctgctccaccagcagacgtgcggtctgtgatccgacggttcccgctcccaacagtccaacgcggatggggttgtcattcagctgtgccacggatttccttccttcagcggtgtttggcgcgcccggccgccactcaccgatagagggtcgccgggccggcgtcactgtgtaccatcctacggaatgaatccgacacgccgcccgtcaacgccccggaggccggatccagctcccaatggcctcgtttcccttggctttccactatgtagcagcgctaacgacacgccgcagtaaagtagatttacaaattaacgccttaaacagagaaatcgtgaaacaccagcttcccgtaaggctgagcccttatacacccgccatgtttcctgcctatttagcaaataatcttaacgaaacacgggcctcatatcgtaaaagtcacgtaccattgttcattgaagcggcgttgctgacatactcgcgagcgtccgatccaatggtgggatggtacgtgaacgggaattttggcggaagaaagcgccgtccgtatcctcagagggaggttggaatgaaagcatatatccagcgccttggtcgcgctcttatgctgcccgttgcgtgtctgcctgctgcagcactcttcctgggcatcggttattggatcgacccgagcggttggggtggcagtaacgtcgtcgctgcctacctgtgcaagaccggcggcgcgatcctcgacaatctgggcctgctgttcgccgttggtgtcgccatcggcatggctcgcgacaaggacggcgcctcggcactgtccgcactggtcggtttcctgaccgtcaccacgatcatgggctccgcgtccatgttccttggcttcgacgccaccaaggtcgacaccgagcacccggcattcgccgctggcgccatcggcaacaagaacgtgttcttcggcatcctggtcggctgcgtggcaggtgcgctatacaacaagttcggcaagacaaaactgccggacttcctggcgttcttctccggccgccgttgcgtgccgattctgaccgctgcggtcatgtccatcatctcgctgctgttgctgttcatctggccggccgtctacggtgcgctggtctggttcggcgagtccatcatgggcctcggcgccgtcggtgccggcatttacgccttcttcaaccgtctgcttatcccgaccggtctgcaccacgcactgaacaacgtgttctggttcaaccttgccaacatcaatgacatcggcaagttctggggcagcgccgacccggccagtggcgcggtcatcgccaccggcggcttccacccgttcggcgtgtacgtcaccggcatctaccaggccggcttcttcccgatcatgatgttcggcctgccggccggtgcactcgcgatctacaagaacgccaagcccgagaacaagaaggccaccggatccctgatgctcgccggtgcgctcgccgcgttcctcaccggtgtcaccgagccgctggagttctccttcatgttcgccgccttcccgctgtacgtggtgcacgcgctgctcaccgccatctcggtgttcatcgccgcttcgttccagtggatcgcaggcttcaacttctccgcaggcttcatcgactggttcctgtcgctgaaggttcccgcagctcatatgccgtggatgcttatcgttcagggcctcgtcttcgcggtcatctactacttcgtgttcgacttcatgatcaagaagttcaacatgaagaccccgggccgtggcgatgacgataacgacgatgcctcctccgcagcgttcgacaccgcgacctcgtccaccggtgacaagtacgccgacctcgccggcaagctgtacgccgctctgggcggtcacgacaacatcaccgaaatcgagaactgcatcacccgtctgcgcatgggtgtcgtggattcctcgaaggtcgacgtcgacgccatccgcaagaccggcgtccccggtgtcaaggtgatcgacaagaagaacgtccagatcatcgtcggcacgcaggtgcaggccgtggctgacgctctgtccgccctgtacggcaagcccgtcatcggtggtggttccccaaaagcgtgacggcagcccccgctgccgctgcccccgcccccaaggtgaaagccgctgacaacgcggtgctcgcccctgtggacggtgccatcaagccgatcacggaagtgcccgacgagaccttcgccgccaagatccttggcgacggattcgccgtggttcccacgtcgggtcgtgtggtcgccccggtggccggcaagattaccacggtcgcccaggccaagcatgcagtgggcatcaccactcccgccggagtggaagtgctcgtgcacatcggcgtggatactgtacagctcgccggatccccgttcacgatgatggtcagcgaaggccagcaggtgaacgccggagacgcgctggtcgacgtggactggaatgtggtcaagtccgctggaaagcccaccgacgtgatcgtcgtgttcaccaacccggccaagatcgataagctgtcgatcaccgccaagggtgcggtggctaccggcgctccgattggcaccatcgtcaccaagtgattcggtagacacaaccgcaacaaacaataaggagtcctccctgatagccggggaggactcctttttttgagttctactgcttttgcttttatatcttgccgctggcgctgaacggtcagccctgatccagatccagcaggtcgtcaatggtctggcgacggatcatcacatgtgcgccggcttcactcacggcgaccacagcaggaatcagcgcctgattgtagttgctcgccatcgtgcggccgtatgcgcccgtcaccggcacggcgaggatgtcgccgcgcctgaggtcggccggaagcctgtcctcgtgcacgatgatgtcgccggactcgcaatgcatgccgactacgcgcaccagcatcgactcgtccgacccgcgacggttggccagccggaccgtgtagtcggcgccgtacagcgctggacgaatattgtcgctcatgccgccgtccaccgacacgtacacgcgctcatcgatgggattgccggtcttgtccttggcatcggacagatgcaccggcttgatcgtgcccacacgatacagggtcacgccggccggggcgacgatccatcgtcctggctcgaagctgatggccggcgcgggcacaccgagcgcacggttgatggcaccgaccgcttcggcgagacgacgcagctcgacgcgcacgtccatcgaatcctcgccgtcggtgtatgccacggagtatccgccgcccaagtcgacctcgggcagcgtataggcgtcggtggcgtagaaggtcttgcgcagcagcatcatgcgcttggcggcctggatgaaggcgtctgcgtcatggatgttggaaccgatatgagagtgaatgccgacgagttccaactcgtcggaccgtgtgaggatgtccttgagcacggccagtgccggcccatccgccacggtttccatcgcggcggcgagcgccttgtccttttcggggatctcctcgtggctcaggtcatacgggtacttcatgtcgtagtgcagttcgcgctcgggcttcgcgttcccgtcaccggcatcaccatcgcgttcggcgatgtgcgcgttcgtaacagccggcgtcacgcctgctggatcagccgtgagttcgtccagtacgctgagtgccgcggcatcggcgccggccggcagcagcggcacgccgaacttctgatcctcatgcgcggtggagatgtattcgtggccaccggcgtgaatgccggcggtcacgcgcagcatcacgcgggcacgcttgccgagtcgtcgcgcgatggcggcgatgcgggccggctcacccggctcgtccacgacgattttcgcaaagccctgctcgatggcgagttcgatttccgcgtcggacttgttgttgccgtgcagcaccagacgacggccggggacgcctgcggcgagcgcgatgcgcatctcccccatcgagcatgtgtcgacgagcatgcctgcatcggtcaccaaccgcacgacttctttggagaggaacgccttaccggcgaaactcacgtgcgtggtggagttggtgaaggcgtcggccgccgcgcgcacgaaatatctggcgcgggcggaaacttcgtcagtgtcgatcagatacagcggggatccgaactcgtcaagcagcgactcggcggtgcgcccgtggaatgtcagggcgccttcggcattcactgccgtcgccaccggccagatgggggtgataccttgcgttccgtccacacgcacagcagatccagtcattgctcctctttcgctcagggcttgccgcttttcctattactgtgccattgtgccagaaccggcaccgtgataccacttcccgaccataaggcggaggctcggtcggagagtacctgaatgagaaccgcccccagtcgcgctacgcgcgaccaggggcagcctaggtcacatcttgtcgggggcggtgacgccgagcaggtcgagaccggaggcgatgaccgtgcgcacggcgtcgttgagcttgaggcgtgcggcggcacgtgccggttcggggttcttggcgatgcgcagtgcctcgcgagcggcgtcatccagacgctcctcggggtcggtcagcgccatcggaaccacgcgctcgacgttgtaccacttgtggtaggcaccggccaggtcctccagatagtgcgccaccttgtgcggggcacgctggtcgccggccagagccaaagtcgccggccactgggcgagcgcggcgagcacctcgccgtccgcctcggtgtcaagcaggctcaggtcagcgccttcggtaccaatgcccgcagcggccgcgttgcggtccacattgcaggaacgcgcgtgcgcatactgcacgtagtacaccgggttctcattggaatgcgaagtcagcagatccagatcgatatccaccgacgtgttgtagtcggtacgggccagcgagtaacgggccgcatccacgccaacggcctcaaccagatcgtcgatggtgacgacgttgccagcgcgcttagacatgcgcacgggcttgccgttcttcatcacattgaccagctggccgatgagaatctgcatgttcacgcccggctcgtcgccgaaggcggcgcacatggccatcatacgaccgatatagccatgatggtcggcgccgagcatgtaaatcgccacgtcggccggatccacagcgcggtgacgcttgttccagtagtaggcgatgtcggcagcgaagtaggcgaagtcaccgttcgacttgatgatgacgcggtccttgtcatcgccatgcttggtggattcaaaccaggtggctccatccttctcgaagatgtcgccgcgactgcgcagctcctcaatcgcgcggtcgacttctccgtccttgtataggttgttctcgtggaaccacacgtcgaagcggactcggaattccttcatcgagcgctgaatctcgtcgaacatcatcggcacggcacgcttgcggaactcctcgcgctgctcggaatcgccctcgccgagcgggttgccgtccttgtcgaggccgccgtcgacgcgcggcaggctcagcacatccacgccatcggcctccgcctcggcgatcacgcggtccgcgatctcgttgatgtacttgcccttgtatccgtcaatgggcgtctcctcgccgtgcgcggctgcgaccagggactttgcgaaacggttgatctgctcgccgtgatcgttgaagtagtattcgcgcacaaccttggcgccgttggcctctagcacgcgggccatcgagtcgccgacggcggcccaacgggtgccgccgatgtgaatcgggccggtcgggttggcggagacgaactccaggttgagcgtcttgccgccgaggtgcgcgttcttgccgtagcctgcgccatcggccagcaccttgtcgaccaccgcggcggcggaggcggaatccagcgtgatgttgatgaagccgggccccgccacctcgacggtcgagatgccgtcggcggcggtcagccgctcggcgaacagctcggccaaatcgcgcggcttcatgccggccttcttggccagctgcatggcggcgttggaggcccaatcgccgtgcgcgcgatccttcgggcgcatcacggcgaatttggcggtttcgggaatcaaatcgtcggtcagggtaccggcttttccggcggcgaccagatcgtgggcaatggtttcaatcagttcactaagcgcttcaggactcattctccctagtgtaccgggcactttgacagcgaacgtccggttcatgcaccgacgcgggatcggtcggcgtcacgcctgggagcgatcgtcatcgtccggcgacgagaacggttcgggaagcccgtgatatgacgaacaagcctgctgcaacggcgtgatgttctcgccgagcagtccgctgacgccgtggcgcagcaagccgttcgcggcatcgtatgaatccaccgagtcgacatatacgggaattctgcgcagccgcgcattccgcagcagtcttgatgtgacgtcccgcgcgcggaacacgacgaagtccatggcctcgccgcgcattccacggaacatgggatgctttcgctgctttccgccgcgcttcgccgtcacttcgcggcgcacggtctcgacccgcgcggccccgtccatgaaccgcgcttcgctcgtgccgtcatcatcccattgcgtcagatcgggcctgccgctggcgcacaggcctacatgccactgcggacgcatgctcttgaagaccatcaccgcatacgggttggccgacatcaccatcagattgccggcgtatttggaatcctcgaccacacgcaccacggcatcggccactttccgggcataccgcgcgtccgtcttgatgtccagcagcaagccgaaccgccgctgccccggacgtgacatggaagcgtcgtccaacgcctgacgcagcgtgagaaccgaataccgcatgccgcgttgctgcatgatcatgcgctgcaatgcggacaacggcatactgttcaccagcacgttgcgaccgcccgcgtccagacgcccggttctgcggtcatggaacaccacgggtatgccgtctttggtcagccgcacgtcgatttcggcgaaatcggcgccgttctgctttgcggcgcgaatggaagccagcgagttctcgggagcatgccgggtgtcgccacgatgcgcgatgacgatcgggcgatgctgtggcgacgccagtgcgatcgcatcgaacacccagccgaccacatgcgtcgtgcccatcaccaatccggcaagcatggcgatacatgccagtacggaaaccaccgccacaacggatccggacagccgtcctcgtccttcgcgcccgtgcatctcacaccccgcttccatatttcgccgcgcgacatagtcgcgccaacgccattggtgcaggtcatcataggccgcgcagctgtgttcggggcattcgagggtaagaatcagggtgatccgcgtcactccttcaccaccgcatcacatatgcggtggattggccggagatgatttgggagacacgtttggtaactctatatagcgtgtcacgtgtgaaccacctcagtcgctttgcgacagccccgccagcgggagcgttggtcgtactcccgctgacagggggctgtcgagcggagcgagattggggggcgctcccaaagcgtccgtaagtgcgcgccgaaacgacaagtgcgcgaacatatggacgcaaaaggcccgatttgcgtccgtaagtgcgcacggtcgtcgtttcggcgcgcacttacggacgcaaatcaccttcatatacgccacatccgacggaaccatcagcattggcgcaacatggttatgcaatacgactcacagcagtgagcctccatcatgcatctggtggaggctcactgctacggctttggttgaaggcgggttactgttcggattccccgcgaaccgtcacagaactgcgatggcgtcgatctcgacgagggcgcccttggggatgtcgttgccgccgatggcaacgcgggcgggcttgacggagccgatgaacacgtcggcgtaccgggcatcgacttccttgaagtcttcgacgttcttcatgtagatcgtcgcgcgcacgacgtgctcgatgccggtgccggccgtgtcgagaatctgcttgatgttcttcagcgcctgggcggtctgctcaccggcggtgtctccggccagttcgccggtcgtggggtcgatgcccagctggccggacacgaacacgaacccgttggcctttaccgcctggctgtacgcgcccagcgccacaggcgcctccgacgtggcgaccgcttccatcttctcgctcatgactcctcattccccgcgggtatccgcgattattgtctgcgttgcgacgcgcttgtgcacgcttaccgtgtaataaatatacctatgccacccatccggtgatgcgtacatgtacgcacaatggacaggcggcatgaaaaatcggggtcatcgtcgaaggagtaggcgacgatgaccccgatattcactcgttcacgccgatccggagcgatgatgcgaccggatcagatggtgcgccaggcgataccgctgggcgccagttcgatgcgctcgatgcgaccgtcgccgcgctccacatacgtggactgcgcgcgatccgtgttgttgacaacgcagtagcaacccgacttgtcgaacaccgcgacctcgcactcggggttcgacgagctgtatgccgcatacttgccctcgttgtgggaggcccagaacagggcacgctccagcagacgggcgttcgcggccgagtagggcagaccggagacgtatacgccgcggcccttgccgtactcgttgaccgcgagctgcacctgaccgccgtcggcgcgcagcagcgtcacgtcctcgttgaccgggaacgtgtccgcgatcggctcgccgaagtcgatgccgccaagctcgccgatcgcctgaccgccgccgcagcccgacaggggcttgcggtatccggcgtcgaggaagccctgcagcacaccttcgcccaggtgcacgtcggcggtgatgaagtgctccggcgtgacggccgggaagtacttgtccaccgacagcgtctggtgacgctcctcgtccacacccagcacatcggccagctggaagaaacgaccctggaactgctgggcactcggctggcccacgccaatcagggcgccgccgccgtgcacccaggcacgcagcgtcgccgcaaggcgcggctcctcggcccacaccgagccaccggagaacgcggtgtcgaccgggccaccggtcacgatcacgtcgatgtcgtcggcgacgccatgctccagcacgtcatcgaagctgatgaaccgcacgttcacgcgcatgcccgacagcgactccagaatgccgtaatacgaatacgtctgcttgttcggcagcgcgtgggcgaccgtgtaggccatccacgaacgcatcttgccccagcagttcaggatcgccacgttgagcacgccgcgggccgcctcgccgtcggtgcggtcgtggatgtcgcggaactcatccgagatgtgctccaccgcgtccacgaacttcgggaacttcgcggccagcgacaggtatccgccgtagcccatgcgggcgatcggggaacgcaggatggcacgacgggccttgcgccagttgtcgagaccttcgatgctcgggtcgttgccctcgtagaacgtgtcggggaagaagtacggcaggaaacgaccctccgtgtacttcacgcccgggatgtccgcgatcatgcgggtcgtagtgccgtcaccgatcgaaccgacgacagcatccagacccagatcctcgaaaccatccttgtacggctcggtaccgatccactggtcacccaggaacatcatcgcttccttgccggcctcgtgcgacagcgatgcgagtttcttcacgttcgcgcgtacgaaatggctcaggaagtcgatccagtcgcgctgcggcttgcgcggcacgcgccatgcggagttgtacgagccctcgttgacgaagtcctcgggacgcaggcggtagccgtactccttctcgaagtcgtcgagcgcggccgggctcacggtcttcacccagccccccgcgtcgttcggtttcacggccctccggtttttcggtatgtcggtatccaccgattccggtcttccggtatccatcctcacgcgtctaagtgttgtcgttatggatgttgcaacgcttagacgcgtgaggtccgttccgtttgatgccggtcttcaccggtttcggtttttcaatatttcggtttttcggttttgcgggtatgcctatccggcctggttccgttcccttccgtcgtcttcgagctcctccagtcttctccggagtccggcgacggtctgccgcagctggtcgatttcctcctccttccgggctatctgcgccttgatgccggccggctccccggcggggaggtattcgagcgccagacgttcggcgacgtcgcgacgatgttcatgatccagggccgaacgccgcgccatgaaacgggccgccgcgcagatctacgacagggacgatgtacatgccggtatcggaagaggtggctacggcccttgacgcggaccggaacgaacggcatgacgcctgacacgacatgcgtgaggagcggaatcaggcgcggctctgtctaagggctgtcggttttgctagaattcaaggagaaagggaggcacgatgttcggaacgatatctgaatccgagatgcgccgccgcacggagaacgtcgggctgtcggtgcagtccgtgcggttggaaggcggcgacgtgacgagggccttcatgcgcgatgccggagaatatgcgcggggaacaatcgatggcaccgaacttcttgcccgcacccgtcgccgttacggactggagtgatgatggcgcgtgtcttcgatccctacctgattccgggaacgaacgtgctgcggaaccttgtgggcgccacggacgaggatgcgttggcggctgcggagaacgatctctgctccgcccgcgccgccattctgagagagaacctccctcctgcggaagggacgctggaacagcttcgccgcatacaccggttcctcttccgggacgtgtacgactgggcgggggaggtgcgaaccatcgacatgggcaagggcgaggggcttcccttccagccattggagctgttcagcataggggttcgctactccgaggaggtgcttcgcgccgacgatcttctcaaaggtctcggccatgacgaattcgtaaagcgtctgagcgtcagctacaacaacttcaacatccttcacccgttccgtgagggcaacggacggacgcagcgcattttctgggagatcatcgcgcgcgaggccggctggcatttcgactggggactcatcgacaaaaggacgaacgatcaagcctcgatcgcggggatgcagcgaaacgacctgcgtcctctcgaggatatgttcagaagaatcgtcaagccgttgtcagaaccgttgaccatgtcgaatgacctggcccatcttggtgaatatgcgcaaccggcgaacacggcatacgacatgtctctcgcgcagcgccgtcacgtgtacgagcattactcctaccaacgcaccgtcgtctccccggggcaaggaaagcctgaacgcgggcacaaggcaagatgactttcggatgcgtcgggccaggatccattaccttggtatctggttttcggtatcttgttctttcagcattccggtatttcgttttttcggtatctcggtaaaccggtgtcccggtatttaccggttccggtttcttggtatgtgtcgtcagttcttttcctgtaggatcttcctgagtctgtccacttcgctgcggagcttgtcgatctggcgttccttctgatcgatgaccgtgcggatcacggtcggatagttcgagggcatgtaccggtaagcgaggagttccacggtgtcgcggtggtgttccctgactatgcgctggtagctgtccaccgcgacggtgaggctggtgtgtccgaggtcgtccatcgtctcgcgcatggtcccgccctcgaggacgagcatggtggcgtgcgtggtgcgcaacgagtggaaggtgatgtcgggtcgtccgatcttttcacgggccatgcggaatgttcgttcgatggtcgtgggcgggagcagccagtcgtccagcatggtcgagtggaacagcatggtgtcgggtttgcggtccttgcagaaccggctgatatggtcctcgatgagtggggcgagcggtttcgggatgggtacgacccttttgctgcttttggtcttgggctcgcacaaccggtatttgcccctgtcgtcggggccgcggttgacggagtgtcggacgtggagttgcaggttctccaggtcgatgtccctgagttgcagtgcgcatacctcgccgatgcgcagtccgcctaccaggagggagagccagagcgcgagccgttggtagtcggggaagagcgtggccagcctgttgatctcgtcggcggtgaccggcggctggtcacgtcgtttggattgcggtttgatgacgcggtaccggcacgggctcgcggggatgagcggcggggtgccgtccgcctgctcggtcgcggcggcgagcatgacccgtttgagcgttcgcgccgcctgctcgaacgtccatgccgtcagctcgtccctggcgttcacgtaccattcgtcgaccatctggcgggtgatgcggtcgagcggtgtgtcgccgaacgcctcgttgagccggcgtagcacgatctcgttgcaccggttggaccggccggatagcttgctgccgtccggtttgcggtatccgtcgaaatagtctttggagtattccctgaatgtgggcattgtgcccgcgcctcgctgcgatgggtgaacccattggcggatgcctttgttgtggagcgtgacgaggtagcgctcctcgtcgagccacttataggcctccgtctcgtattccagaccgaagttccggccgaccttcttgggcggatcgagcgggttgacgtatcgcgcctggaaactggtcgggttgccgtccgtgtccctgcggacgatcaccgatccccatttcctgcgttttctcgatggtggcctgttctccgtgtccttcattgactttccccttttaggaaattgtttgggttgactgcgactcggcggttgatgcctagcttcgcggcctcttcatatagctctttgctatcaatcatgccaagtgcaacgtagctgatgtcattatcgccagccccatcccggattcacttgtaagtgcaacggctggtttcgggtcggcttgttttgattgtagcttggccatctcctcgtcccatacctcgttgggcgttttgtagccgaggagcttcatgggggtgtcgttgatctccccgacgatcgcgtcgagctcgtcctgcgtgagatcctcgaaactggttcccttgggcaggtagcggcggatcctgccgttcctgttctcgttgctgccacgctgccaggaactgtacgggtcggcgaagtacgtgagcatgcccagcgcctcgtccaccagcatgtgcaggctcgcctccgtgccgttgtcccacgtgcggtcgacgcgcgcggccggcggcatgtccttgaagatctcgtattcggccctggccgtggcggacgcgctcttgtcgtcgacgagccgggcgaacagcctgcggctcctgcgctccacctgcgtgttcatgcagcgcctcgacggcgcggcgccgaccaccgtgtccgactcgaaatggccgaaccccttcctggatccgaccgcctcgggccggtccgcgatgggcacgcgcatcgggatgcgcggccccttcgccttcctgccctttttcctcgtccggcgtttcctgccgcgcgccaggtactggcgcaggtccagcgcccgctgcggcttggcgtagatccactggtagaggcactcgtggctgatccgcatcgacgggtcgccggcgtactgggccttcaaccgtccctcgatcagttccgggctccaccccctgcgcagcgcgtcaagcacccaggcgcgcaacgggcccgaatccatgcgacgcggtttcctggactcgcgccgacgccggtcggcctttctctgcgcggccagcgccgaatagaacggacccgaggtccacggcccggtcttcagccgtttcggccggtagggccggtacgacccgttctcgttggacgcgaaccacaggccgcgcctcagctcgcggctcacggtggacttgtcccggccgatcctctccgcggtccgacggatgctcagatgccgctcgcaatgcagcttctcgatcaggatcctctcctcggacgacaggtgcgaatactgttgacccatgagtgcaacaccttcttaagttagaaacttcgaacacttccaaccctagacaaggtgttgcacttctatttagaacccgggcatagtattcgggcgaatgaatatgataagttgtatgaacaaattacgtgatataggtaaatacaggcttattaccaacggggattttgatctctgtgaggctgatgtgtttctattagactcattggttttgattgatattaggaatttttattttgatgggctgaatccgaattcggcgtcggggctccatcagcttcttgtaactatgtcgcccaataagcaagtgcgtccagacgttgtatttggttttgctttagcagagacttgttttcggcaagaggggttcgaccgtttacgttgtcggcgtatctaccgtgcggtacaaacagttgtgaattggaatcaggagaagattgataaggctttcgatagcagacatccccctgttaagcgggataaacagtgggagaaaggaaaagtctcaattccttcgccatcaatgttggggatggacgatggagatcctcgttcgttcattatgcctgcatatggcgctttacttcatttgcttaaactggtgcaaggagccaatagacataatggtgtcgaaaagtttcaggagcattgcgaatgggtccgtgaggagcttggatgtgtttctgcatacgcaagagtgatagcggctgctcttctcctaggagatgaagcaagcaaggggaaagcacgctcacttcttaaagtcgatcataagaggaaaagtctaggacaaaaagcatggaatgccgcatgggatgcatggtttattcaggctcttgatggatatcgacttggtatgttagtccctccagctagactcgagcatcagagcaattatgttggagcgaacgcagttttagtgacggcaaaagaccaagtatggctggattccattacagatttctctgttgctttcagtccctccgcccagaaggaaatcagttaccccctaatttgttcaacagttacaatgcgtaatcaggaagcggaaaaatgtctcgaggaggaacttcggcgtgataagcttagttttcctgagcatattcgtaatggtgatttgataggcaaaatgagcagggcgattaacaatctagagaatgagctgaacttgcctgttcgctcttttgatgtcgattagtctgtgtgtccttgaccttcgtataggtgactgttttggttttgacggtatgtccagttatggctgaccgtcggggtgggaatcagtcgagattatgcttgggtgcctgtaggtgcctcgtggaagacgagggtaatcggcaggtttcccaaaaattgaaagccttggaacaaagccaaaaacagctgaccacgattatcatcggaggcacgcatgatgatggtagtcatgactttaagtgtctcatgggcttgagaccgggcattgctgtttgattgcggggaatggcgcagcgggcccgtggactggccacggccggtagccgggccgccgagctgcaacgcggaacgtcatacgaattggttcactatgatcagcgcaccggcagcgacagccatgagtggctcctgctctgtattttgatgctcctatacattgtcaagcgtttggacccgttgtttgagttcgggcaggttccatgctccgcgttcgacttcgttgatgcggcttgacggcacggtcggcgcctcgccgacctgctgttgaagaaggagcttgtgtaactggaaccgctacaccacgatcgagcgactgaggcgcgacctcaacgactacgtgtggtaattcgacgaccagcggctccgttccatcctcggataccgggcccgaaggaattcatcgaacgaggatcgtcctctaaggacctatccaacacgctgtcgccaatccgattggcgtcatggagttataatttttctgtgatttaggtatgtaatgtagccctaatcataagttgtgaacgtcttactcgcgtatgttcgtagacactgaaagtcaacggacatacttatcccagttcctacgtgaaccaactcccggggagatcaacatgactcgattccgcaatacatacacaaccctcacaaccttcgtgtcggccgctgttctccttatctcgaccactgtgccggcatccgcatcgcccatggcaagtgatccattgtcttcgtccaccacaacagccgtgcgtgcacaggtaacagcccttggtgcaaatcgtacctacacttacgttccgaccaataacacaagcgtcggcgaccccatcgtcacagcctactggactccagaacgcatgaagagtgccattcccgctgatacaccaacaagcacgaccgaggtaaaccgacagattgacgagctcgaacaaccggctctggcagacgaaccagttactgacggatcgtcccccgtgacggcaatcttgaatgcaatcacgccacaggctgtgacgccagtcacgaatttctcaaagaccaacggaaaagttttcttccgcaatcagaccgacggcaaggattacgtatgctctggagcctccgtcaatagccgttccaaacgtctggtcgttactgctggccactgtgtccatggcggcccaggaaaagattggcataccaattggatattcgcaccgggttacagcaacggtgccacgtatggcacttaccaagctgccacgctccgaacgctcaatgactggatcaactatggtgaatccgggcgaggattcaattcagacgttgcctttgttaccacctatagtggcagcacttccggggatactgttgtaaacgcggttggtggtcacgggtttaggtggggcagaggtactggtttcgacgtcagtattttcggctatccaacgaacctcagcggaggccaaagcatgtgggcctgctggggctctagtcaaactggttggaatggcctttacaagttcaaccatattactggttgcgatttcggcggtggttcgtccggtggaccttggctcgacgaatacagcaataccactggtctcggatatgtacgcagcgtaacctcgaacggccccgcagacaattcctatcttcgaggcccatacttcgacagccgcgtcaacgacttgttcgttgcagcaaacaaggactggtgaaacaacatcatggccagttggattcgcttccgcagccgttttgttgctgcgcttctggtatttgctttgaccagtatcacggtaatgggatgcgcaactaacgggagcgaatccagccccagctcaccaggtacagatgcaggatacgattccgcggcagaggcaccggagcaatcctccaacgacgtacagcaacgaaccgacctcagcaacgaacatatatcctcatggaaccgatacgaagtggtctcggacacctccgtgcgcattttcttctccatgggaaatcccaaatgtcatggtgtacgggccaccgtcgacgaagactcctccgcagtgctaatcaccctctacgaaggaacactccccaacgcgccaaccgaatgcgccgcgatcgcagtcaatgcatcccttctgcttaccacacgcaatcccattggaatccgttccgtcattactggataaaaatagtccagacctttggaactaaacacataattccaccggtgtcgccatgcacatgcttgagaccggtaaactagcgcagtccaaacaaccacgtagatcgttcgggcattaatcgaaatcaaacaacggtatgtcgccgccgaaccgtccgtgatcctcgcggtttctttcatcgaaccggcacgccggacaccatccacgaacggtcacgtcgagcagatggttctgcgtgacggagacattgaaggcctcgtgcccggcgtgcctgttgtccgacacggagacgtactgctgggcgaatgcttttgggcatcgcccatgctgaacatcatgaaatcacaaggcggatcgttctttttccgtgccggtcggcgaagacgttgagcgccggcaggacggtggaatgtcaccggattgttctcgcgtgcctgtagatgcctcggcgaaaacgaggctgatcggcaggcctcccaaaaaacgaaaaccttggaacaaagcaaaaaacgaccacacgcgattatcatcagaggcacgcatgatgatcgtactcatagcggtcaagtcctgcagaacgccccgacgcggccggccgcatcgccgcgcccgtaagcggggcacgtcaccgtcagcgcgcgtacaccgtgggagagccgctcagacgcgacatcgccgactgggggatgtcatggacacgccccaggacggcgtccaacgtcgacgagacggcatgcggcgcccggcgatcgctgcaatccgtccaggagggtcgttccatcggggacgtcatggccgtccgaccatccgcgccggcctccatgtcatactcccggcgaccgtatcgccagagagtcgcattgctgttgcgaaccacccgcgccaaagccgggcgacgtctacgctgaaggaagaacatgcctgcctcgatcccgtatgggcgccgtccctctgatgtccggcgccggtcgatattcatcgtgccaccatcggcgatcccgccaatcgatgacactatcgattacacaccggatcgtgccgtcatgccctcgtccgaaagggtgattttccgcacgcccgtcatccccggggccgtccggccttgcaaaggtcacgcggaaccggcagcgcgacgggcggaagacttggacgatcgctggaacgaatccggctactgcatcttgcgcaggcgtggcacggcggaatccttcgcgccggtgacgcggtacacgtcgaacacaccgtcgatcttgcgcacggcagcgagcagacggttcagatgctgcgggtcggccatctcgaagctgaactggctgatcgccacgcgatcggagccggtcgcctgggagccggacaggatgttcacgccgtggtcggccagcacgcgggtcacatcggacagcagatgctggcgatccagcgcctcgacctgaatcctgaccatgaacaggcccttggtgctggtccatgccacatccacgacgcgctcgggctgacggcgctgcaggtcgatcatgttctgacagtcggcgcggtgcaccgacacgccctgattgcgcgtgatgaagccgacgatcctgtcgccgggaaccggcatgcagcagcgcgccagcttgacccacacatcgtctacgcccttgacggacacgccgagggagccggtcttcttcttggcgttctcgaccgcgcgcagcggcagcgcctcctgctcaacctcctcatcaacctcgtcgctgcccgcgtccttgaccagatgcgcgatgacgttctgcgtggagatctgcccgtcgccgatcgccgcgaacacggcgtcggggttggggaaattcagctcgtcggcgacgccgaccagcgcctgggtggtcagcagcgtgccgatcggcaggttacgcttgcgcatcgcgcgggtcagctcgtcgcggccctcctcgatggcctcggtgcggcgctccttggagaaccactggcggatcttgttgcgggccttggggctcttgacgaagctcagccagtcgcgggaggggccggcgttgtcggatttcgaggtcagcacctcgacggtgtcgccgttctcaagcttggtgtcgagcggcaccagacggccgttgacgcgcgcgcccatcgtcctgtgcccgacttcggtgtgcacggcgtaggcgaagtccaccggcgtggcattggccggcagcgagacgatcttgcccttcggggtgaacacgtagacctcggccgcgcccagatcctccttgagcgagccaaggaactcgttcgagtccggggtctcgctggtccaatcggcgagctgctggatccatttgaggttgtcggtctcgctcagctcctggttgccgtcggaaccgcgcttgagatcggatttgtcgggcgcgctcagggcgcggcccgcctgcccgttctccttgtacttccagtgcgcggcgatgccgaattccgcgcgccggtgcatgtcccaggtgcggatctggatctcgaccggcttgccgcccggccccacgaccgtcgtgtgcaacgactggtacatgttgagcttgggcatggcgatgtaatccttgaagcgcccgggcacggggctccaacgcgcgtgcacggcgccgagcgccgcatagcagtcgcgaatcgtgtcgacgatgatgcgcacgccgaccagatcgtagatgttggcgaaatcatggccccgcacgatcatcttctgatagatcgagaagtagtccttcgggcggccggtcacgtacgccttgatgtgctgcgcgtcaagatcctcgttgatctcggcgaggatctgcgcgagatacacgtcgcgctggccggcacgccgcgcgaccagcaccacgatctcgttgtagatcttcgggtacagcaccttgaagctcagttcctcaagctcggtcttgatggcgttcataccgagcctgttggcgagcggcgcgtacacgtcaagggtttcgcgcgccttcttctgggcgctggacgacttgacgtaccgccatgtgcgggcattgtggacacggtcggacaacttgacgacgagcacgcgcacgtcgcggctcatcgcgacgaccatcttgcggatggtctcggcctgagcggaatcgccgtattccatcttggagagcttggtgacaccgtccaccagaccggtcaccgtgtcgccgaattccgcgcggcactcgtccagcgtgtagtcggtgtcctcgacggtgtcgtgcagcagaccggcggcgaccaccagcggccccatgcccaggtcggcgagaatctgcgccaccgcaagcgggtggatgatgtacggctcgccggatttgcggcgctgtgaggaatgctggatgaccgcccgacgataggcacgctccagaatgctcagatcctcgtcggggtgatggttcctgcacgcttgcatgatcggcagcagcgggttcagcgggtcgtcgctgatctcgcagccgagcatgcgggcggcattatgctcggcttcatcgttggccatgtctgcctccctctcaggtatttggtatcacatcctacccgccgcgaatgaaaaagcatacgcggcatcttccgccgtgaacggtctcccgcatgccttggcttgcgggccgtgacggccgtgttcgcaccgtcggccaggatcgtccgtcaggatgacacgccggtggagccgaaaccgcggtccgcacggtcggaacccggcagggtgctcgccgggacgaacctcgcctcgacgtaacgctggatgaccagctgcgcgatgcggtctccgcgatggaactccatcgtatgctccggatcgaggttgatcagagggaccttcacttcgccgcggtacccggcgtcgatggtgccgggcgcgttcagcacggtcacgccgtacttgacggcgagtccggacctcggatgcaccagcgccacgtatccggcgggcagggcgatcgccatgccggtcggcaccagggcgcgctggaacggcttgagcgtcacgtcctcggcggcgaccagatcggcgcccgcgtccccggcgtgggcgtaccgcagctcgaccggatggccgggatcaagcgatttgaccaggacctcggtgtattcgggctcgtcatatgtctcgtcgaacgccatcaggccgcgcattcctcgcacaccggctggccgtcgtcggtgacgtatgccagctggctgcgatgtttgaccaggaagcactccgagcagatgaactcgtcgttctgcatggggatgacggtcacggaggcgtcctcgttgctcagatcggcaccgggcagttcgtaatcctcggcgatggcgttctcgtcgtcgtccatatcggttgaagagctgcgcgagcccttgcccaactcctgcagcgattcctcatcctcgtccttattgcggggggaatcataatcctgagccatctgaatcctttcatcatggtggcacgttctgcgccatagaatacatgacttttactcggcataggatacacgatttgaaatactcgtaaaatacgacacgtggggcacaatagaagaagttgtaattttctgaggaaagtggtgtgaacatgcctgagaacccgctcacacaagcccggttcgaccacgtcgacgacacgggtcgtctcgtgttcgcgtcaggcgacgagcgtttcttcgtcgatgtggacgaaacgctggaacgcgccattctggaagcgaaacagatccgcgaggagtcccggtcggctcccagcgcatccagctcggctacgctaccgatctcgcagattcaggcgcttatccgggccggcgcggatcccgcgcgggtggcggaacgataccgtctcagcgaggcgctggtgcggcgtttctcgtccgccgtcgaggtcgagaagcagtacgccatcgagcagttcctcaccgtgccggcccccaaggagagccgtgggcggaccaccgccgacgtggtggagcgcgcgctggcgctgtccggcatcggcatggaatcggtgacgtggaaggcgacacgccggggactcgaaccgtggaagatcaccgcgacgttcgacgccgcggggcgcaccgccagggcggaatggtcctggaacatgcacgacaacgcggtggcatgcctgaactccacggcgaagaagctgctgggaacggcgacgggcgcgcgcggcgacgggaccgagggcacgccctccgagatgctgcctgcgacgctgcccggggattcggtacgctcggcgaggatagagcgcaccgtgtcggcgtggaacacccctgccccgacactgcctgcggctcgccccgaagcgcggatgccacgttcggcgtccccgttggacgtgcgcaccgagcctgcgccatccgaggaaggcccctcaatcgacatcccgcgcaccggcgcgcttccggcgaaggccggcgaggccgcgctcggcgccgccgagtcgaaaccgccgcggccgacaccggattcgggcacgtccgcttccgcggctcagacggcgcccgagatcgaatccgaatccggcaagacgtctgccgaacgctccgaccggcagacgccgcctgcgaaacgccgttcgggtcgctccgccgtgcccagctgggacgagattctcttcggcgagtaggatcgtctggcccgccgtcgctgtccagcgagacacgtcaatccttttttacggaaaaacgcgacaggccgtccggataatgagacatcggcgtgacacgttcggcatcgaaacggtcacgccacgtcaatcaggcagggaatgtccatttccagcgccgtctgcgagccatgcacacccggcagacgcgtcgccttgtcggtctggatgcgcgaatccacgaaggtcgccctcccggccgccgataccagcacgtcaccgagcatcggcctgacacgcggctcgacgacaccgaacatgccctgatcgatcgcctcatcccgggtacgcaccagggcggcgtcacccagccgatcgcgccatcgacgcgcgatgtcattcgggtcgcaatccggctcggcatacagcatcagagacctgggctccccgccgaccagggccacgccccgggcgagctcgggattctcggcgatatcgacgcgctggtccggatccgaaccgaccatgccatgatcagccacgatgacgatgagcgtgcccctcggcgcaagcctgtgcaattgcgccagctgttcgtcaacccgctcgaacacggccgtccactgctcggactcccagccgtaggcgtgccccaccttgtcggcgtcgcggatgtacaggtacgtcagccccggcgtcttcgaggcctcgcacgcggccctcacgcggccgagcggccgcatatcgcccttgtagtccgcaccgcgcaacgcagccttcgtcagcggggagccggcgaacttcggcagtccgcagctggtgacccgcacgccggcggcccgcagggtctcgaacaccgtgggctccctctgcaggtccagaggcgcgatcgcgttgtcgaactggatcagctgcgacagctcccccgtttgggtgttgcgctgcgtgtagcccgccatccccgtcaggcccgggcacgtgccggtgccgaaagccgccatcgcggcgacggtggtgctcggcgcgcatgtggcgatgggcctgtcgttggactcgtcgcgcagcaatgcgcgcaggtacggactgtgtccgacgcgcatccgaaggttccagtagccaaggccgtcaaccagcgccacgatcacgctgtcggccttgggaacccccagggcgacgcgcaaggcctccggatcatggtggatccgcgtggcgaccggatgccctatcgccgcgctgaccgccggcagcacggcggacaggtgcagcgccccgccgcgtacggcgtcacgccgccagtcgccataccgaacggtcggtatcgtctgcagcaattcgtccatgctcgcgatttcagcgttcatgttttccattcaagcaccgtccgtcggaaaaggacacggctgggcgggattcttggcatgattgttcgctatcatggacgattggatttttcaacggcaccatttcggccattcgcgccatgcggatggccgaagcacagattggggaatggcacctatggcacatcgcaccacgactcatcaggcctatgacccgcgtcaggtccaagagcatatcgtggaaacgccgttgaacgaggaaatgagcaagtcgttcctcgaatacgcgtattcggtgatctacgcgcgagccctgcctgacgcgcgcgacggcctcaagcccgtgcagcgccgcatcatctaccagatgggcgagatgaacctgacgcccgaccgcccgtacatgaaatcggcccgcgtggtgggcgaggtgatgggcaagctccacccccacggcgattcagccatctacgaggcgatggtgcgtctcgcgcagccgttcgcgatgcgtctcgcgctggtggacggccatggcaatttcggctcgctggacgacggcccggccgcctcccgatacaccgaggcccgtctggcgcccgcggcgctgggcatgaacgccgacatcgacgaggacaccgtcgatttcacgccgaactacgacaacaagctcaaggagccgaccgtgctgccggccgcgatccccaacctgctggtcaacggcggttcgggcatcgctgtcggcatggccacgaacatggcgacccacaatctcggcgaggtcgtcgcggccgcgaagcacctgatggcgcatcccgacgccacgctggaggagctcatgcgctacgtgccgggccccgattggccgggtggcggcatcatcatcgggcgaaacggcatccgcgaagcgtacgagaccggccgcggcacactcaccacgcggtcgatgacgcatttcgagaacgtgacggcgcgcaagaaggccatcgtggtcaccgagctgccgttcatggtcggccccgaacgggtgctggaacgcatttccgaaggggtgaagaaccgcaagctggagggaatctccggcgccatcgacctgaccgaccgccataacggcaccaggctggtcatcgagatcaagaccggtttcgacccgaacgccgtgctcgcgcagctgttccgacacacgccgctgcaggacaatttcacgatgaacaacgtcgcgctggtggatggccggccccacaccatgggtctcaaggagatgttgcaggtgtggatcgaccaccgccgcatcgtggtgcgccggcgcagcgaattccgccgtcggaaggcgctggagcgcctgcacctggtcgagggcctgctgctggccatgatcgacatcgacgaggtcatccaggtcatccgcacctcggatgacgccgacgccgcgaagtcgcggctgatcgcggtcttcgaccttgacgacgtgcaggcgcagtacatccttgacctgcgccttcgccggctcacacgcatgagccgcatcgagctggaggcggagcgcgacgacctcaaacggcgtatcgaggagctggagcgcatactggcctccgcgcaggaactggaccgcgtggtcgtcgacgaaatggatcaggcggttgccgaatacgggacgcctcgccgtaccgtgctgctggacgaggccgaggacggcacgctgacgccggtgactcctcatggagacgacagcgtgaacgcggccgcgatgaaggccgccgcagccgcggccaccctgtcgtcggccgaagcggacgtggccgccgcggccgcggccaggaaggccggcgaggatgccgcggcagtcgcggcgctgcaaatcgacgacgagccgtgcacggtgatgctcggcgcgtccggcacgatagcgcgctccaccccggccgcattggatgcctggaagtcgcggtcgacgagcgacgaacgtacgaaggacgaccacatcgtgtccatcttccgcaccaccacacggtcctcgtacggactggtcacgtccgccgggcgtctggtgctggcccatgtggtcgaattgcccgcgctcgccgcatcgccgcagacgaacgtcgccggcggcataccggccgacgagctgatcggcatgaccgaaagcaccgatccgattcccggcgagcatgtcgtcgccgccatccccatggatcagcgcgacgacgacggcccgacccccgctcccctggccatcggcacacgggccggcgtggtgaaacgctggaaccgcgaggcccccaccacgatggactcctggagcgtcatcgacctcaaggacggcgactccgtgctgttcgccgccgacgcggcggacgaagaccgcctcgtgttcgtcgcgtccgactcctcgctgctgacgttcgatgccgggaatgtgcgcccacagggtcgcaccgccggcggcatggcgggaatccgtctggctgagggatgcacggcgatcacgttcaacgtagtgcccgcaggcaagatcgcgtggacgtacgaagagggcgacaacggcatgttctccgcgtccggagccgtcgtgctgacggtcgccggagacaaggacgcgctgcccggcaccgaaaacggcgcggccaaggtgacgccgttagagatgtacccgaccaagggccgcggcaccggcggagtgaggtcgcagcgtttcctcaagggccagaacaccctgatcttcgcccgcgtcggcatgtacccgctgcacgcctccaccgagggaggctcgccggtggagctgcccaagcccgacatgcgccgcgacgcatccggtgtcgatctggccgcgcctgtcgccttctgcggatgaggctgtttcggggccggtgccttcagcgagcatcgtcccacacacacctgtggggcgtaggggggggggtgccgtccacgtttcggcagacgcgcagttcctgcaggcgcgcaatatcagatggcacgccgtgtcggatgatgcgcaatgccggatggcgtacctcacgcgtagatacgccggtgacctggcgctggcggcggaacatatcggagaccggcggcggctgtcagcagtagagcctcatgccttggggtacggggacgaatcccgcgacgtgcagcatgcgcgaccactcgcctcgcacagtcaatggctcgtcgttggcatcacagaaggtgacacccccgcgaatacccccgtcacgcaggtttcgctgcaatgcgtaggcgagctcgttgcaggcctgctgcaatgcgggatccgcgtcttgcgcgagcaacagatgatggcttcggggcaccgcgtatgccagcaatcgtccaccccggagcacgaccgatgcgccggagcgccgcgccggcctgatcgaaaacccgcctatcgttcgtggccatgcgatgacgcttccgtacaggttggcggggtcggtggcgtccaacacgaccgcggagggttccgccgcgcatgcccgcagcgcatccacggtctgacgcgacgcgaactgtgcggcaccgcatccgctgacgaacatgccgcgcatcaatgcgccatgctcttccatgcgtctgagcaccggatacaggcccgagaatccgccgtccagacgttccttgtcgatcatgggcggagctatgacgccgtaacggtccagcaacgcctcaatccgcgcgatggcgacccgctccgcggacgcctcctgcatatctgcatgaggcacggcggaccatagtcccgtcatgttcgccgggacactgaccctgacccgcaccctgcgccgtgatgcacgggctggggccttcaccgcatgggatgacgctccgagggatctcagcggatcgaacgagctgttggtgaccttcccttgccagaccagcgaccatagggcctcctcgaactgggagtcggcccatgggtggggcaatatctcgccggtggattcgtccacgcattccgacgacgcgtcccatgccgcgcgcgtcagccctgcgagctgattcgcatgatatgccccgcccggtgccagcacggccatcaccgcatccggcagcgtgaccggctccccgggggcttcgccgttcttctccccatcctgcactgtcagaagcagggagtccgccggatgcaatgcgacgagtcctggttccttcgccttgctgccggtggtcttggaacccacccagacgatctcgccggaggagagcaggccgtcgagcatcgccggacgatagtcgcgcacccgtaccggcaatacggacgattcccataccgagggaggcagggcgacgccttccagctgctcgatgacacgcatcaccccgtcttcgccgtcatatcgttcgccgcccaccggcccgacaccttgcagcccgataaggaatgtctggtattcgctcaattcgacgggcttggtctcggctcgggccttggccagcgacctggcccggatgcgtcggaacacctccttgtgcagccatgcctttcctccgtcctcggcggcgatgccgtcaaggacctctcctcgtgctttgagcatgtccaaggcgtgcaccgcgccggccgcgtcgatcgacaggtccgccatcatccgttcgacggtgaaaggcccgtgcgtcttggcgtatcttgcgacccggccatcgatgtcatcgtccggcagctcgttccagaacgtcctgcgccccagctcctcctcgacctcatgcacggctcgaggatccatgatcgccgagaaatcggcctgccccagcagccgttccagcacatcgggatcgatcgacagcagttgcgccgatcgttccgcctgaggcacgtcgtactggtacatgacggtgcccacatagccgaacagcaggttctcggcgaatggggacgcaatgtcggtcgtcacatcgaccagaccgatgtttcccgactgaatgtccgtcatgatgcgacgcaacgcgggcatgtcgtaatcgtcctgcaggcattcgcgggcggtttccagcagcagcgggaaattgcgtttcagccgcgcggcgttcaacagttgcgcggcacgcagtctctgctgccatagcggcacgcgcctgccgggatcggttctggggaggaacagcgagcgtgcggcgcattccctgaaccgggccgcgaacagcaccgtctcccccacctgcgtctcgatcatgcgctgcatgtcgtcagggtcgaacctgatgagctccgggacatcgatgtcatgctcctgggcgggaagcctcaggacgatgccgtcatcggcggcgtatgcctggccgtcgaatccataacgctgcttgagacgcgcggtgattgccatcgcccatggctcatgcacgcgacggccatatcgggaatggatgatgacccgccagtccccctcgtcgtcggggcaacgttcgatcaccatgcggcggtcatccggcacgacgccggtggccttcctctgctccgccagcagtcgggcgaggttttccacggcgttgtcgtccagcccgtcatcgtgcaggcggtctgccgtggcggtgtcgaaccgtggatggcccgcttctgcggcatccgtcagtccagtgcagacctgccggatgaaagcgccttcggccgtaccgaacccgcagtccctgccgctgccgtccccatgccagaacggcagacgggccgtcctgcccggtgccggggtgacgatcacgcggtcgcgggtgatctcctgaatctgccatgtggatgtacccagggtgatgatgtcgccgacacgggactcgtacaccatttcctcgtcgagttcccccactcttcgaggccctttgcccccatccgtctcgggcagcaccacggtgtacagtccgcgatctggaatcgtgccgccgctggtcacggcgagccgctgcgccccgggtcgggcggagatcaggtcctcatcatggttccacatcaggcagggacggaaggcggagaagtcctcgctgtcgtaggcccccgtcatcatgcccatcaccgagtcgaacgtgccgcggtcgaggtcgcggaagggtgccgacctgcataccgtcgcataccagtcgtccggcctgaggtcctccatcgatgcggccgcgacggtctgttgggcgagcacatccagcgggttgcggatcaccgatatcggttcgatgtcgccggcccgcatgctttccacgctcgccgccgccccgatgatctgctcccgggtcagagggtagatcagcgcatgggacacccctccgacacgatgatccgcgcgtccgacgcgctgcaatcctgacgataccgacaacggaggcgatatctgtatcaccagatccaccgaccccatgtcgatgcccaattccaggctgctggtggccaccacgcaacgcagcaggccatgtttgagctgttcctcgatccgtttgcgccgctccttggacaccgacccgtgatgggccatcgcgatgacgtccccgtcatcgtgagaccgaaccagcatcgtcgtggagccgaccacgggatcgtaatgccgggaaaacccgctgcgcccctccggtgactgcgtctgcacggcatcggtgccatgatcctgtgcatacaggtcgttgagcctggcggtgagcttctccgccaggcccctcgaattcacgaacaccagcgtggtgtggtgggagagcacctgatccagcacgtcccgctcgatcaccggccatatggatccgcccgcccgatcccccgcggcgccggtgatcgcctgcgaatcgtattgcgaatcctccggcgaaaccagaaccgaccgtcgatccggcgacactggcaggccacgccgttcggcgagccgtctcatggccggggtcacgccgctgatatgcggggccgatgccgccgacgcgccgacgcctcccgcacggccgggcacattggctgattggaggtccctcatgttctccagcggctcgacgacgcgcagatccatcgcgggcctctcctgcggattgatgacggtcacgggatggatcccgccgacgaatctcgcgacctcgtcgacaggccttaccgtggcggacaaccctatgcgctgcgtcgcatgcccggcgagcgcatccagccgttccaggctcacggccaggtgcgcgccccgtttggtgccggcgacggcatggacctcatcgagtatcaccgtttcgacgtcgcgcaggatgacgcgcgccttggacgtcagcagcagatacagcgattccggcgtcgtgacgaggatgtccggcggatgggaggcgatggcgcgtctctcccgtgtcgtcgtgtcaccgctgcgtatggcgatgccgatatcgggagcggcaaggccggacgcctcgcattcggcggcgatgccgtcgagcggagcgcggaggttcttcgcgacatcgacggccagcgccttcagcggcgagacgtacagcaccttgacacgccgagtccgatgccgctctccggaaacgtcagccgcgcccttcggagcggtcatggcaccggagccgttcagacgatccgcctctcccgtcatcaggcggtcgatggccgagaggaacgcgcataatgtcttgcccgagccggtgggcgcgaccaccagagcattgcccccggcatggatgaccggccatgcctggctctgcgccgcagtaggtacatcaaacgcatgtttgaaccatgccctggtaggacccgagaacagattcaaacattcgtacatatattcgattatgcgatgcagcctagacccacgacacaccactcgaagacgggcgacctactcctcgacccactccagcacatcgcccgactggcactccagcgcctcgcagatgccgtcaagcgtggagaagcgtatggccttggcccgcccgttcttcagcagcgagcgcatgaccagcatcagcagcacgaacgccgcgagcagcagcaggccgaccgcgcccagcaggaccacgcccggagcccccagcgcgacatccacataggcacccgacgccgggtcgcggtattcggcatgggcgagacctccgtacagcgtcacgaacaataccggcgccgcctccaccgccgcgcatgcgatgatcgcatcgacccagcgaaccgcgcggccggaaaacacgtcaagccggtccaccaacgtcagcagattccacagcggcaccatcgccgcctcgacgcacgccacgcccagtatgcccgcgacggcatacacccaacgcgacggagcgaattccgggttggcctgcacgacgtcgcccgacaccacgaccatggcgcattgccccgccgcggaagcgccgatcccccacatgcagtacagccagctcatgtgacgactcgcgtaatggatcgccacacagttgttcagcgccgcatcgacgccgcctgcgcccaatccgtagggaggggggcggcgagcagcaaattggccatgattctcccggtattatccagtggtatgtacgttcgtacacatgctaggcgaaccgcaggatatccgttctcgcaggccgaacgagcgcgccggtccgccgcgctccggacccgttcacggacgcatggtcattcgcgctcagcgcaaccatagcgtttctcgaataaaaacgagatgattgacccggaaaacctgaacgagaaaaggcggcaacatggtcggcaatgacacgatacacacggtcacgcgtaaggagcacgactgcatcggctacatggatgtgccgaaagacgtgtattggggcatccatacgcagcgggcgctcggtaacttcaccgtctcccgaatcgcggactccacccatccccagctgatgcgggcctatgcgaccgtcaaacgcgcctgtgccgaagccaacgacgagctcggactgatcgaccacgacaaggcacggctcatcgtcgccgcatgccgcgacgtcgagaacggcgagctcgccgaccagttcccggtcgacgtgctgcaaggcggcgccggcacatcgacgaacatgaacatgaacgaggtcatcgccaatcgggcgttggagctcggcgggcatcccaaaggcgattatgggttcatccacccgaacgacgacgtgaaccattcgcaatcgaccaacgacacctaccccgcggcctgcaagctcgcgctgatcgacgccatcgggccgctcgcggaagagacgaagaaactcacgcgggcgttccacgacctcgccgacaagcacacgaacgacgtcaccatcggacgcacccagctgcaggatgcggtgccgatgacctacggtcaggaattccacgcattcgcaagcttcctgaaaagcgacctcctggccctcgaacacgtcgtcccgcaactgaccacgctgaacctcggcgccaccgccatcggcaccggcatctgcgccgacctgcggttccgcacgaccgccacacgccatctggccgccatcaccgggctgcccatcaccgcggcgtcggatcccgtggcggccatgaccgatatgagcggatacatcgccacgtcgcagacagtcaagaacctcgccatacacctgaaaaaggccgccgacgacctgcgactactcaattccggcccgcataccggattcgacgacctcaacgtgccggcacggcaggcgggcagcagcatcatgcccggcaaggtgaacccggtcatccccgaatgcgtgaaccaatgctgcttcatggtgttcggcatggacacgaccgtcacatgggccgcatccgaagggcaattgcagctcaacgccttcgacccggtgatcatccacgaactgctcaacggcatcgagctgctgacccgcgcgatggcgatgttccgcgagcgctgcgtgtccggcatcaccatcaacgcctcgacggggcgccgctacgccgaatactccccgtcgatcgccgccgcactgaacggcgccatcggatacgaacacgcggccgacatcgcccaggaagcggccaacgacaatcgcaccgtgcgcgatgtcgccggcgagcgcaccgacctgcccgcgtcgacgctcgacgagctgctcgacccgatcgccctgtcgcgccgcctcggccagacctgccgggagcatcagtagacggatatcggctcgggccgccgccggcctgatacaagccgacggcggcccgggcagtgcacagccggcagaaagccggatcaggtgtcgatcttggagcggtcgaaatcgtcggcgttgtcgacgatgaacgccttgcgcggcggcacatcgtcgcccatgagcaggctgaatatctcggacgcctgtgccgcatcctccatgcggatgcgccgcagcatgcgcgtgcgcggatccatcgtcgtgtccgcgagctggtcggcatccatctcacccagacccttgtagcgctggatgtcgggattgtacgagatgtgtcgccgttcgagatccgccagacggccggcgagctcgtcatcggagtacgtgtagatgaactcgcccttgtgcgagccggcgagcgcgatgcgatgcagcggcggcacggcggcgtagacgtacccgtgctcgatgagcgggcgcatgtaccggtagaacagcgtgagcagcaggatgcggatatgggcgccgtccacgtcggcatcggtcatcatgatgaccttgtggtagcgggactgctcgatgtcgaaaccggcgccggatcccgcaccgaccacctggatgatcgcggcgcactccttgttgttgagcatctggctcaacgatgccttctgcacgttgagtatcttgcctcggatcggcagcagcgcctggaatccggaattgcgcgcagccttggccgtgccgagcgcggagtcgccctcgacgatgaacagctcggccacatcgtcgttgcccggctggcagtcggacagtttcgacggcatggcggcggattcgagcgcgttcttgcggcgcgtgacctccttggtcttgcgcgcctggatgcgggcgtgcatctcgccgacaatcttctccagcacacgaccggactgctccttgtagccgcgtttggagcccgtgatcatctcgccgaactgcttgtcggtcatcctggtgacgatgggcttgacgggagcggtgccgagcacgtccttggtctgcccctggaactgcggctcggcgatgcgcacggtgacgacggccacgagtccggccaggatgtcgtcgcgctcgacgcgcatgttcgagtccttgaggttcaccttgagtttgcgggcgttgtcttcaacggccttgcggatctgcttggtgagccccatgaggaaaccgtcgacgtgcatgccgccgccgggcgtctcgaccacgttgacgaagctgcgcatcgtcgtgtcgtacccgttggtccaccgcatcgcgatgtcgacgccgcatttgcgggtgactttctgggcgtgcagttcgccgccctcgccgaccgcctgggtctcctcctcgtaggtgtcctcgccggtgatgcgccagatgtcggataccgcctctcccgcggacaggaaatcgacgaagtccttgacaccgccggtgtggcggaattcctcgacgcgggcgtgcgtgtggcgggccgcgtccaccttcgccgtctcgaccgcggcggagactgcggcaggtcgcgcttcggcttcacccgcttcaacggtatcttcgacggccgtgtcggccgcagaggcgatgtcggcagcgtccatcaggccggttccatcgtcggcgggcgtctgtgcggcgtcgacttccatcatctcgtcgacgctgtcgtcgccggtttccggcacgttctcgtcgatgacggtgatccgcagtcccggcaccaggaaactggtctggcgcacacggtcgatgagctgctcgtagctgaattcggcggtgtcgttgaagatttcgggatcggcccagtaccggatgcgcgtgcccgtggtcttcgggctgaccttgccgatgatctccagttcggtcgggcggttcttgcgggtgcgcttgaacggcgcgtccggggacggatgctcgggatcggtgtcggaatatacgcctggatgaccctggtggaaggccatgtgatgggttttgccgtcgcggtcgacctcgacgtccagacgcgagctcagcgcgttgacgacggacgagccgacgccgtgcaggccgccggccgcgttataggacgcgttgccgaacttcgcgccggcatgcagcttggtcagcacgacctcgacgccggtgagcttggtcttcggctcgacgtcgacggggatgccacggccgttgtcggccacttccacggagccgtcgtcgtgcagggtcaccgtgatatggtcgcaggcgcccgcaagcgcctcgtccaccgcgttgtcgatgatctcccacaggcagtgcatcagaccctggctgtcggtggtgccgatgtacatgccggggcgcttgcgcaccgcgtccaagccttcgagcacggtaaggctgtcggcaccgtattcctgtttgggcatacaaatcctattttctgtataactcgcggctctcctcatcgaggggagctatcaacggatggctccgtcgggggggggacagtccactggaccgcccctcctcgcgtgatcgcgctgccgagcggcgcgatcactgatcgaggaagtcgcgcagggtctgggagcgcgacgggtggcgcagcttcgacatcgtcttggactctatctggcggatacgctcacgggtcacgccgtacacgcggccgatatcgtccagcgtcttgggctggccgtcctccaaaccgtaacgcatcttgatgacgccggcctcgcgggggctcagagtctccagcacctgcttgaactgctcctgcagcagcgagaacgcgaccgcgtcggacggcgcgatggcgtcggtgtcctcgatgaggtcgccgaactcggaatcgccgtcctcgcccagcggcgtgtgcagcgagatcggctcgcggccgtacttctgcacctcctgcaccttctcgaccggcatgtcgagctcgcgggccagctcgtccggcgtgggctcgcggcccaggtcctgcagcatctggcgctgaacgcgcgacagcttgttgatgacctcgaccatgtgcacgggcacgcggatggtgcgtgcctgatcggccatggcgcgggtgatggcctgacggatccaccacgtggcataggtggagaacttgaagcccttcttccagtcgaacttctcgacggctcggatgaggcccaggttgccttcctgaatcaggtcaaggaagagcatgccacggccggtgtagcgcttggccagcgacaccacgagtcgcaggttcgcctccagcaggtggtccttggccttcttgccatcgttcgccgcccacttgagctcgcgcttgcgcttgaagtccatgccgtcgctctcggtatcgagcagatgctgggcgtacaggccggcctcgatgcgctcggagaggtccacctcctgctcggcgttcagcaggctgacacggccaatctgcttgagatagtccttgaccggatccgctgtggcgcccgcagcgatgacgcggcgcttcggattgcccgacggggtcaggttctcgtcgtcgtcatcgtcgcgcaccacgaacgcgcccttctccttgggctgttcaggctccttgcgcccgggttcagtcccctcgtcgtcctcttcgtcctcgggaacgtcgtcatcctcaccggattcgtcatcgatgtcatcatcgtcgccatccagaccgccgtcatcgacatcgtcgagatcgtcgtcaaggctctccagaccatcctcatcgacctggacgtcgtcgagatcgtccgaggaatcctcgttggcgagttcctcggtcttcgccatctcctcggtctcgtccttgacggccttcgccgacttggacgcggcgcgcttgcgggtgggcttcgcgggcgcggctgccttcgccgaggacttgcgtgccgtggacttggacgcggcggacctcgacgaggtcttcttgcccgcggcggatttcctgcccgctgcggtcttcttgtctgccgtagaggccgtacgcgcggcggttcccttcttctcggatttcgtcttggcgtccgtatcgtccgggactgtcgtcgccatcgtatccttcgtggccaaactcatcctcctgcatcatcatgccaagcgtgcttataccacatcgggcgcacttctggcaagagcaaatcgtcaactatgtgagttaaccatcttccaaggacgattattcccacggctcgttgcggcgtggaaccgatggtctcccgcgagccgtcatgcggcgtcgtgatgcgggccggcacccatccacgccggcatcacgccgcgctggtacgccgagcacacgatcgccgccagcgaacagtcctcatccagcatcaggcagcgcaacgcgaacgccaccgctcgactgtcgcccatccaccacatcacatacgccagcacggccagcggctgcacgctgaagctctccggaacgcgatcggccatggccacgagcatgtcggtgccggcccggcatctcggttcgtcgggccggcgtcgctcgtcgaaaaacgcgccctgcagctccctgcacatacggctctgcacatccggcgcatgcgagcgcgacgcgaaatccatcatcgtgcgcttgtcggcgcaggtgtccccggccaccaatgacatgatcagggcgtccctgatcgacaacgtcaccgtcattcccaccaccagcgcggcgatcgaggcgtcatcgatggcccgcggctgcgccgacaggcccgccagccaatggtcgaacggctcatcggcccattgcgcgtccgccgccacggtgccgctgagcttgcggcgctcgcagtattcatcgcgcatgcgtctgagatcgtcctcgcgcagcatgtcatcgtccgcgaccgcctccgcataccggacggcctgcgtgttcgtctcctgtcccatatcgtggtcccccttaccggtctcatccaccgccggcgcacgatgccggcgaccgccgcccccgcgacgggataccatcaactatgccgtatcgggccggttttcagggcgaaatccaacctatgtggtcgaaggcttgtcaggcttgcaaatccgcagttcttgtattcgtaaaaccctgtggataacctctaggtatgactgtttcatctgatttggccctgatcgagtcccgcatcgccgacgcggtggaccgtttcatggcgctcgacgccgacgacaccatcgaaggcccgtgcctgaccatatcccgcgaggtcgcgcgtcaggccctggtctccagcgaaggcggcaagcggctcagggcgttgctggccctccacgccttcgacgcgaccgacccgcaggggcatgacgacgatgacgcccatgcccgcagacgcgacgcggtgctcgacctggcctgcgcgatagaggtcttccagaccgccgcgctcgtccatgacgacatcatcgacgactccgacctgcgacggggcaaacccgcggctcacaaggcgctcggcacgacgtcgcacagcgcgtcgctcggccgaggactgggcatcatgctgggagaccttctcgccaccgccagcgtcgacatcgcccatgccgcggcgcaacggatgccccggcccgacatgatcgtctcgacgttcctgcgcatgcaccgcgaggtggagatcgggcaggtgctcgacctcgcagttgagttgtctccattggacgagccggaacggctcgcacgggaatccatgaacgtgttccgatggaagaccgccagctacacgaccatcgcgcccctcgaattcgcgcttctcgcctccggccgagaccccaggcgggcacatgccgacgccatgtccatcggactgccgctcggccaggcgttccagctcgccgacgacctgctggacgtcatcggatccagcagatccaccggcaagcccgtgggaggcgacatcagggagggcaagcgcaccgtgctgctcgcggacgcgatcagcggcgccgaccagaggcagcgccgcacactgatcgacatgttctcgtcgcagtcgcggggcgacgacgacgtacgccggtgcatcgagctgttcgaaggcaccggcgccatcgaccgatcccgccggcgcatccgcgcactgtggcagggcacgcttcatgccataggggacctgcggctcccaccgcaggacgagcgcacgctcaccgaggcatgcatgaggttcatcccgatcatcaaagcgtagagttttcgccaacgtatgtattggaaatgccgttttccagcagaaagaaccttacgatacaaccatgagtgaagtcgcagccacgtcgcaagagtcgcagggacgaatgatagaggggcgataccgcgtcatacgcaaaatcgccgaaggcggcatggcgaccgtgtacgaggcggaggataccaggctcgaacgccgcgtcgccatcaagatcatgcacatgcagctggcgcagggagcgcaccgcgagcagttcgtggaacggttccaccgcgaggccaagtccgccgcggcgatcgcgaacccacatatcgtgcaggtgtatgacaccggcgaattcaatgggctggactatctggtcatggaatacgttcatggcgtgaacctgcgtcacgacatgaacctgcagggcacgttcagcgtgcgcgagatgctgcgcgtcatctccgagacgctggacggactggcagcggcgcaccgcgtgggcgtcgtccaccgcgacatcaagcccgagaacatcctgatcaacgaccgcgggcacgtgcagatcaccgatttcggtctggcgaaggccgcgtcacaggcgacactgtcgaccaccggcatgctgctcggcaccgccgcgtatctggcgcctgaaatgatcgaggacaacaaggcgaccatgcagggggacctgtattccgtgggaatcatggcttgggagatgctcgccggcgacgtgccgttcacgtcggacaatcccgtcaccatggtgttcaagcacgtgcatgaggacgtgccgtccctgacctcgacctgcccgggcatcaaccagcaggtcgccgatttcgtctcgcatttgaccgcccgcgccgtcgaggcacggcccgccgacgcatccgacgccctgcatgagctgcaacagctgaccgcgaacctgccgatggacgcatggcagtaccgcaagcccgccgacgtaggcaccggcggcgataccgaggagccgaccgcccccgcgctggtgggcgccatcccggccccgcccgcgccgccgctgttcgattcgcgcaccggcaccgccccgcagaccggcaccgcccctgccacggcccgtacttcggtgatgcctgaaggcaccgcaccccaggacgtctccgccacccaggtaatcacgccgcaggattccacactcaccatcgggctgatggacgcgcgcccgctcgatgaccaaggctcggagcccgccaagcgcaagcgctcgaagaaacccttgatcatcacgctcgtggtggtgctcgtcgtggcgctcgtcgccggcgcaggcggctcatggtggtatttcctcggtccgggcagctactggacgctgccgcagcccaccgacatctcctgcaaggagaacaccgaatgctccatcgtcggggcgaagtggagcgattaccagagcacgctgaacgtggcgaacatcccgttcaccttctccgaggcgtacagtgacaccgtcgccaaggggaacatcatctccgccgacccgcagaacgtcggcacccatatcagcaagcgccacaacggacgcatcacggtgacggtgtcgcttggcgtcaagcaggcgaccatccccagcgacatcgcggatccgacgtcggccgatggcaaggatccgatcaaagcgcttgagaacgccggattcaccaacatcaaacgcgatgactcctcagccgaatattcgatgacgctgccggagggagccctgcaaagcatttccgagacgcccggctcgaccctggaccacaacgccgagatcaccgtggtactgtccaagggactcatgccggtcaccatgccggacatcgtcggcaagaccaaggacgaggccatgaccgccctcgacaacgcgaagctcaagaccaccgtttcggaggagtacagcgacagcgtcaagtccggcagcgtcatctccgcctcgcccgactccggtaccgaactgcattggggcgactccgtgaagctgaccgtatccaaggggcccgagaccgcggacgtgccgaacctcgtcggcaagagcaagagcgacgccatcaagacgctggaatccctcggtttcgaagtcaagaccggcggcttgaacatcctcggcctggtgcagcagcagagcgccaccggcaagacgaggctgcgcgacacgaacggcaacaagaccgtcatcacgctcaccgtcgtgtgacggcggcgcgccggcatataccggcatatacgcgaagcggctccccctctatcagtttgagagggggagccgcttcgttcgcgttcgggatcgtcggtcagtggccttcgccggcggttgcggcttcggcctcctgccgggccttgagctccgccttgaccttctgggcgtactcgtccacgtattcctgtccgctgagctttcggatctcgctgacgagatggtcggtgagcgcccgtacctcctcatgggtgatctcgtcggcgtccttgcgatccaccgggatgggcttgccgtatatcaccttcgtcttgcccttcgacgggatgacctgaccgggatgctgtatctcgcgcgttcccaccaacgcggtcggcaccagcgggcagccggtctccagagcaaggcgcgcggcaccggtgtggcctcggtacagtcgcccgtcaggactgcgcgtgccctccacgtggatgccgaacaggtggccttcctcaaggatctcacgggcgtgggccaacgcgcccagcgacttcgagccgccggaacggtccacggggaacactcccaccgacgtgaaccaccatttcttgaaccggcccttgatgcccttgccttcgaaatactcggccttgcccatgaaatgcaccatgcgcgggcaggtgatgggtatcagcgcatcgtcgatgaccgccagatggttcgcggcgatgatggcaccgccttcacgcggcacgttctccagtccgatcgccgtcggtcccatacgacgacgggcaatccaaccgaaacctttgacaaagaaccagtacagcacgatgacacctcccaagtttggccgtccgcctgattacagtaggacggtatgaccgatcatcacgatagcaaccacaacgataccaacgcgggtgaagaacatccaaacaccacgccgcgcgccggacatgacgggtatgacacaggctccaatgccggcgacgatctcgactgggccgccttcgccgcggagcatgccaacgacctgcaggacgtcgagcgctcacgcaacgcgcggcgcttcgagaagcatgcgcagcgcaaggagaaggaggcgctgctgtcggtcgacgatctggacgccggcacgttcaccgatgacaaggtgccgctgcaccagcgcggcccccgcgaccatggcggccgcagctggctcgataccgatgacgtcatggacgagtacggcgatgacttcgtgccgccgaacccgaaaatcggccgcgtgaacgcctcgaagctggtgttctggatcctgctggtcgcaggcgtcgcgggtatcatcgcatccgtgttcgtacccgccctggcgacgttcctgggctccatattcggtctgtgcgcgctggtcggcggcgccggcctcatcctccaacacaaggggcacaccgagacacgcaccgacatgttcgacgacggcgcgcgggtgtgacgacggtgcccgtcctcatcggacgggcaccgcaatggtcaggccttggacttggcggtctcgatccacttgccgaacagggccgcggccttgccggaatcgacggtgttctcggcgagcgcatacgcctcacggaaccgctcggcgagtgtgccgccgccgaccaggttgccgtctgccacgatggcagacgcagcgttgagcaacgcggtggtgcgtgacgggatgtccttgccggccaagaagtccgtgaacgcggcggcgttcacatcgggttcgccgcccttgagctgctcgacggagatcttggcaagacacagatccacggtcgggtcgaaatcggtttcggtgaccttgccgtcgcgaatctcccacacggagatcgggccggtgggagcaagctcgtcgaggccctcgtgcgaggtgtagaccaggccggactggccgcggctggcgtacacggcggccatgatcggactcagcttgcggttggcgcagccgatggccacgtgcgccggattggccgggttggtcaacggtcccaggatgttgaacacgcacgggatgccgagcgcggcgcgaatcgggccaacaaagcgcatggccgggtggaaggtgcgggcgaacgcaaaggtgatgcctacctcgtcgccgatctccccgaccgcctcgggcttcagatccatcggcaggccgagatcctcgagcacgtcggcggctccgcacttcgaggaggcggcgcggttgccatgcttgacgatcttcacgcccgccgcagctgcggccacggaacccatcgtggataggttcacggtggcgaagccgtcaccgccggttccgacgatgtcggtggtctcaccggacacgttgagcggcacggcgtgggagaccatggcctttgcggcgccacacacctcgtcggcggtcagtcccagctgctcctgcatggcgagcgcggcacccacggcggccggatcggcgttgccctgcatcaggtcgtcgacgaaccactccgattcctcagcgctcaggtggtctcccccgaccagcttggtgagaatcgacttccatgtgatctcggccatgatgccctccttggcgtttcgtcacgccgtgtgatatgtattcgtcgcctcattgtaatggcttgtcgtttcgtcgcccgtaatcttccatattgcaaaacatcatcggctcccgtcagcgggagccacttacttgtccggcccggacagcgtgccgacaatcagggcaggcaacgcggcaggcatcgccacgatgccgctacgggagtcccgactgaaacgctatgcagtatcccaaggctttgccgggcaatagatcggaaccgctgcagggtcaatgagatcgccgcgtgcgtaccaggcctttgcactgatgggcaccgaatatggcggacaacgcacgcatatatcgattgatgcgcgcgttgtcctgagacgatatcgggaaccccagatagcggcattttacaaacggtagaattccaacgatttcgcgatttgcgtcgtgggacaatgcacgcgtcaaccgattgatgcacgcgttgtcctgcggtatcgctgtacaacacgcgcgaatccatcaaaatcgtgcgttgtacagcgaatggggctcggcgaacctcgattccacggccccgcgaataatcgacgggctcaacccgcggacaagcccttcctctctctcccccgaaacgcaagtggctcccctcacatcgaggggagccacttactcgtctagtccggagagcttatatcactcttcgttctggccgtggcacatcttgtacttgcgaccggaaccgcacgggcactgcgcgttcttggacgtgccggggaacgtacggccgtcggaccacggggtcttcagctcctcgttcttcgggcgcttgttggcgggcaccttgccttcggcatggctgatcggagccgggccggtgatcggcgcagtggcctcgcctgcggcggattccttggcggactgggcgatggcgaccttctcgtcggattcctccgcagtctcagcctcaccggcgtcctcggccttgtcgacttcggagctagcggcgccgacggcctcttcggcctcatcaacgacggcgtcatcggactcgatgccgacttcctcgctcctggacacctgctgcacatcgacgtggaagagcagctggacggactcctccttgatcgcctcgatcatggagttgtacatctggtaaccttcgcgctggtactcgaccagcgggtcgcgctgacccatgccgcgcaggccgatgccatccttgaggtagtccatctcgtacaggtgctcacgccacttgcggtcaagcacggcgaggaccacgcggcgttccagctggcgcaggccttcctcaccgaccttctcctcaagttcggcgtactcctccctggcctgatcgacgagggagtcgcgcacggccgcaacggccttgtcgcccttgagcttgtcggcggcgtccttggcggcgtcctggtcaagctcgaacgggaacacggtcttgagggccttgaacaggccgtcccaatcccagtcggagggcttgctggaacccttctgggcacccttgatgtagctgtcgatggtatcggcaatgaagcgctcgatatcaccgtgaatgtcctcgcccttaagcaccgcctgacgctcggagtagatgacggtacgttgcttgttcatcacgtcgtcgtacttgaggacgttcttacggatttcgaagttgcgcgcctcgacggtcttctgtgcggtgcgcacacccttcgacacgcttttcgcctcgatcggctcgccttccggcatgcccttggccatgacgcgggcgacgagctgcgtgttgaacagacgcatcaggtcatcttccagcgacaggtagaagcgggactcgccaggatcgccctgacggccggaacggccgcgcagctggttgtcgatacggcgtgattcgtggcgctcggtgccgagcacgtacagaccgccaagctcgacgacctcctcatgctcgtccttgacctgctccttgacctcggccaaggtgcccggccagcgcttctcgtactcgtccggcgtgtcctcgggggaatagccctcggacttgagcttctggtcggccaggaactcgacgttgccgccgagcatgatatcggtaccacgaccggccatattggtggcgacggtgacggcgcccttgcggccggcgaccgcgacgaccttggcctcgctggcgtgctgcttcgcgttgagcacctgatggtcgatgcccgccacgtcgagcagcgaggagacgacctcggaggactcgacggatgcggtacccagcagcaccggctggcccttggcgtggcgcttggcgacgtccttgacgatggcggccagcttctccttcttggtgcggaagatgaggtcgtcctggtccttgcggatcatcggcttgttcgtcgggatcggcagcacgcccagcttgtaggtgcccatgaactcggcggcctcggtctcggcggtaccggtcatgccggcgagcttgtcgtacatgcggaagtagttctgcagggtgatcgtggcgaaggtctggttctcggccttgatctccacgttctccttggcttccagcgcctggtgcagaccctcgttgtaacggcggcccggcaggatacggccggtgtgctcgtcgacgatcagaacctcgccgtgggtgacgacgtagtcgcggtcacgcaggaagagttctttggccttgatggcgttgttgaggtagccgatgagtgcggtgttgctcggctcgtacaggttgtcgatgccgaggaagtcctcgaccttggtgatgcccgggtcgagcacaccgacgaccttcttcttctcgtcgacctcatagtcctcgtcgcgggtcagcttcggcacgagacgcgcgaactggcggtaccaacgggtcacgtcgccctcggccgggccggagatgatcagaggggtacgggcctcatcgatgaggatggagtcgacctcatcgacgatggcgtaatggtggccgcgctgcaccagatcggccttctcccacgccatgttgtcgcgcaggtagtcgaagccgaactcgttgttggtgccgtaggtgatgtcggcgttgtactgcttgcggcgctccgccggcttctggtcggtgatgatgcagccgacgttcatgccgaggaagcggtagatacgacccatcagctcgctctggtagcttgccaggtagtcgttgaccgtgaccacgtgcacgcccttgccttcgagtgcgttcaggtagctcgggagcgtcgcgaccagagtcttgccttcaccggtcttcatttcggcgatattgccccagtgcagagccgcgccacccatgagctgcacatcgaagtgacgctgtcccagagtgcgcttcgacacctcacggacggtggcgaacgcttcgggcatcaacttgtcaaggttctcaccgttgtccagtcgctgcttgaacttggcggtctggcctttgagttcctcgtcggacagagcggaaatctcgtcctcaagggcattcacggccttggccacgttctccagtttcttgagctggtgcccttctcccatgcggagggctttgtcaacgatatctaccacattcgctccctgtttaagctttcgtacgtcaacgagcatagcctgatgcccgacatcaggcacaaactccatccatgatatgcgaacactcggatttttgccgttccgacccgctggacacgcccatcgatacttgtttcgtcgtgtgccgacacgcaaatatggcctgcctggatatgccgggcaggccatgtatcacgtggcggaacacttacttgttcttgatgttctccggggtgtcgatctcgaacacgccgtagctccaaccgtggcggtggtagacgacggacgggcggccggtctccttgttgacgaacaggaagaagtcgtgaccgatcagttccatctcgtacagcgcctcgtcgatgctcatcggctcggcgatgtgcagcttgcggcgaatcacgatcggcgtgtcaccgacctggacctccaccgactcgcccggaccgaggtcggaggcgacggcggcttcggggctgttgttcggctcttccggctccggctcctcttccggttccggcggagcgaccgctcccagatcgacgggcgtcgggttgatgtacccgcggcggtgatccttgcggcggtcacgggtgcggcgcaggcgcagcgtcagcttgtcgagcgccatgtccagagcactgaactcatcggtgctggaagcctcggcgcgcaccacggtgctgcctgcgatcacggtgatctccacacgcttcgcggtgtcggcctgacgcggattcccctcatgcgtcagcacgatctgagctcgttgcgcatccggcgcgatagcggtcacacgattcatcttgctttcgacgacatcacggaacttctgcttgacttgcgtatgacgtccggtaacgacgatttccatgtggacctccctatactcaagcggtgtcacccgctatatgtgtgccgaatggcgtcatcaccacccgggtaagtttcattgtagccgaacagagggtaaacggcggggaactcgcccagagaaatacgtttctttttttcacaggttcccgtaacgttgctgtgcttatactgtgcggcttactttccttgaaggaaactgttatactttttggtctggcgacacagattgttgcgctgctggtattgctggcgctgagccgcagcatcacatcaatggaggtcttgccctggatggtcgtcatagaggtcgtgtggtccgtgtacttcgtcgtcaccgaacgctggcacgacaagcttgcccgcaaggcaatgctgacggtataagaccattcggacagaatcgagcatgcaagcaaggccagcgatataacggtatggaatgttcgggaggtgcctgtgccagtcgagccacgattcgatcctgtgatccatgagccgatgcggctgcggatctgcggcatcctgtcggcggccgactgtggggtggtcaccacccgccggcgccacgcgccacctcccgccagcgggaggatgagcacccccccaccgacagcaattcggcattcggcgttcatcgtctcgcccggtgcgccggcccaccctgattctcctgcgtaaaatccctggcctgccgtatagtagctgattcgagacccccagatggccgcggccgcgtcattcatttggcaaggctgaggaacttccgggctccgcagagcacgatggcggataacgtccgcccagggtgacctgagagatagcgcagcagagaacagaccgcccgcgcaagcgggtaagggtgaaacggcggtgtaagagaccaccggtccgctggtaacagtcggtcgcatggcaagcctcatcgggagcaaggccaagcagaagacggcaagggctgctcgcccgtgtcttcgggtaggccgctagagcctggcggcaacgtcaggtcgagatggatggccatccgcgtggcgacacgcgacagaacccggggtatcgggggtctcgcttttctttaccccccccccgaatccgcatacctcccgccaacacattcctcccaccaatatgagggcgcgcgaacgaaacaacgcaatgccggcagccccgttccctcccgctggcgggagatggcgcgaagcgtcggagggtgttctcacgccggcaatgcggtaagaccaccggatcgacaaaccaccgggccggcaacccgccaccccgccaagccaccggggcatctcccccgcttgccccgcgctgtatctcatctaagagatagttcattgagatagttcattctaatcaaatagctcatgggctacggcacgcagggtttcggcgtcgtgccccttgcgcccgcccgaggaccagaaccggcgcttgcgcactttcgggtccatgccctgtgtcttggcggcgctgcgccgccccaactcccatgcggcgtcctcgaagacaccgctcatgcgggcctcgtcgcagacccgctccgccagcggacggtcgacccccttgcgagccagttccataaccgcaccgcggtatcccatcagacggccgacgcagtagcgcacggcagattgcgcgtacgactcatcatcgaccagaccaacctcgatcagcctgtcgaccactgcggcgaccgtctcatcgtcataccctttgtcgatcaggcggtctcgcagggcgcccgatggacgatccgccgcatccagcaggcgcaatgcggactcccgacacgcatcgacatcgcagggatcctccggctcccgcccaggccgcgacatgctccgcgcggagcgccgagccgggcggttcccatgtgaccatgttccgcgtcgcggggagtcgacgcccggttcgacaaccggcgtctcacatgttccatgagcggcgaggaacgcttctgcgctgatcatgcggcaggcgatgcggcggcagcgggcgcgccatcctccggcgccgtttcaggggcatccccgtccgtcgcggactcaccgtcggccagctgatcgggcacttcgatgaggccgaattccgccttgaccttgttgccgatctcctcggtgatctgcggattgtccttgaggaacttgcgcacgttctcacggccctggccgagctggtccccgtcatacgtgaaccatgagccggacttcttgaccacgttgcactgcaatgccatgtccaggacggatccctccttggagatgccctcgccatacagcacatcgaactcggcggacttgaacggcggagccatcttgttcttgacgaccttgaccttggtgcggttgcccacggcctcctcgccgttcttgatggtctggatgcggcggatatccagacgcaccgacgcatagaatttcagcgccttgccaccggtcgtggtttcggggttgccaaagaacacgccgatcttctctcgtagctggttgatgaagatggccgtggtgccggcctgtgccagagcgccggtcatcttcctgagcgcctggctcatcagacgggcctgcagaccgacatggctgtcacccatatcgccttcgatctccgccttgggaaccaaggccgcgaccgaatcgatgacgatgacgtcaagggcacccgaccggatgagcatgtccgcgatctccagcgcctgctcgccgttgtccggctgcgagacgatcagggaatcggtgtcgacacccagatgccgggcatagaccggatccagcgcgtgctcggcatcgatgaatgccgccaccccgccgttcttctgtgcgttggcgaccacatgtagcgccagcgtcgtcttgccggacgattcagggccatagatctcgacgatgcgccccttcggcagaccgccgatacccagggccagatccaacgccagcgatccggtgggaatcacctcgacgttctgctcgggcttgtcgcccaagcgcatcgcggatcccttgccgaagcttttctccacttgctccagagcggagtccaaagccgccttgcgtcggggatcgatgccgtcccccaccggcccattgcttgcggcctcacgaacagagaccttcgatgcggccttgcccgccccacctttcgaggtcgtacgctgtgccatgtcaatctccttacgttgtcatccatatgcgccatatgccacatgcatcaaccgtacggaacatacgaaccccggcgcaaacgaatccggccaatgtggtcgaaggctccccggcatccatcgatccgcaccgactcccccttactgtcgcaaggaattcgtcggcgtgtcgaaccgtgcggcgcactacgtcatatcatcgtgcactgtggataactataccccaataggcgaacacctgttcgatatcacccgttccgcgtgtctcgtcaacggaccggcatcggaggcgcgttgtgatcggagccccaacgctggggatcgggaacgtccatatggtcgcacagcacgttccataccacgcgcggctgctcccccgcagacagcgcctgcgccgcggtaagtcccgcgagcgcgtcaagatgctgatcctggaccaggctccggccatacccatgaccgaacacctcatccaccagttcccagaattcccgttctcgcatgtctcccagtctaacccggccccgccgctgcgaatgccggcataccaatcgacgccacacccccgaacacgacgaaaccgcccgccgggcctcaagcccatgcggacggttcctctcatgcacacgatacgacgatatgcatatgcacgcggcatccggcgccgcaaatcgctattcgccgatcgaatccagataatcggcgacgagccgcagcatctgcgcggtgcttacacccagtgatcccgcgatggagctcagcagttcggagcttgcctccttctgcccgcgctccacctcggacagatagcccagcgacacgccggccttctcactcacttcacgcaacgtcttgttgtcgcgggtgcgaagatcgcgcagcacatggccgatggcctcgcgcagcgacacatcctttccctcgggcaacgcctcgacgccacgcgagaccgcgcgctgacgcggttcgaaggaatcctcctccatacgcatacgattcagttccgcctgccgttcatccttggccttcttcgccgcacgcacccgcagcacctgctgctgggcgaacaacacggcacgccgctgcgccggcgtgagatcacgcatcctggccgtacccggctgcacctgcttgacggggatgccagccgtttccatccgctcgcccgttcgggtcatcgtttccatgagaccctcctttcatatcgtccaagtgcttccactgtgttcaacaccgccggcggcggtttattcctgcatatctcctgtgaaatggctcacgatttgcacaaggctgaatacggcaccgcgacggacctcctcgcgcccacccgtcagatgaagctcgtgggcggtcacggacggcacgccgtcagggcttatggcggctggaatccgcactcccacatacaccagtcccgcgggcttgtctccatccggtccgggccccgccacgccggtggtcgacaatccgatgacacggtcagcgtattcgggctgcccgtacagcccggcgaccgacgccgccatctgtcgggccacttcgggatgcacggccccttcgcgttccaacaaaccgcggtcgacccccagaatcgacgccttggcacgaatgtcgtaggtgaccgccgacccgagaaacacgcgggatgcgcccggcacgcgcacgaacgcatcggccagcagcccgccggtcaacgactccgccgcaactatcttcacgtcatgcgcctcgcaaaaccgcagaatccgcgcggccatgtcgtcgcaacggcacgaatcggcatcattcatcgcaatccccctccatcaaacgccatcaaacaaaaacgccgccgtgcgcaggcacgacggcgtccactcgctcagtccttgcggctcccgaacgtgttgatcagatatatcgcccccgaatacaggcacagcatcagcgcgatgtatatcagggcgtacgtcagcgtgtaatatcccgtcatccacaccggcgcggtctgggccggattgaacacccacacgggcagcagcagcatcgacaggccgatgcactggaacagcgtcttgagcttgcccggccaggcggcggcgatcaccttgccgcccttgtcgatgacaaagaagcgcatgacggtgatgcccacctcacgcagcagaaacagcgcgacgatgatccagccgagccagacgggaccgagctcgccaaacaccgcggccacgatcagcgtggcgcaggtgagcagcttgtcggctatgggatccatcagcttgccgagttcggtgacctggttgtacttgcgggccatccacccgtccaccttgtcggtggacgcggcgacgatgaacagcacggccgcggcccatcgcatggggatgttgttctctccccacgagcctgcggcgatgtacaggccgaggaatatcacgaccagcacgatgcgcgaatacgtgacgaggttcggcggtgcgttccagccgtccagcagcgacttcttggcggtcgccgagcgttccgttgtatcgttttgcatatcgttttccatagtgttcacgatacccccacactcctaccttggatgaatatgcggttcgagttctctgggaatcccgtcagatatggctgcatcatggccgggtcaggcctgccggtcaggccgacttggcacccactacgccaattcgccctgctgcgcggccgcggcgggcgcagaggcctgcatcgcatcggtctcgccacgaatgaacgcgagcaccgcaggcagatcctggggctggacgagcacctgacgggccttcgagccttcggacgggccgacaacgccacgcgactccagcaaatccatgagtcggccggccttggcgaagccgacgcgcagcttgcgctgcagcatcgatgtggaaccgaactgcgtggtgaccaccagctcggccgcctgcagcaacacgtccatatcgtcgccgatgtcctcatccggctcgacggccttcttctcggcctcctgcgccatctgctcgatgtcctcgcggtagtgcggcttgcgctgtgtgcgcacgaactcgacggccttgcggatctcggactcgttcacccacgatccctgcacgcggatgggtttcatcgagcccataggcaggaacagggcgtcgccctggccgatcagcgtctcggcgcccaccgaatcgaggatgactcgcgaatcggtggcggaggatgtggcgaatgccagtcgggacgggatgttcgccttgatcaggccggtgaccacgtcgaccgacgggcgctgcgtggcgagcaccaggtgcacgcccgcggcacgcgccagctgtgtgatgcgctggatcgagctttcgacgtcgttcttggcgaccatcatcaggtcggccatctcgtctacgacgacgagcaggtacgggtacggggcgaccttgcggttcgaaccggctggcgcatgcaccttgcccgcgcgcacggcttcgttgaagtccttgacgtggcggaatccgaagaactgcaggtcgtcgtagcgcgcgtccatctccttgaccacccattcgagcgcctgtgcggccttcttcggatcggtgatgatcggtgtgagcaggtgcgggatgcccgcatacgcgctcaactccacgcgcttgggatcgaccatgatcaggcgcacctgctcgggcgtggaacgcatgatgatcgacatgagcatcgaattgatgaagctcgactttccggagccggtggcgcccgccaccagcaggtgcggcatcttggtcaggtcggcggtgacgaaatggccctccacgtccttgccgacgccggcgagcatggggttcgggtcgttcatcgccttgtcggagcgcagcacgtcgccgaggtggacgatctcgcggtcatcgttcgggatttcgatgccgatcgccgattttccggggatcggcgagaggatgcgcacatcggagctggccaccgcgtaggcgatgttgcgctgcaggttcgtgaccttctcgaccttgacgcccgcgccgagctcgacctcgtactgggtgacggacgggccgcgcaggaagccgacgactttcgcgtcgacgttgaactgctggaacgtggaggtcagcgcgcggatcacgcggtcattggccggcgtgcgcacggcatgaggctggccgtgcgacagcatgttcaggtcgggcagttggtacggggcgtccggcgccgcaagcgcagggtcgtccacattgggattcatgttctcgcccgcaccggccgatgcgcccgaggaggcatccggggacatgggggaaatcgcaccggcagcgcccgcggcgggcatcgccgcccacggatcggacgtaccggcaaccgtcgatgagaccaacctcgcactcccggccgccccgtcgggatccgtcgcatacgccggtacgcctgaggtaccggaagatgcggcaccggggtgtgcggcggccatgccggatgtcatcgtcgcgacggcatcggcggcgtgggccgccgccacgcccccggacatggcgccggacatggcgccggcagctgctccggccatcgcgcccatggtggaggacaccgtgcggggcatgacattgccgcgtgcgtccagtgatgtctcggcggcctgcccatgccgactcgccgcgtgggagaacgggtcatcccccgcataccggtcaagtgacgcgtcatccgtcttctccgcggacttgcgccggaacagacgggagaaccatccgcccttcgcgcccacggagtccgactcagtttcgtccataccgtcatgggcggggacgccctcggcgaacgccagagtctcatcgccgtcacccacacgcacctcgttggggaactgatcctgttgcgcggccgaatccggctcctgccgaggatgcagggaacgctgcgagatcatggcagcgatggtgcggacgcgatccggcacctgagtgacgtgggtgcgggtgatcatcagcagcgagaacaagccgactactacgaagacgatgacggcgaacaccttcgacaatccccatgccaaaggcgagcccagcacgaaaccaagcagtccgccggccctttgcagcaggccgatgtcgaacgaacgcgcgtcggcggccacgaccacgtcgatgatcgagcagacggaccacaacagtatcgcccagccgctcaccacgcgggggttgtcggaattcttgccgctgttgcgcatcagacggatggccacgatcaccagcagcaccggcaacacgacgctcatcacgcccagcacgccggccgagaacgcatgcagcacccggccgatgatcccgttcacgcggaaccattcggaagcgcagaagaatacggcgagcacgatcagcaggaagcacaggccatcccggcgatacacggggtcgaattcacccactccggcaaccgaccgaaccagtgagccgaagccgcgcggaaccgcgagaatgatccgcttccacagcggctcctcgaccggggtgcgggcatcgtcccccatgccgccacgcccgccggaagctctcttcccggtctcgccgccgcgcgacgaagcacgctgcgtgcgggtgccacgcggcgagtcgttggaaggaccattgcctgatgaggatgttgttcgtgccatagcgtcttcagattctacccatcacccgttattttcccgatcaattcgcgtcaaaacccgcgcgaggggcatcggcgcatgtaccatctaactatgactccagcagaacgtgcgagcgcagtcgcatttgcactcaaaaactgcgcattggaagcgatgacgccgggcgatgcgacgatgcgcgccgcggcgggatacgagcggggcgacaacgacgtatccgctctgatcgacaccgcggaccgggagacctccgggatcgtcagcggcaggctcgccgacgggagccttgacgatcatgccaccgaccacgccagcagcgtgttcgcccgaacggtgctgttggctgaacgccgttggaatccgagcggcgacattgccgagctcatcgccatccaccggggactgttcgacggcgtgttctccgacgccggacagctgcgcacctcgaacgtcacccgcgaggtcaccgacaagcggcatcaggccaagaaccccgaggcgttctttcccgcgcaattgatcgagaccggcgccttgaacatctcgaccgagcttgccgacaaacgcaacctggacaacctcgaccggggcgtgttcgtccgggagctcgcccacgtctacgacgaactgggctacctgcacccgttcaagggaggcaacgccatgacgcttcgcatcttcgcgtcccgtctcgcgcatgacgccgggtgggatctcgactggggaggcgtgacgcgcgagtcatacaagcaggcgaaacacgccgcatatcgaggtgacatcaacgccttcagccagatgttcgccgacatcgtgcgccccgcgaaccccacgcgggtcttcctgatcgccggctgggagcaggggcccgcccactgaccgaagccgcggcgactctgttgccggtcaccacggggtaccggtcgccacgggccgctctgccattactgcaggtcgcccagatgatgttgcgtatactcgtccgcctgcgcatcgatcgggtcgtaatcgcccgcgtcggcatggtcgataacggccatcgcgttatccaccagtcgcggattgagcgcatggagccaatggatgcgcgggtcacgcccgaaccatcccatctgcttgcgggcgagccgtttggtcttctgcgcgatgtctcggaacgtgtcatccagatcgcacagcccgtccaggtaatcgatgacttgctgatagcccagcgcccgcccggcggtcgctcccagatgggggcggatccgctccacctcttcgatgaaaccaccctccagcatctgcttggtgcggatgtcgatgcgctggtccagctcctcgcggggcaggtccagcccgatctgcactgaggcgatgacgtaccggtagcggggcagactggcggaatacggacgcccggtcacttcgatgacctccaacgcgcggatggtacgacgcgggttgtgggggtccatgcgcgacgcggcctgagggtccttcgcccgcaactcgtcgaacagcgctccggccccctcgctgcgctcacgttcctccagtcgcctgcgcacatcaggatcggtgccggggaacgagatgtcgtcgatggcggcccgcgcatacaggccggacccgccgacgagaatggggcggattccgcgtgattgcaggtcatggatggtggctcgcgctacctgctggaatctggcgaccgacatggcctcgtccggatcgatgatgtcgagcagatgatgcggaaccgccgcctgctcgtccgcggtcggtttggccgtgccgatgtccatgccgcggtacatctggtaggcgtccgcgttcactatctcggcccgctccccccgttccgccagcgcccgggcgacggcgatgccgaggccggtcttgccggacgcggtcggcccgacgatgctgacgaccctcggcatcgccacggacgggtttgctgaccggccttcggagcctgacgaggccgggccggtcacgttcgacgccatgtcattattcgtcaatttatcggtcatggtcacatcgttcatggtctcgttcacggtctcactcatgatgtcgtctcgcttatatcgcggtgtctgtcccgctcaccggcggaccgcatacgtctggccggcgttgacatccgggtcggcgatgaggttgtggcgaccggcatgggtgacggtcgcggtcacgaaatcaccgatctgcggcatcggctcgccgtccggcacgccgatatgcaccagcacgccggtccgttcacgaccggtgacgcgatgtgtcgcggaatccttcttgccttgggccccggtaatcatcacttcgacgtcacggccctcgaacttggcgagctcctcttccgtgatctgctcctgaagcttcaccagccggtcgaaccgttcctgcacgacctcatgcgggacctgctccatttcggccgcgggggttccgggacgcggcgagtattcgaatgtgaacgccgactggaacctcgcctgacgcaccacatccatcgtcgcctcgaaatcctcgtccgtctcgccagggaatccgacgatgatatcggtgctgatctgcgcgtccggcatcgcctcgcgcaccttgcgcaggatatccaggaacttggcggaacggtaggagcgacgcatcgcacgcaggatcttgtcggagcccgattgcaacggcatgtgcagctggtgcatgacgttcggcgtctcggccatcgccgcgatcacgtcgtcggtgaacgccgccggatgaggcgacgtgaaacgcacacgctccaatccctcgatgtctccgcaggcccgcagcagcttggagaacgcataccggtcgccgatgccgtaaccgaacgagttgacgttctggccgagcagcgtgacctccttggcgccttcatccacgcatcggcgaatctccgcaaggatgtcgccgggacggcggtcatgctccttgccacgcgtggtgggcacgatgcagaacgtgcacgtgttgttgcagccgatcgagatggatacccagctcgacaccttcgaagcgcgggcgaccggcagctgactggggaaatagtccagcctgtcggccacttcgacctggcaggtccccgccatgcgggcctgatccagcaggcgcggcagcgagccgatgttcttcgtgccgaacaccgcatccacccacggcgccttctgtgcgatcctcttgcggtcaagctgggccatgcatccgccgatcgcgatctgcatgttcggatgcgtgcgcttgaggtccgcccacaggccgatggtgccgtacatgcgttccgcggcgttctcccgcaccgcgcacgtgttcatgacgatcaggtcgacgtccttgtccgccgcctgttcctcggtcgccggcatgtatccgtcatcttcgagcacaccggcgattcgctcggaatcatgcacgttcatctggcatcccagcgtgtgcacgtaaaatacgcccttgccgcgccccgttgtggcgccaagggtcgggtccgtcaatgtggaggtgcgctccgactcggtcatcatgtcttcattcatagtcaaccatcgtaacgattgcccaagccagcaccagcgtgctgcgatttttcagttcctccgcaagagttcggctatgatggtgaaccgtgatacttgaccgacaaagccgcatcaacacgaatgacctgaaaacccgactcgatgccgcgggcatggaccgggggtctttttcaccggaagaactcaccgaattcgtgaatctcatgcaagtctacgaaggcgcgatgtatgagataagcaccaaactggagatccttgattcggagttccaggtgcggttctcgcatgatcccatccatcacatggaacgccgtctcaagtcggtgaactcgatcctcggcaagctcaagcgcaagacgctgccggtgaccgtgtcgtcgatcaaggacaacctgttcgatgtggcaggcatccgcgtgatctgcaactaccgcgacgacgtgtactccgtgtcgaactatctgtcggcgcagaacgacatctccgtgctgcgggtcaaggactacatcaagaaccccaaacagaacggctatcggtcgctgcacgtcatctatgcggtgcccgtgttcctctcatccggcgcccactacaccccggtggaggtccagttccgcaccatcgcgatggattactgggcgagtctggagcacgccctgcgctacaagaccgatctgccggacgcaaagctcgccgagcactcgcagacgctgcttgattgcgcgcggagcctgcagaacatcgagacccagatgcagaacatccaccgcgacatcaacggcgcgccgcaggtcgaggagacaccgaaagccgactaagctggtcgaatcggcccccgtcacgcatcctccgccctcgctgacgggaacggatccgtctgacggccgatcagcgggattctgtctttcttgttttccggtcgcattccccgatcgcgttcactgatcccgttttccggtcttgttcaccgccaatcgtctgcggccgacaccgggcgtctgcgcgagcacgatacccgcgaagatcagcgcacagccgaggtatccgcgtaccgtcatcgtctcgcccaacagcaatgcgccgccgatgaccgagaacaccgattccagcgacatgatgagcgatgcgcgggtcggcggcacccactgttggcctacagcctgcaacgtgtaggcgacgccgactgacccgattcccgcatacagcacggcgatccacgcctgccctgccccgttccagtccatggagccttcgatcagcgtgccggcccagctgagtgccgcggtcgtcacgaattggatgaatgacagtgtcagcgcgtcgacgcacgctcccagcgtatcaatcgacaggatatgagcggcgaacaggaccgcggtgaacagcagcaggcagtcggccagcgtcagggaaccgaagccgtccgtgatgcacagcaggtagaatccggccacggccacgcccaccgccatccaagtcatcatgcgcactgcgcggcgaaggacgagatacgccagcaacggcaccatgacgatgtagagcgcggtgatgaatccggcgcggccggccgaacagccgaacatgatgccgtactgctgcagcgtgctcgccgcgaacagaaacacaccgcatatcattccgacgatgagcgggttcgacagtgcgctgccgacgatcatgtcatgttcgtcatcgccggcctcacggttccccgcgccaaccgtcttccccgattcccggcatcgtcgcaaacgcttccacagcagcaacgggatcagcgaaatcgcccccaaggtgaaccgcgtggcgttgaagaacaacggcgacatcgatgccatgccctgcacctgggagacgaacgcgaatccccaaatcagcgaggtcaatacaagacatgccataccggccatttcctgctgcttcatgagcattcacgctagcgtatcgccgtgaccggtcccgaacgatgatggaatggtctcgctgattcgcgcgatgggcatctgaacgatgatggcccatcccgcggctgcgggatggtccatcgcatctgccgtcgtgacaatatccgtattggcggaatcggctatgacggtaccgttccagtgatatcagtctcggctgccgaacagttgaaggatgtacaggaacatgttcacgaagtcgagatacaggttcagcgcgcagatgatggagatcttcttgatcatctccggcccctgagcctcataggcgctgaacagcgcacgggtctgctgagcgtcgtacagggtcatgccggcgaacagtatcaggccgaaggcgcagatgatacgcatcccggtcgtgctgcccggaacgaacatgagcacgatctgggagatgatcagcaccaccaggcccaccatgaggatggggccggccttgagcatgtcgaatttcgtggtcaacgagaacatggtgagcacgaagaagaacgccgcgcacaggaccagggccacgccgatgtcggagatgctgtacaccaggaagatggagctgagagtgaatcccatcagcgccgcgtacacgtagaacatgacacgggcggtcgatgccttgatcttcatgatgcgggcgcccagcgccacggccagcacaacctgtacgatcgcgaatccgaagaagccgatcaggccggttgactcgatgaaggagacgtatgcgccggtcatctgcgcgacgaccgcgacgacggccgtgatgataaggccgagcgtcatctcgccgtatgccctggtgacggatgcccgttgggccgcctgcacctgctcacggctgtagatggtctgggcgttgatcgccgcagtgccgttgggcgcgtatgaatactgtgattgtccgtattgctgctgcccatatgcgggctgctgctgattgccgccgtaatagggatcgccgttgcctggctgctgtccaaatgtcatgctggctcctttgtttgcgtacgcttcatcgtaacggagaaggctgaacaaatcattaatgttcagccttgagcatcacaccagcaacgcctgcctattcgtctatttcaggtcgaacgtgtgcacgaccttccgggagtcatcgatggagaacaggtcggtcacgtcgacggtgatggtcgactcgtccttcaacacgtatcccagggtcacctttcccgtcgctccgggctggatctccgccgtatatgaattcatgtcatatccggtcggctggtcaagatagacggcggtgtccagggcctgtccgttctggaacacctggggatgcgccagcgcggcgaaggagttgttcttgcctgaattgttcttccattcgtacgtgaccatcaccgtaggcttgtcttcatagtcgttgcccgatttcgccgcggagacgatcgtgacatggaggttcttgagatcaccctcctggtcctgctcccccgatgccttggtcgtatcggtggagtcattgttcgtcggatcgttgttcgcggaaccgtcgttggaggaatcgtcgccgctctttttcgcgtcggacgacttgctctgtgacgtgccggaaccgttaatggcctcatcaatggccttgctggctgcggactgcatggccagagtgatgacgatggcgagcaccgacagcaccgccgcgacgatggaaagtatcttgcccgccttcttgccgcggaacgtccccaccatggcgatgatcgccagcaccacgccgatggcgcctaggatggccgctatattgttcacgatcgggataaagctgaggaccagccccaaagcgccaaagacgacgcctacgataccgcagatcgtggttcctttgggggtatcctgtgcgggcgtctcccccttgataccgtgcgacatagcattctccttcttgatctcggtgagttatgcaccatccacgctatcggagttcgcacgtttgcatcagtggacgaacgttcatttccgattgccctttcgggcagataagaatgaacccgcgttcgatggcgcggaaagacctgaccctgtagagtggatgccatgaatgatttctcgccccacccccgcgcgggaggaccgctcccggcgacgacgtccgacgaggacaccgtcgccgtgcgcacgcgcgtatggtgcaccgcggtgatgatcaccgtttccgcgttcatgtgcctggtgcagacttcattcgcagccacccggtacatcaataatccggtcaacgccatgtacgtctggttcatcgcgagttccctactggccttcgcgttcccgttccgggtgcttgcacgcgacaagcacccggaaccggtgttctggatctgctgcgccgtcatattgatctttccctatgatccgatgctgatgctgatggcgctcacatcgctgatcgcaagacgccgcggcaggcagcgcatcatccgcgccatcgtcgcggcgacgctggtcggggtctgggggcagatgcgcgacacgttgcgcccgttcaactcctcgatgtggcaatcggccatcttcatcaagccggattcggatgtcgcctcgggccatgccgcgatgcttgaggggaggccgaccatcatagccacagccgttgtggtggagctgatagccgtcctcatcgccattctggcgggactgtatatccggtcacgagtgcaattggacgaggccgctaccaagacccagtccatcagcgattatgcggtgagcctgcatcgcaatctcaccgatcagcagctggccgacgccatcgcagccgaagcccacgacacgctcgctcattccttgtccctcatcgccttgaacgccagtgccctgcagggcgaggcacaggcgttcatccagcttgccgatgcgacgaacccacatgagacggggcagatgctgacccccgaattgcggaatcaggcttcgcttatcgaggagaaatccgaggagattcgacggcaatccgcaggagccttggatgaggcgcattccatcatcggcatgctccgtcacccccaacaggcacgtcagcagctcgctcccgccccgcaaacgtcaatgacacgcccgtcattggacgccctgatcaacgatgcgcgctccgccggcatgcgcatcaacacctggatagacatccagcagctctccgacctcgatgagggcacagggaaaatcgcataccgagccatccaagaggggctgaccaatgcccgcagacacgccgagggtgagccggtgtctgtggaagtcacgatgaaccccgacaacggcatccatatccacatcagcaatcccatgaagcgcggtctctccgccccgaacgagcgcgagatcccatccgcaacggacggcaacggacttgccggcctgacggcacgggtgcagacggccggcgggacatgccgatacgggcacgacgaccaccatgtcttccatctcgacgtggcaatgccgtggatcgcctgtcaagccgatagaatgaagccgtgaacgattccgaacagcacgtcatcaccgtgagcgtcatagacgacgatccgctggtgtgccaggcgatgagtatgattctccgcgattactcgcaggggcgtgtctctgtcgtctccacatcaaccgacggagccaccgccgtgcgaaacgccgacagcgaacacccggacgtcgttctcatggatgtggcaatgcccggcatcgacggcatcgagaccacccgtcgtcttcgcgcgcttcgcaatcctcctcacgtgctgatcctcacatccttgaacccgtccaacacggtggaacgctccgtggaggccggcgccgagggattcgtatccaagaccgacgcgccggaggacatcatccgccgcatagtcggcatatgcgaggggaccccgcagttcaatccggccagccagagacagctcatcaatgatctgagcatgcagcgtccccagtccaggcgtgacgaggctcgggccctgctggacacgctgccctcccgggagcgcgaagccgtgctgctcgccgccgaaggctgcaccaacgccgagatcgcaggacgcatgttcatatcggaacgcaccgcgaaagcgcatctctccagtgccgcggacaaactcgacatggggcgcgtgcagatggcacggcttgtcgaacgagcggacctgtaacggcgccgtcacgcaagtcgccgccagcgcatccataccgacccgctggtacgctgatgctcagcagctaccgatgagggggcgtcatggcaatcaacgcgacggaaaaaccactgggcaaggtgttcactccggactatcagttgtccatcccatccttccagcgcgcctatatctggaaaccggagaacatcctgcagctcatcagcgaccttgaggaggcatgcaaatcaccggaaacgccgtatttcctcggttctctgattctcgtgcgggaaggcgacaccagcttctcggtcatcgacggccagcagcgtctggtctcgctgtcaatcatcatcgccgcgctgcgcgacctcgaacatgacgaggaatggatgcgtctgctggacgctctgatcgtcgagcccggagacaagctgcgcggcatcacctcgcaaccccggctgacactccgtgaacgcgacgccgcatttttccgcgaatacgttcaggaaggcaatctggaggcgctgttcgacatgaacgatgaggactgctcctcgaatgcgcagcgcaacatcatcgccaacacaaagcaggcatacgatgcattggcacagcttgacgaggaggaacgccaccggttcgcatcttatctggtcaattcggtgaccttggtcatcgtcaccaccgatgaccttgatggagcgcatcgtattttcgacgtcatgaacatgcgcggcctccccctgacgccatcggatgtgttcaaggcccgggcgatgtcaggactgcccgccgccgcggtggacacgtacgcctcccgttgggatgacatcatggatccgctgggcgatgacgccgcccgcgtggaggagttcttccggtatctgcatctcatcctcacgcacaagcccgcgacgggcaaactgatcgaggacttcctttccgacgtgctgaaccagtatctcgccggtcattccattgaggcgttcatcgacggtgttctcgccccgtatgccatggcgtggcgcattcttgagcgcccgtcggataccgtgctgccggatgatgttcgaggcaggctggaggcgctgaacgactatcggcatcatgagtggaaagccgtggcgatgtgggcgctgacgcattcgttcaggaacctcggcgaccccgaggtctcgttcttcgcccaacgtggttcgcattcggcacgggactgcggcaggacggccgacccgttggggtcgcatgaccgacagcgcttgggcgagattctgtgcgctttggaacaggtggccggtgtcgatatgctgaatcgtcggagtgccattgaccgtcgtgggcacaccgcagctgcgatccgcgatctggataagggattccctgttcgcttggtacgcggactgtccgtcagcgccgccgaccgggcaggtgccctgatcaggctgcatggcgagttgcagggagaccctgatctggtgcgtctgctgttggttcgggccaacgagcagcgtgccggggctcgcattccgcgcccgcgtgcgctggcggtcgtaccgatcatgcctctggatatcgcgtcggcggcgtcgttctcttcctggacggcggacctgcatgactattggatgtatcgtctgggcaatatggtgctgatgcaaggcaaggaggggcagatcgaccggctcacggagtacgggcgccgtcgcgaccgcgtgctgctgcgtgccgactcctgccgtttcccgctgaccaagcagattgccgacttcaacgaatgcacgccggcgatgctggaataccggcagaaggagacgattcgcctgcttgccgaatactgggacatccgttatgacgagagccatgccgatctgacgagcaaacccccggagcagctttccggcgacgcaggctcccggcagacgcgcggttcacagcgtgtcaccatcaagcaggtcgtcgccgccggtctgctgattcccggcgagactttggtatgggagcgaccgcgcaagggcgaacgttggctggtgaccgtgacccaggaggggcgcttccgtcttgaggacggctcggaatatgcgtcgcccacggccgcggcacgcgcggcaggcggtcgcagcgccggattggatgtgtggaagcgtacgtcgaacggcgaaaaactcagcgatatctggaaagcctaccgtctgcgcacccgctagacgcctggctgccagtccacgaccacggcacttcgacaagtccgccattcccatatccctcacccggccatgatcccacatcagacgacataaatgggactgtgggcggatggaagatgatgcgtataccgaaaaagtcccatcgcagtgcatgcggatgggactctggctggataaggggcgcataatacagcggcaaccagcggcaacggtccggcagtcagatgtgccgctcggcggtcactccgtgatgccgtattcggaggcgatgacccgccacaggtcctccgccgccttatcgacatcatcattgacgatggtgacgtcgaattcgttttcggcggagagttcgacatgagcggtttccagacgcttggcgacttcctcgggagtttcggtgccgcgtcccttgagccggcgaacgagctcgtcgaagctgggcggggcgatgaacacatagacgacttcgagaccgagctccttggcacgctgcttgacgcgtcgggcaccttgcaggtcgatctcaagaatggtggggacgccttcggcgaggtgttcctgaacgggcttgaggggcgtgccgtagcgggccaggccgtggaccgtggcggtttcgagaaaatcgccggcctcttccttgtcggtgaactgctggtcgtcgaggaaccagtagttgacaccattgacctcgccgggccgcggcttgcgggtggtggcggacacggagacccagacgccgggatggttcttgcgcaggatgttctcgacggttcccttgcccacaccggcggggccggtgaggacgacgaggcgcttgcgaggtgtgccatcatcgtcgggagtggccgctggctcggccggggtctgctgcagtgatgcggtaatggttcccataccgtctttctccttgtcctcgccttctttcatggcttcgtagagcgcctgccggacgtcgatggcgatggcctcggtggcttgggcaagcgcggaaatatcgggcccatgggcggcgatgaaacgggatacggtcaccagaacgttgcccttggtgcctttgaagacggttttgaggtccttggcctcggcgccctgccagccgtagcccggggaaaggatgggaccggtgaatttcgccgggtcgacaccgctgtcggcgatccactggcctatggtggcgccgatgatgagcccgaccgagcccataccgtcgatgtcgtcattgaacttctgggcagtgctggcgatgccgaacgccacggttttgcccttgaagtcgccgctctggcggatggccgtctgcatgctggcgccttcctgattggaggtcagggaggcgatgaagacgccgcgaccgttgttgagggcctcattggtgaggccccgcagtgagcgtgcgccatagtacggcagcagggtgatggcgtcggccagcagaggggcgcccggcttgaagtatgcgtccgcgatggcggagatggtggtggacaggcctccatggaggcagtccacgatggtgatgatgcccatttgacgagcggcgtagagcactcgttcgagcgccgcgaatcccttggacccgtagcgctcgaacatgggctcctggaatttgacagcggcggcgcgatctcgcatggcctgaagcatgcgcatggagaacagctccgcgccttccgcgtcgacgttatacccccagtcagtgaggtttttcctgtgcgggtcgatgccgacgcacaaggggccgtactgggccatcgaactgctgaggcgcagtccgaaatccgaccgcatggccttgatttcttcctcactgctggcgtgtgtcatgattgctcctggcctaacttattcctggctctccaactcgaacagctgcttggcgtgctcctggatgctcatgatctggtaatcgttgtgcttgacggcttcgatggccatcagcacggcggagaactcggtcatggtggtgaactggggcaggtcggccgcgatggccgcagcgcggatggaatatccgtcggaacgcgatccccgggaattcggcgtgttgaggatcatgtcgatcttgccttcttcgatgagctcgaccacgttctttccgatgccaccgacggcgtgctcgaccttgacggccgcatccgggtcggagtcgacgcgggtgctgatcttgtcgacgatcttcgagtcgatgccgtaacggcgcagcacggacgcggtgccctccgtggcccagatggagaatccgagctcgaccagacggacggccatcagcggcagctgccgcttgtcggtgtcgttgacggagatgaagacgttgccgctggtaggcagtccgccgtcgtatgcggcgagctggctcttggcgaaggcgtgcgggaagtcacggtcgaagcccatgacctcgccggtggagcgcatctcgggtccgagcaggatgtcgacggtcttgccgacgggcgtgcggaagcgcttgaacggcagcacggactccttgatggcgacctgctggccacggtggatgtcaccgccgtcgcccttgggcaacagcaggccgttggcccgctgatcggcgatggtctcccccgccatgatgcgggcggccgccttggccagggccacgccggtagccttggatgcgaacggcacggtgcgggaggcacgcgggttggcttcgatgacgtacagcgtgttggccatgaaggcgtactgcacgttgatcaggcccttgacaccgcagcccttggagatggcgtaggtgccttcgcgaaggcgacggatctggtcgtcggacagcgtactcggcggcagcgtgcatgcggcgtcgccggagtgcacgccggcctcttcgatgtgctccatgatgccgccgatgtacagctcttcgccgtcgaacagggcatccacgtcgatttcgatggcgtcctgcaggaacttgtcgatgagcagcggggagggcaggcgtccggacacgaccgtgtcggccttggcctcgtcgagcgcacggttgacgtacttggtcaactgggcgtcgtcgtagacgatttccatgccgcgtccgccgaggacgtaactggggcgcacgagcaccggatagccgatgttgtgggcggcctcgcgggcctcttcgagcgacagcgcggtgccgtagcgcggcgcgttcatgtgctcgcgacgcagcacctcaccgaacagctcgcggttctcggccaggtcgatggactccggggtggtgcccaggatcggcacgccggcggccttgagtcgcgcggccagcgacagcggcgtctggccgccgagctggacgatgacgcccttgaccgggcccatcttcttctcggcctcatagatctccagcacgtcctcgaaggtgagcggctcgaagtacagccggttcgacatgtcgtagtcggtggagacggtctcggggttgcagttgaccatgatcgtgtcatagtccttgccgagctcctgcaccgcgtgcacgcaggtgtagtcgaactcgatgccctgaccgatgcggttcgggccggagccgaggatgatgacggcctcgcggtcgcgcttgcgcagctcggtctcgtcggcgtagcaggagtagtagtacggcgtgaccgcgtcgaactcggcggcgcaggtgtcgacggtcttgtagaccgggcgcaggccgtaggtccagcgcagctcgcgaatcgtgttctcgccctcgtcaccgagattgcgcaggtgggcgatttgcaggtcggacaggccggcgagcttcgccttcttcagcagcttggcggtgagtttctcggcgtcgcgcacttccatcgcggtctggttgatgagggccagctgcttgacgaaccacgggtcgatcttggtggcgtcgaagatctgccgttcggtggcgccgccccacagagcgcgctgaatctgcagatagcggtgctcggtcggcacggtgatggccttgagcagttcggcgacctcggcttcgtccggcttgtcaccatcccagctgaagcccatgtggcgcttgtcgatggagcgcatggccttgcccagcgactcctggaagttgccgccgagtgccatggcctcgccgacggacttcatcgacgtggtcagacgcgggtcggcgccggggaacttctcgaacgcgaagcgcggcaccttggtgaccacgtagtcgatggtcggctcgaaggaggccggcgtggactgggtgatgtcgttgcggatctcgtcgagggtgtagccgagcgccagcttggtggcgatcttggcgatcgggaagccggtggccttggatgccagggcggaggaacggctcacgcgcgggttcatctcgatgacgatgatgcggccggtgtcagggtgcacggcgaactggatgttgcagccgcccgtgtcgacgcccacgccgcggatgatggcgatgccgatgtcacgcagcttctggtattcgcgatcggtcagggtgaagcagggggccacggtgatggagtcaccggtgtgcacgccgaccgggtcgacgttctcgatcgggcagacgaccacgacgttgtcgttgcggtcgcgcatcagttcgagctcgaattccttccagccttcgatgccctcctccagcagtacctcgtcggtcggcgagtaatgcaggccggcgccggcgatgcggtgcagctcctcctcgtcgtgcgcgatgccggagccgaggcctcccatggtgaagctcgggcgcaccaccaacgggtatccgagttcggcggcgacggcgtccacttccttcatggagtgggcaacttcggagcgcgcggattcggcgccagcctcgtcgacgaccttcttgaacagctcgcggtcctcgccgcggtcgatggcgtcaagggaggcgccgatcagctcgacgttgtacttcttgagcacaccggcctcgccgagcgacatcgcggcgttcagtgcggtctggccacccaaggtgggcagcagggcgtcggggcgttccttggcgatgatctgttcaaggatgggcgtggcgatcggctcgatgtaggtggcgtcggccatctccgggtcggtcatgatcgtggccgggttggagttcacgaggatgacgcggatgccctcttcgcgcagcacgcggcacgcctgggtgccggagtagtcgaactcggccgcctgcccgatcacgatcgggccggagccgatgaccatcactgacttgatgtcggtgcgtttaggcattgcggttttcctccttggacgtcttcatcagatcgacgaaacggtcaaacagatatgcggcgtcgtgcgggccggccgccgcctcgggatggtactgcacggagaacgcggggatgtccacgcactgcaggccttcgaccacgtcgtcgttcagatcgatgtggctgacgaacaccttgccgaagtgcccgttgtcgaacggggcgtcgatggtctcgccgataggcgcgtcaaccgcgaagccgtggttgtgcgcggtgacctccaccttgccggtggtcaggtccttgacgggctggttgatgccgcgatggccgaacttgagcttgtaggtgccgaagccgagtgcgcggccgagcagctgattgccgaagcagatgccgaagaacgggtagccggcgtccaggaccttgcgcagcagctcgacctcggggtcggcctgctccgggtcgccggggccgttggagaagaacacgccgtccgggttcagcgcggtgagttcctcgaaagtgatggtggacggcacgacgtgcacgcggcagccgcgctcggccatgcgatgcggggtcatgcccttgactccgagatccacggcggcgacggtgtagagcggctccttgccctcgtactcgccacacggctcgaccgtatacgtctccttggtgctgacctcgtcgtacaggctcagacccttcatctgcggggtggccttgacctcgtcgatgagcgcggcgacggtcttcaggcgtccttcgtcgtcgagcagtgcgtcaccggagaagattccggcacgcatgacgcccgcggagcgcagatggcgcaccagcttgcgggtgtcgatgtggctgatgccgacgatgtgctcggcgacgagatcgtcgtcaaggctgcccgtggcccgccagttgctgacggtggggctgggatcgcgaaccacgtatccggccacccagatacgggaggattccggatcctcccggttgattcccgtgtccccgatgtgcgggaacgtctgcaccacgatctgccgatcgtaactgggatcggtcaaagtctcctgataaccggtcatgccggtcgcgaacacgatctcgccagtggtcttgccgatcgcgccgtaagagtcacccacatacacttgcccgtcctcaagtacaagcacggcgtcatcaggggcaaaactcacggtttcggaatcaatctggttcaccaaaacccccttattttctcaggatattcgtaccaaccttaactgtcggcggggacgcgccccaccggcaattcggctggtttctcgtcatttacttgtggactcgccgtcctgctggccggcttgtggatcggacgtctgctcggatgcagcttcggcaacgtcatcggatacatcgtcgaacgtcatgtcgtcgaaatcgacgccgtcggcgatgtcatcgtcctcggacgcttcggaatcgccggtttcggcttccgcatgcgacgcttcaccggcaggctcaccaggctcatgaccgtcgtcgctcggctgtgcgtcgggctcgtcgttttcggggtggagaatggcctcgcgtccttcggtgtcatcgcaaatcgcgctgagcaggccgtggatgaacgccggggagtcgccgtcgctcaacgtcttggccaggccgagcgcctcgtcgatggccacgcgatcgggcacgtcgtcgttgaagatgatctcccatgcggcgatgcgcaggatattgcgatccacgacggccatgcggcgaaccttccacccggtggaatgctcgttgagcatgtagtcgatctcacgccggtgatcggcgacgccgcgcacgatctcgatggcgtagtcgggaagcggggtctgcgcaccaggctcttcgatgcgctcagcaagaagggacaggaaatcctgtcccttctcgtccgcctcatacaacgtgttcagagcccttttgcgagcggtggaacgtgccatggaagcctgttgtccttactctcagttctcgcggccgaggtaggagccgtcgcgggtgtcgaccttgaccttctcgccttcgcccacgaacagcgggacctggatctcggcgccggtctcgacggtggcgggcttggtgccggcgttggagcggttgccctgcaggccgggctcggtgtgggtgatggtcaggatcacggaggccggcagttcgacgctcagcggggtgccgtcgtggaacgacacgacgcagtcggtgccttccagcaggaacttggcctgatcgccgacgagggtcttggggatgtagacctgatcgtaggtggtcatgtccatgaagacgaagttgtcgccgtcctcgtaggagtactgcaggttgcggttgtcaacggtctcgaactccatcttcatgcccgcgttgaaggtcttgtcgacgatcttgccgctcagcacgttcttgatggtggtacgcacgaaagctggacccttgcccggcttgacgtgctggaacttcgtgacggtccacagctggccgtccaggttcaggacggatccgttcttgatgtcattggtagtctgtgccacagtaactcaccttttcatgttttcaatttcggcaaagctcaaaaatagccttgtctattatgccataccgtctatacagcgcgtcgcggccgaacaatcccccaatggcatcttccggctgcatcagctgttcctcatgcaattgaaacggaacaagcaatagtggttaacgacaattcacctaatgacttagtagctgaataacgaacataataatgacaatgacgacatgtcggctgaaccgataggagacaaccgacatgacgccattctcacgtaatcaatcgatgcagtttatagtgttgatgcaaagaacggaatcaagcatgtggtctgaaacacgaacctgcggcgcgaagatacgcgtcgcgcactcattgacgtctggcagtaattctatgcacaggcaatgcttcgcctcaacatatccttcctgcctagtcgacttacttggtaacgtctcgacttcggtatccataatcattcgcctcctttcactaacatagtgttgccgcatttattacaccgctgtgtttacagacaaccagtttccggccttcttctggaagttacatgtctcgcttcctcctcgcgactacgaaagacacattcaatcaatagttgacttcctggtgatgagaaaagccgatttcaaattgccggatatgacgttccctcaaatactattcaacagcaattggaatcgtgcatacaatatctgacgttcaaaagggaagccctcatcccctatgggtggaacgatacagcagagcatcctgtatatggagatgacgtcaacagtctcttcgatgtaatcgaactattcatatcaacagaaagaagaaaaaaccgtgactgaaaaacgtcaggaaaaagaatcaacaatctcaccatggagggtgagggattaccggtcctggttcgtggctgacactgcgtcagcactgggaaccacaatcggcggatttgcgttcacgctggtggcatatgcggtaagccatgatgtaactacggcaggtatggtcggcaccgtgttcgcactgtgcgaaggtttgggaacacttccaggcgggcacctgtcggatagaatcgatcgcaagaaactcatgattgttttcggtcttatatcggctgcaacactgtgtgtgatgacatcggccctggttgcgaaaatgatgtcggcccctctgctattcctgtttgccattgtacggggactcacttccggtgtgttttccaatgtgtccaatatcatcttgcctcaaatcgtcaccgggaatcagctggtgcaagcctattccgcgaatgaatcgcgcgatgcatgcatccaattgttctccaaaccgctgtcagggttcctgtacggattaggccccgagattccattcctgatcagcgccgtcctgtatgcgctgatgtccgttgcgactccgctgattcgttcggatctacggcccaagaacgacgcctccccatcggattccgatgattccacgaagaaaacaccacgaaaccacattggcggcagttcatcgcattcatcgttgatcgaaggctttgcatggtacacgcgatggccacaagcagtatccgtattcagcagtgtgctcttgttgaattgtgtcctcaccctgatggtcagcattgtgattctgaatcaacagatgctgaacattcccggctggcagattgggctcatctcaaccggaagcggtgtcggactgctgagcgggtcgtttctgaccactccccttgccaaccgtctgacgggaggcagaacagtacaagtctccttcatcatcatcctggtaggatgcgctttacagccattcacccagaatacatatctactggccggatgcatggcgatcatgaatctcatggtcgttcccgccaattccgtccttggtgcctacgcgtcgctgatcattccgaatgatttgcgtggccgcgtgttctcagtgttctccttgtttaacatcacgcttgcctcattggcgtccggtattgcgggaatcatgctttcctctctggggtacatgattgcggcggcgaccaccgccgcaatcatgacaggtaccgtattactggccttcatgagtaacggtattcgtgaaatacctgacaaggcggctttctcgaaccttgaaccgtggcgctgactactctcgcgatatccgcagccgcctacccgcaatgaggacgagccccgacgtgagagtcacagccgcgagcatgaagaccgccgtcacggccgcgcccgtgtgagccagccggacggtcgatccgccgagacccgcacctgaaggcctctgaatagttgcaccatgctgctgcccatcgccgttgctcgggtcggcgacaaacactgaccggtcgatctgcacgttgacgattcgcgtcgtctctgtggtgtcgaagttgtcgtcggtgagcaggctcagatcgagccggccattgtcgtccgtatgggtgatgaccagatcctcgaagttgtcaagcaacgggttggcgtccatgtattgcgcattcggcttgaactgggcgccaagggtcagcttgccgccgaaatcggcgagttccgtgaccggcaggaacgacgagtcggcgctcttcgacagcgacgcgacatcggagacgtccggggcggctgcgatgccgtgcgcatacgcaagctttatgccgtacccatgggtctggtcccaggagcgttccagcaccaggaatccgtcctcgccaatcgccgcgaactcggtgatgcccatgttcacgtcggcggccttgaacgccacctgcttgacgagcttccactgtcccttggcgcctttcacgtcgtcacggtagaccagcgcgcggcgggctatggtggcgatgtccttgccgctgggcgaatcgttcttgagggcgtactcgttgccgaccacgatctcatggccggacggcgataccgtcagcgcttccaggctcttgttgtgcacggcctgtcccctgcagttgatgtcgaacagttcaggcacgggcaactcgtccttctgacggccgtcgatgccgaagatacggatcttcggctgctcatgctcgccttctgccgcgttcggatggccttcggaggtgagcaggaagtcgccgttcggcagcacgccgagcccctcatcatcagtagtttcgccgttgtatggcgtaccgttctcatcggtcaggacgatgctgccggtcggagccgccttgtcgagatcgttgcccagcagccataggcgagcgacatcggtaccatgattgtccattgcggacacatattgtccaagcttcctgttgtacgccgtcgaggacagtccgccgaacgctatcggctccgacgtgccggtgccgtcgctgaatccgttagccgaccagtagtcaaggcgatcgtttctgccgagtgccgtgacgtactgtgacaggcgaccgcttgccgagtcgtcgaatcctgccgccgtcttctggaacggttccgcttcgacgtcgaggatgcgcgtggtctgggtggcgctgtagttgtcgtcgctgatgatggagatagcggccttgtattcgccgtcaccgcgatgccacgaggcatcgggagtggcgagctggtcgaggttcgtgatgacgagcccttcgtagttatccatcagagggttcgcctgatgagcgccgggtttcgcggaggcgcccagatccggcaacttgtccagctcgccgatctggcgggatttcacgaactcggatgcattcttcgggtcgttgaggttcgccacaccggaaacatccggcgcgctattcagcccggagacgtacgagagtgccaccttgttgccggtctcgctgttccatgaacgttgcaggacgtacagggagtcttcggaatcgaggacgatatcggagatgtccagtcccggtaccgtgtggaagcccacctgtttgacgagcgtccactggccggccttgcccgtcacgtcgtcacggtatacgaggaagcgccgcgcgtcgctccggttctggtagacgtcagacttgagcgtgccttccatggccgatacgagttcgtgccctgtcggagacaggctcaatccttccagcgtaaggttatgcgacgcctgacccttgggcgtgttgatgtcgaacagctgcggaacctcaagctcccccttctgccgcccattggcgtcgaagatcctgattgtcgggtgttcggcctgattcctgcccgcagggggaatgccttccgagctgatggcgaaatcgccgtcgggcagcaccgctatgccctcgttgtccgtcgtgttgccgttatagggagtcccgttaacatcggtaaacgtcaccggatcacgcgtgatggacgggttgtgcaggtccttgccgaggaaccacacccgagattcgtcactcccatggttgtcggattgcgccacatatgaatccgcggttttgtcccacgtgagacccgacagtcccccgactcgaatccccttataatcgagcttgtccagcgcatcgctgtaggcaacggccttgacctgattctgtgcgccaatatcagtcgtaccctcggctgataccgctggaatcatgacggatgcgaacagcatgcatgccgtcgccgtcaccgcggctattctcttgttcatgattttcccttccgaacgtaccgttcacatggccatgctggctctgcaaggtatcgggaaggggaataatcacgcgtctgcagatgaacgatacatgaaaagacggcgacatcgttgtccacctgtatggaattcgcctgtatgggtccctggaatacgaaagtgggtcctgaaacctcaagcaaggtttcaggacccactcagaacgctagttcaagcgtgtcgagttcttcgctgatgggaatcaggcgaggatcttggtgacacggcccgagccgacggtgtggccgccttcacgcacagcgaaggtcaggccctcctccatagcgatgggctgaatcagctcaacggtgaaggtcgcgtggtcgccaggctgaaccatctcgacgccttccggcagctcgatgacgccggtgacgtcggtggtgcggaagtagaactgcggacggtagttggagaagaacggcgagtgacggccgccctcgtccttggtcagcacgtagacttcgccctcgaacttggtgtgcggggtgacggagcccggcttggccacaacctggccacgctcgacgtccgtacggttgatgccgcggagcagcagaccggtgttgtcgccagcctcgcaggcgtccatggtcttgtggaacgtctcgatggaggtaacggtggtggtctgggtcgggcggatgccgacgatctcgaccggggtgttgacggccagctggccacgctcaacacgaccggtgacgacggtaccacggccggagatggtgaagacgtcctcgataggcatcaggaacggcttgtccagatcgtgaaccggggtcgggatgtactcgtcgacggcatccatcaggtccttgacggtctggacccacttgtcgtggtccggagcgtcatcgtgcagagcgccgtaggcggaggtacggatgaccgggcagtcgcggtcgaagccgttctcgtcgaggaggtcacggacctcttcctcaacgagctcgatgagctcctcgtcctcgaccatgtcgcacttgttcagggcgacgaggatacgcgggacacccacctgacgggcgagcagaacgtgctcgcgggtctgggccatcgggccgtcggtggcggccacaacgaggatggcgccatccatctgggcagcaccggtgatcatgttcttcacgaagtcggcgtggcccgggcagtccacgtgagcgtagtgacgcttcgcggtctggtactcgatgtgggcgatgttgatggtgataccacgctgctgctcttcgggagcggcgtcgatctggttgaagtcgtactcagggttcagatccgggtactcttcgtgcagcaccttggagatggccgcggtcagggtcgtcttaccgtgatcgacgtggccgatggtaccaatgttaacgtgcggcttagtacgctcgtacttttcctttgccatgtaattgtcctcctggacgtctcgtgtagttggcttgcgcttgcggcacaagacactcgctacattgtactgggtttctgggtttcttgccactttggagccagaacccagtcagcggtatatgattttaccgctgactggagacacttacggcttcaaaacagctgcgcgtgtcactccccgcgctgggccttgatgatctcgtccgagaccgacttcggcacctcggcgtaagagtccatctgcatggtgaacatggcgcggccctgggtcttggaacgaaggtcgccgatgtagccgaacatctcggacagcgggaccttggcgtcgatgaccttgacgccggtggcatcggtcatggactggatgttaccacgacgctggttcagatcgccgatgacgtcgcccatgtactcctccggagtacggacttcgacggccatgatcggttccaggatgacgggcttcgccttgggagcggcttccttgaacgccatcgaaccggcgattttgaaggccatttccgaggagtcgaccgggtgcatctggccgtcgtagaccgtggccttgacgccgaccaccgggaagccggcgagcacgccggattccatggcttccttgacaccggcctcgatgggtccgatgaactcggcgctgatgtggccaccagtaaccttgttctcgaactcgaaggtctcgccggcctcggtgtcgaggggctcgaagttcatgaacacctttgcgaactggccggaaccaccggtctgcttcttgtgggtgtagacctcgttgagcacgggcttgcggatggtctcgcggtaggcgacctgcggcttgccgacgttgcactcgaccttgaactcgcggcgcatacggtcgacgatgatgtcgagctggagctcgcccatacctgcgatcagggtctggccggactcttcgtcggtggtgacctggaaggtcggatcctcgtcggagagcttcgcgagggcgatgcccatcttctcctggtcggccttggtcttcggctccacggccacctggatgacgggatccgggaaggtcatggattcaagggagatcggggccttctcgtcgcacagggtgtcaccggtggacacgttcttcagaccgacgaacgtgtagatgttgccggcttcggcggcgtcgaccgggttctccttgtcggcgtgcatctggaagatcttgccgatgcgctccttcttgcccttggtggagtcgagcacgttgtcgccgggcttgacggcaccggagtagacgcgcacgaacacgagcttgccgtagaacgggtgggtcgagatcttgaagaccagggccgcgaacgggtcggaggtcagcggcttgcggtcgatctcgacggactcgtcgcccggcttgaagcccttgatggacggaacgtccttgggagacggcaggaagtcgatgacggcatcgagcatcggctgcacgcccttgtccttgaacgcggaaccgcacagaaccgggtacgccttgcgctcgatggtgagcttgcggataccggcgcggatctcgtcctcggtcagttcgccggactcaaggtacttctcggtcagctcgtcgctggcctcggcgacgtcgtccagcagctgagcgcggtattcctcggccttgtcctgcaggtcggcggggatgtcgacggtgtcgtagtgggcaccctgatcggtggagacgtcgttccagacgtacgccttcatgcggatcaagtcgacgacgccggcgaagtcgttctcagcgccgatcggcagctgcacgacgagcggcttggctccgagcttgtccttgatggtctgcaccgagaagtagaagtcggcaccgagcttgtccatcttgttgatgaagcagatgcgcggcacgccgtacttgtcggcctgacgccacacggtctcggactggggctccacgccttccttgccgtcgaagacggcgacggcgccatcgagcacgcgcagggagcgctcaacctcggccgtgaagtccacgtggccgggggtgtcgatgatgttgatctggaacttttccttggtgtcgtgggactgacggttccagaagcaggtggtggcggcggactggatggtgatgccgcgctcctgctcctgagccatgaagtccatcgtcgaagcgccgtcgtgggtctcaccgatcttgtagttcttgccggtgtagaagaggatgcgctcggtggtggtggtcttaccggcatcgatgtgtgccatgatgccgatgttgcggatcatgcgcagatccgtaagcacgtctagtgccattgctgttccttgctctcgatctcgaaattaccagcggtagtgagcgaaggccttgttggcctctgccatcttatgagtatcctcgcggcgcttgacagaagcaccgaggccgttggaggcgtcgaggatctcgttggcgagacgctcggccatcgtcttctcgcgacgggcgcgggagaagtcggtcagccagcgcagcgacagcgtgttggcgcgggcgggcttgacctcgaccggcacctggtaggtggcgccaccgacacggcgggaacgcacctcgagggacggacggatgttgtcaagagcacgcttgagaacggcgaccggctcctggtcggtcttctccttgaccatgtcgagcgcggagtacacgatgtcctcggcgatcgacttcttgccgtcaagcagaatcttgttgatgagctgggccacgacggtcgagccgtagatcggatcgggcagcagctggtgcttcttagcaggtcctttacgtgacatttctcttacttcgccttctttgctccgtacagggaacgaccctgcttgcggtccttgacaccctgggtatcgagcgcgccacgcacgatgtggtaacgcacacccggcagatccttgacacggccgccgcgcacgagcacgatggagtgctcctgcagattgtggccttcgcccgggatgtaggcggtgacttcgatgcccgaggacaggcgcacacgagcgaccttacgcagagccgagttcggcttcttcggggtggtggtgtagacacgggtgcacacgccgcggcgcagcgggctgcccttcagagccaaagtcttcgacttcttcggctttgcctgacgtcccttacggacgagctgttcaatagtaggcaacttgaattctccgattcagtggtttcttccttttcgtgaagccgccgcactgcagcccacgcccacgaccatgaatcgtcataagcagccacagtccaccggcccgatggcccgtatctctttcacagtccgcattgctgcgcgcgatccaatcaagatccgggatatcccagcgcgtgctcctatcacataaggcgcaccactggcacacacaagtatctatattacttccaccgcggacaacgacacgcttgtcgtgacggcagacaagacaggcagataaacgaaaaccctccgcatgggagggttttcagtggggtggataacgcggcttgaacgcgcgaccttctgaaccacaatcagatgctctaccaactgagctatatccaccatgtgagtcattccagcgaactggattaccgcaacagagggatactatacacgaaatatcaagccgcgtcaccgcggcgtgtcgcgcagccgcccagtatcattcactgcgcgattttgtgcgtttccacctcgacagacgggcgatatgttcacttctgtgcgattttttgggcacatgaaaacacctgcaaacattatgtttttacggctttcaaacttgaacttgttcgtttccataggtataatgaaacacgaaggccggagttgttatcatcaggggaatcctgttgattgcaatgaagcgcacaaagcagtagcgcaacgtcttcacgataattaaataccgaggcaaacagaaacaatgcagcacgcaagcgaagcagtgcgaagcgacacgatgatgagtacgccatcagaagacatcgccatacggcaacgacatcatcgttcggtgacacagtgtggagcgtattacgctgagcagctcagcctgagatatccgcggtagttgtgagccgcagacgggaagagtacaacagcgaagaggcagagaatccgcagagccggcaacgcagctacggccgcagttgacgaggaagcggcacaatgccggctctgctgcaacgtgaccacacctttcataacagaagagactcctttcgcaagggcgccggatgctgatccacatccggcgcccttgtttatggcgcgcggtctgcggaacgcggcctgcgtcacgcggccgtacatgacccatgcgcggtacactcgctacataccctgatgcatccgcaccacgacacagcgcgacaaggagccgacatgctgtctttcggaaacgattattcctatggggcctgccccgagatcctcgaccgtctcgcgcggaccaacgacacggcgttccccggatacggcagcgacgcggcctgcgaagatgccaagcgcaggatccgcgaagcatgcgaggcacccgacgccgacgtgtggttcctcgtcggcggcacgcagaccaaccagatcgtgatcgacaccatgctcgccccgtacgagggcgtcgtcaccgttgattccggccatccgaacgtgcacgaggccggcgccatcgagtcgaccggccacaaggtgatcacgctcccccatcacgcgggcaagctcgacgccgccgagctcgacgactattgcgccaccttctatgccgacgacaaccacgagcacatggtgttccccggactggtctacatctcgcaccccaccgagtacggcacgatctacggcaaggccgagcttgaggtcatcgccgagaccgcccaccggcacggcatgccgctgttcgtggacggcgcacgactcggctacggactgaccgccgccggcaccgacgtgacgctgccggacctcgcccgcatcgccgacgtgttctacatcggaggcaccaaggtcggcgcgctgttcggcgaagccgtcatcttcaccaagggcaatacgccgaagcattttctcacgcagatcaagcagcacggcgcattgctggccaaaggttggctgctcgggcttcagttcggcacgctgttcaccgatgacctgtacctgcgcatcgcagccaacgcgaaccggcaggcggaccggatccgcgaggcgctgcgcgagcgcggctacacactgaccttcgaggcgccgacgaaccaggtcttcgtcaccttggaccatccgaccatcgaacggctgcaggcccatgtacgcatgggcttcatggagaaggccgacaacgagcatacggtgatgcgcctgtgcaccagctgggcgacgaccgacgagcaggttgaccagctcatcgcgttgctgtgaacagccgcgaggccgacgccgggcctaggccttcgcgtcggcgatggcctcgcgctccatggcgacgaacttcgcgaccgacgcctcgaccgaataatcggccttcgcgtgttcggcataccgtccgccccaaacggccagctcgtgcggatgatcgatccaccaatcgatgcgccgggcgagcatcgccacgtcgcgagccgggaacagggactcgtccaacaacgcgaactggctcgccgcgctcaactcggcggatgcgatcacaggcaccagccccgacgccatgccctcgatgacgctcaacgattcgatgtccacgatcgacggatgcacgaacaggtcacatgagcgcagcagcgccggcatctcggcgttcttgtggaacccgatttgcgccttgcgctccagaagccggtcggcgcggaaccgcaggtaatgctgcaacggcccggttccgcagatgatcagttcgatgtccttcgcgtgacggcagcgagaaatcgccttgatcaacgtgatctggtccttctcatgggaaagacgccccgaggcgacgatgcggaacggcaccggcgcgggggctccgtccgaacgctgccgtttgggggtgaaccgcggcacgtagccgtttgatatcacgtgcagcttcgccttgtacccgtgcgcgcgcaactgtccggcgatcatttcggtgggcgcgtggatatggccgatgcgccggtacagccagaagcggaacagggcgtacagaaaacccgacatcccaggcaggtatttcagcggaccggccgaatacatgacattctccggctggaggtggaatcccgcggtcacgggaatacccatgctccgcgcgaccttgtacgcgcaccgcccgaacttgaacggcagatacagatgcacgacatccgctccggcgaacgccgcgcggaacagcgtatcgcttggcttggcgaactgcatctgttgtttggcggccacccaggagaccagcggcaccttgttgacccgtgccggatattcgggggcgccgatgccgacgagtctgacatggtgaccctgccgctccaattcgtgcgcatactgcaatgcggagttcgacgtgccgttgcccttgttgccgatggtgtccatgaccagcacgatggtcagggggcgatccaaagccgacctgtcctgggggcgcggttcttcgttcttgttgtctcgcattgtttcatcctatctcgcagtctcgcgaatcacgaccgagacgcgcacggtggccggccgcatgccttcgccgcatgtctccatggccgcgtcctcgttgacgcaatgtactcggcctccccccccctgaacgttggcccggcgcgggttaaccgcccggtaagaactattgtcacgcgggcggattgccgacgcaagcgtccggtcatacgggaaatccatgaccgcctatcatgacgaacgatgccgacgtccggaggatgtccggacgtcggcatcatttaccgacacgccgttcctcgagccgtgcgatacgtgcccggagaacggtttgccgtcaggactcgcgcctcttgcgccccgtcagcgcgcagccggcggccatcatcgagaccgcgagcacgccgaccggcacgatcgaggcgccggtcgcggcgatggactggttcttgtccttgccggcgttcttgtcggcatccttgtcggtgttcggcttctggccgtcgcccggagtcgtcgtacccggctcgtcgcccggacccggattcgggttgggatccgggtcaggatcaggcttcggcgtcgggtcaggatcgggttcaggatcaggcttcggatccgggtcgggatcggctttctccgccaccgtgaccgtcaccgaggccgtcaccgacggcaccgcgacggatgcgacggtgactgtggccgtaccggccttcagcgccttcaccgtgccgtcctcgccgacgctgaccgcgtcacctgcgaccgtccacgtgaccgactggtcgacggcatcctcgggggtgaccgtgacaccgagaccaacgctctggccgacggtcatgtccagcttgccgtccttgactccctcgccggtgacggcgaggccggtgacctgaggcgcctccggcatctcatcgccgacgaaccgggcgtccgcccaatccgcgtgatcgccccacgtctcgctgcccgcgccgacggccagcgtgatggtcttggcgccttcggggatgtcgacggagaccttcgccatcggcgtgtcgtgctgcatcgccgtcttctcgaagacgacctcaccatcgatcatcacctggaagtcgacatttgcgtggtcgcggtcgacgccggtcagctcgcggtccacgccgacgtacgcctcgaagcggatcgccccgagatcggacacgtcgtacacgatgcgcgaggccgcgtgggtgccgatgcccttgtcgaacgtctgctccttctcgccgtcccacagcgtgatcgtgttgttgccgcagctcttgtccttgcgcaccgggttggtgttggggtcgccggacgtggccgactcccacgccagatcggaggcgtagacgctgtccgtgccggtcacggcaaccttataggagacggtgctgccgccggacgtgacgtccagctcgaacgtgttgtcgccctggtatacggtgacgtcccgggtgaggcttccctgctgcgcatcgccgactgggaccctcttcgagccgttcacccgcatcagctgcaatgtggcagtcgggtcgaaggacgaggcgacgacctgcgtcttggagcgcatcgtcgacgccgtatactgcaggcgtccgtgctccaccgagatggcgttgccaccgaccgacagcgctgccagacccgtgtcaacgccgccaatgcggtcgatcacgaaacggtaggtgttggcggtgatgccgtcggtcgcggtgaccgtggcttcgatgacgttgcggccacgcgccagcttcacgtcggcgcccgcggcgtcgatggccttgccgttcaacgtcgccttgacgctggcatcggcatccgtcgccttgaacgccgcgcgtgcggtgagggccgagtccgcgccgaagtagtacagcgtgcccggcttgaagtcgaacgacttggacaggccgtcgatggtggcggacgacagcgtggccaccgaggacgggtgcccgtccagcgggtcggcggacgtgccgggggtcggcgccgtggcggtcgaggcgctcacccgtacgttgacgacggagccgggcatacgccgggcgccggcgatgacgtaggtgcggaccgttgtctcgccttcgccgaccgcggtgatcgtgccgtcctggtcgaccgaggcgaccgccgcgtcgtcggacacgtacgcgatgctgccggtgacggggacgagaccgtccgcgccgaccttggccgaatcgtcgctgacgttcacctcggaggcacccatattggccaggtcgataccggccttgacgccgacgtcgtacgtgttgccgccgaacacgacctgcttgcatccgttgagacggaacaggcgcgatcccgacacctggctcaccgacgcggtcgcatcgattcggcgggtgtctccaacggcgagcgccacgtccgcgtcgccgcccagcgtgaccgtatcgtcggggttctcacggtagatcttgttgtcgcggaaggtcaggtcgctgacgctcttcgcgttgagcacccggttgccattgacgtagaaggtgttgccttcgatcgtcatgttcttgtgcacggtgtcggtggtggacacggtcgggttcgtcggctccaccaggatcgcgtcggatccgctgcggcggaacgtgttgccgcggatcgtcacgtcgcgggtcgggccggattcgtaccagctctgcgcatcgttggagatgtagatgccggccatgcccatgccgtcgaacaggttgttctcgatggtcaccttcttgcgggtggtgaccaggatgccgcgggtcggcgtctccttgaagacattgtcgtggatgttgacctcgggcgtgtacgtgatgttctccaccacgtggctgttgaccgcgacggcggaggggatggcgctgtcgagcgtgaggacgatgtcggtcaggctgcccgaccccgcgcccatgtcaccgccctggccgtcgggcccgtcgacggcggtgacggtgcgcacggagtcggagaccgggagcatgtcgcccttggtcatgaactcgacctggtcgccgacgaagaacgacgggaatccagcggtctcgttgtgcatgtagcgcaccttgatcttggtgtcggagatcttctccaccacctgcaggaaggtgccatgcacgttgatcgggtcgtcatgcgggttggagaagctggagttcgcaacggtgatgacgcccctgcagcccgacatctgcacgaagtcggcgtatcctgcggtgctgcggccggtgccttcgccggtaccgaagtgcagcccgtccatcgtgatggtgtcggtcgactggccgaccacgccgaagccgtgcaggaagcggaagtcgatgcccttgagcgtgacgtccttgtccttccacaggaacacgcccgggtggtctcgcgtggtctgtcgcatctgatagctgatgcccgtggcgttggcgagcttgtcgctcatcgacgagtacgagaagaccagccggtggttgccggcgtcggtgatgccggtgacgttctggaatatggggttggtccatacgtcgccgcgcacggtcagtccggtcttcgtgtcatagagctgcacgtacggcagggcgttgcttgccgtccagtacgtggcgccggtgtacgggctggaatcggaataccattcgatgttcgagcccgacagcctgtagttgtattcctcgggcacgtacacggtcgcggtcttggcgcccgcatccaccttttcgacggtcaggtcgatgaccgtcggcacctggaagtccacgctgaagttcttgaacgtcacgttctggctgttgatggccgcgaacgtcgtcatcttgccgtggaacacgaaatccgaaccctggccgtcgacggtgatgttcttcgtgtcctcaagcaggatgccgatcttcttgtccttgtaggacgagttcgtgccgacggtgttcgatacgtacagggtgcgccgctcggccttgtcgggatagatgtcgtagcgccccttggggaacgcgatggtgacgttcttgccttcggcggcgagttccttggctttgtcgaccgccttgatgattgcgggggcgctgtcttcgccgctatcggcggcggccccgtaatcggcgaccgagacgacgtctcctccggccgcctgcgcggtgttcgtggagaacaacggcgccaggcatatgagagccgccactaaggccgccgtcaccccccccggccgctctcctatacgctctcctatgatatccagcacgactcatggtgcttccttccctcaggggttgtcgattatgacaggcgcggcaaggaaggcgacctctatgccgtcctcacgccgcagacggaaccgcacaggtatcatccatgatttttacggctcctgattatgtatactatattggcattacattaagacacggcgtcgaaacgtcgaaatacggtatccccccggtggcacaatgagaccatgactgaaaccagcgcttttgcaagttccctcccctcccatcgcccgctgggcacgccgctgggggcacatcccacccgcgtgctgttcctcggctcgggtgagctcggcaaggaggtcaccatcgagctgatgcgtctcggcgcatgggtgtgcgcggccgactcgtacaccggtgcgcccgcccagcaggtggcgaacgaggcacgcgtgctggatatggccgacgcggcccggctgcgcgcgctgttcgacgaggtgcgccccgacatcatcgtgccggaggtcgaggcgatcgcgaccggcgagctgtcggatgccgcggcgcgcggcgtccaggtggtgccgagcgccgaaatcgccgccatctgcatggatcgcgagcggctgcgcgtgctcgcgcacgaggatctggggctgccgaccacgccgtaccgtttcgccgggtcgttggaggagctgcgcgccggggcgcgggaggtcgggtacccgtgcgtggtcaagccggtgatgagctcgtccgggcatgggcagtcggtcgtgcgcggggcggacgcgatcgacgccgcatgggtcgaggcgcaggagggtcggcgcgccgccgacgagggcgacgtgtcgcgcgtgatcgtcgaggcgttggcgccgctggattatgagctgacggtgctgacggtgagctcgtcggccggcgtggtcacgtgcgcgcctatcgggcagaggcaggaaagcggtgactaccgggaatcctggcagcccgcggcggccgatggcgaggtgctggaaagggcgcgtgccatcgcctgtaccgcggtgcaggggctggtcgacaaggccacggcatcgggcgaaaccggatggggcgtgttcggcgtggagctgttcgtactgaccgatggatcgatcctgttcaacgaggtctccccccgcccgcatgacacgggcatggtgacgctgatctcccagaggctgagcgagttcgcgctgcacgcgcgggcgatcctcggcctgcccgtcaccgaagggcatgtggcgctggcgatgggcgacgggcagaccgccgcgagccacgccatcgtggtcgccggcgacggcgaggcggaattcaccggagtggagaatgcgctggccgaacccggcaccgacctgcggatcttcgccaagccgcgagtgcatggacaccgccgcatggccgtgtcgctggccatcgggacggacgccggtgacgcgcggcgcaaggccgccgatgtcgccgatgcgctgaccatcaccgtgcgctagcgccacacgaagaccgcggtacatctttcatctctatccggcgaaagtcccatccggttcaactccaatgggactttcgccggataacacgcagctgaacacacagccaaacgcgcgaccaagtacacagccataggcctccttcatcccgtcaaagtcccgtttcggacggtacaggtgggatcatgcgcggatagcagccgcagcgagcgtgttagcgctgcgcatgtagccgcccattggtattcttttaccgttagttcacccagaaattccgctcctcaagcatgatttggaaggcgattatggagaaattggaaaagctctacgagggcaaagccaagcagctgtacgcgaccgacgacccggaggtcctgtgggtcgaatacaagaacaccgccacggccggcgacggcgagaagaaggaggacttcaccggcaaaggccgactgaacaacctcatcaccacgatcatcttcgacctgctcaagaagcgcggcatcgacagccacctgatcaagcgcgtgaacgcgaccggccagctggtgcgcaaggtgaacatgttcccgctggagatcgtgctgcgcaacgtcgcggccggccacttctgctcccgtctaggcgtggaggaaggtctgcccctcaaggagccggtgctcgaatacttcattaagaacgatgacctgcatgatccgttcgtcaacgacgacgatctggtcgccctgggcgtgtgcacccgccaggacctcgccgagatcgcgccgctcgcccgcaagatcaacgaggccctgatcgagatcttcgccaagatcgacgtcaagctggtggacttcaagatcgagatgggccgcgcgtccgacggcacgctgctgctcgctgacgaaatcaccccggattcctgccgcctgtgggatcagaaggatcactccggcaaggtcgagcaccttgacaaggacctgttccgccgcggcctgggcagcatcatccccgcctacgaggagatcgaggagcgacttgccgagctcgccaagtccgagggcatcgaggtcaccgagtaattcatccaagcgcaagtagcagaacataatgttggctcccctccagaggggagccaagttctttcaccacgcctcttcattttttgaataacttcttaagaaaggattcccatggtttttcgcgtgtacgtggaaaagaagcccggcttcgacgtggaagcccagcagctcggcaccgaactgaagaccatcctcggcatcgatggcctgcgcaaggtgcgcatcgtcaaccgctatgacgtcgagggcatctcccaggagctcttcgaacaggccacgcctaccgtgttcagcgagccgcaggtggatgacgcctccgcgaacctgcctgacttcggcgacgcgacggtgttcgccaccgagttcctgcccggacagttcgaccagcgcgccgactccgccgcagagtgcatccagctgatctcgcagggtgagcgtccgaccgtgcgctccgccaaggtgtacgcgctcgaaggcacgctcagcgaggccgacgtcgatgccatcaagcattacgtgatcaaccctgtcgaggcccgcgaggcgtcgctggaagccaagaccacgctgaagacccaggtgcccacccccggcaaggtcgagaccatcgccggcttcaacgagatggacgccgctgccggccagaagttcatcgacgagcgcgggctcgccatggatctggccgatcttgagttctgccagaagtacttctccgaagagggacgcgagcccacgatcaccgagatcaaggtgatcgatacctactggtccgaccactgccgccacaccacgttcggcaccgaactggacaaggtcgacatcgacgacgccgcggtcaaggccgctttcgaacgctatctggagatgcgtcacgagctcggccgcgacgccaagcccgtgtgcctgatggatatgggcacgatcggcgcgaagtggctcaagaagaacggcatcctcaccggtctcgacgagtccgaggagatcaacgcctgcaccgtcaaggtgaaggtcgacgtcaacggcgaggacgaggactggctgttcctgttcaagaacgagacgcacaaccaccccacagaaatcgagccgttcggtggcgcggccacctgcatcggcggatgcatccgcgaccccctgtcgggccgttcctacgtgtatcaggcgatgcgcgtcaccggtgccgccgatccgaccgtgccggtctccgaaacgcttgaaggcaagctgccccagcgcaagctcgtgaccaccgcggcctccggctacagctcgtacggcaaccagatcgggctcgccaccggccaggtcgacgagatctaccaccccggctatgtggccaagcgcatggaggtgggcgcggtcgtggccgccaccccggccgaccatgtgcgccgtgagaccccggcccccggcgacaggatcatcctgctcggcggtcgcaccggccgtgacggcatcggcggcgccaccggttcgtcgaaggctcacaacgtggagtcgctggaactcgacggcgccgaagtgcagaagggcaacgcgcccgtcgagcgcaagctgcagcgcctgttccgccgcggcgacgcctgccgactcatcaagcgctgcaacgacttcggtgccggcggcgtgtccgtggcggtcggcgagctggccgacggtctgtacgtggacctcaacaccgttccgaagaagtacgagggacttgacggcaccgagctggcgatttccgaatcgcaggagcgcatggccgtggacgtggcagccaaggacgtcgacgagttcctggggtacgcccgcgaggagaacctcgaagccacggtgatcgccaccgtgaccgaggacccgcgcatggtgatgacctggaacggcgacaagatcgtgaacctgagccgcgagttcctggcgtccaacggcgcctccaagcatcaggtcgtgcgcgtcgaggagcaggaggcgtacgaggtgcccgcctcgtggcgcgaaggctcgctggccgaccgcatgaacgcggtcgtcaccgacctcaacgtggcatcgaacaagggtctgtccgaacgtttcgattcgacgatcggagccggaaccgtgctcatgccgttcggtggacgcaagcagctcaccccgaacgaggccatggtcgccaagctccctgtgttcggcgagaccacgaccgcttcggccatggcgtggggcttcaacccgtacatcatgtcgaagaaccagttcaccggcgcatacctgtcggtcgtcgagtcgctgtcgaagctggtcgcggccggtttcgaacacgagaaggcgtacctgagcttccaggagtacttcgagaagctgcgcgacgagccggaacgctggggcaagccaacggccgccgtgcttggtgcgctgatagcgcaggtcgacctcggcgccggcgcgatcggcggcaaggattccatgtccggttcgttcgagaacctcgacgtgcctccgacgctgatctccttcgccgtggccgtaggcagcatgaagcgcgccacctcccccgagttcaagggtgccggccaccgcatcgtgcgtatcgcgccgcgttacctggccgacggcctgaccccggacaagaatgcgctgcttgaggcgttctcgctggtcgaggagcttaccgacccgtcgcatcacatcgcgttggccgtctccacgccgggctacggcgcgactgccgaggcgctgttcaagatgacgcttggtaaccgcatcggcctgacgctcaacgagagcatcgccgcggacgacctgttcaagcctgcatacggctcgttcatcatcgagctggcggacaacgagaaaatccgggtggcctccaacctggtcgaggtcggcgagatcggcaccaccaccgccgagtacgtgttcaaggcggcgggcgagacgctggatctggcgaacgtgcaggaggcgtgggagtccggtatcgaatccgtgttcccataccgttccaagagcgacgaagccggcaagagcgtcgaaaccatcacattcgacgcgccgaagaagaccgtgtacacgggcgccggcgtcgccaagccgcacgtcgtgattccggtgttccccggcaacaactgcgagtatgattccgccgccgccttcgagcgtgcgggcgcggacgtgaccacgctgatcgtcaacaacctgacgccggccgccgtcgccgaatcgacgcaggcgctggtggacgagatcaacaagagccagatcgtgatgatccccggcggattctcgggcggcgacgagccggacggctccgcgaagttcatcaccgcgttcttccgcgcgcccgcggtcaccgaggccgtgcgcgacctgctcaagaaccgcgatggcctgatgctcggcatctgcaacggcttccaggcgctcatcaagctgggtctggttccgtatggcgacatcgtgccgatgaccgccgaatgcccgacgctgacgttcaacacgatcggccgtcaccagagccgtctggtgcgcactcgtgtcgcgtcgaacctgtcgccgtggctgtcgcgcacggccgtgggcgacgtgcacaccgtggccatctcgcatggtgaaggccgcttcgtcgccgccgaaccggtgcttgacctgctcaaggccaacggacagatcgccacgcagtacgtggacgaggccggcgtgcccggcatggacctgaccgtgaacccgaacggctcgctgctcgccatcgagggcatcaccagcccggacggccgcgtcttcggcaagatgggtcactcggagcgctccggcaacggcctgtacgtcaatgtgcccggcgacaagtaccagccgatcttcgaggccggcgtcgggtacttcgccgcgtgacggtgatgactgactgatagcagactggggcgggaaccttctcgggttcccgccccagtctgttgttgatgaagtatggcctccgcgcgatacgcggcggtatgaattactcggcctttgagggcgcgacaggttctgcgaccgccgcaccgttcgccacaggagcgctgttaacaggagtgctgttagtagtgttgttggccagttgctgatgcacggtcttcgcgatgtgacggctgaccatgaaccaaatcgccccggcgacaaccacgacaaacgaaatcggatagatatactcagcgattccgtatccatactgcgaggaaggcagtacgccacgatcgtcaaaatcccaacgcagtgcatagaaagcgactacagcaagcaccgagaatacgatggccgcgatcggcttcttcaacactccgaacagcagaataagcagcgaagacaccgcgatgaccgccatgagcgtaatgcatatgacagcttccaggtacatgccgccgagcagcttcccggactggagacccgcgatgtagatgcgcaggaatgtcagcagcgacagccccaccacatccttgttgtgtagaccggcttccgcggtgtatacccgatcaccatactgcttcaggtattctgcataatcgccctttgctgaggcgaacggcaggaagaacgacaccgccatcgccactgcgccgaccaccaacagcacatacggaatgagctgcttggcggggagcttcttcgagacctgttggccttgtgctatatctcccatattgtcacctttctttcctgtgttctcgtatcatgtttgatgacgggttgtgaccgtgcacgtgatactgtgcacgaagtgcttagtcatcgggtatcaatcacttgggattggtcgtcgtcacggtcaccgtgtacatttcggcttcggcagtaggctcatacaagcgctcgatgacatctttagcctgtttattggcaattttcagcagttgtgttcggtctagccgagcttcggtctttttcttggcgtcttccatcgcagctttagtgtcctctacatccgctgcgttaaagaaggaatcagacttgtcaaagaaacgcagtgaatctggattgacggccaccgactggattttcggtgcaggtagcgtgatagacactgttttggagtccttgtcgatttttatctgggccttggccagatcgacccccgcgcgcacctcgtatgtgtagaacatcgtgaactgcttcttgttcaggaacgcaataccaccgtcttcgtatttctcgaagccgtaatccgtttccttagccgtggtaagatcctggatcttctccagctgcttaacgacgacttcattggtcaattcctgttgaggattgaagaacttggtgatggcaccacgaatccatcctccggcgaacataaagatgacggcgacgacgaccgccagaatgattgttgctttcaggctcatcttgaatgatgagccatctttgtcgacgcgtgcgcgcatttttcaccttttctctttcatactctcgtcatctcaattcatgtggcatctgatgcaatccagttctggcatacgtctacaaaatgtatgggcaaaaccgcgacgagacatcagtcgtcgactgaattcgagctggttctcaccgattatgcaacacattagcgatgcacaatcagcaacacaataattataacgtaaatattgcgacataatgctatatctgagcttggttatgatccttgtgctggcaacgttgccgaaccatcatgcaccggtcggcatcaacacgagccgcataagaagggaacgacaatgacatcaccgagaagttcgatttcccagtatctcccgcgaaattgcacgaagccgtccgatccatgttgtcatgcggcgccgcattctcactacgcgaagcaaatgacaccgaaatgaaaacgacattcactcgttacgacagcgacgatgtcctgacagcaaccgtgaacggcagtggtgacgagtcgaagataacgctgtctgcacaagactcgtcgaatacaggggcgcgcatcatgcgctttgccaccgatttggctgcccggtggaaaggggcgaaggccggagccgtgattggcggggaacgtacaatgtgggatatgagcgagcatgtggagcatgggttcggcccggtgtgggacagcgaatcgcggattctgatactggggtcgatgcccagtccgaaatcgcggaaggcggcattctactatatgcacccgcagaatcgcttctggccggtgatgcaggcgttgttcgccgacccggcggatccgtctgatgtcaccggcgactcgctgcaatcccgccgcgcattcgcgatgcgccaccatatcgccttgtgggatgtcatcgagtcctgcgacatcaccggggccagcgacgccagcatccgcaacgccacgccgaacgatctgacgcccctgctgcgcgatgcgccgatcgctcgcatattcaccaccggagcgaagtcggcgcaactctatcgcagactcatcgaaccacgactggccgcaaccggcatcaccatcggcatgactccgctcccctccaccagtccggccaacgcctcgatgcggctgccggcgcttatcgacgcctaccgactggccttccagagcgcaggcgctcttgaaatggcggatgaaacggtcactggtctctgacgcgatcgcggcgtggacggcggcgacgggcaatcgacgcgcccaaccggcagaccgggatgagatacaggaacggcgccgcgaatcgtcagcctcagccgaatgatatgcgccggagcacaactgatggacgcaacgatcaattgcggcattggctggcggacggcaatctcgatgtggcggtggcggacttcaccggcatgccgaccggcgtggagctggtggatttctatcaggaacgtatggtgttggtcatcgcgaactcgctgtgactggatctcgccggcggcgggacgccgccggatgagaccgccatcggcgccggtgacctgtcatccttggagcgctgcccgttcctgccgggcaatccgcaggacatcgacggacgcatcggcgacatgctgttccgccgagccggattcgctcccgtggctgcgggccgggaacctcatacgcgatcagcttcggcatatccgcctgcgactaccggtggagcgcggtcgatgatttcatcgactgcgcgcgccggagcatcagcaccattgaccggcatgattccggccggaaccgtcggatcacgcctgatagtcgttgagcatggcctcgatgttgttgccatcgggatcatggacgaacgcggcatagtagcccggcccgtagttcgggcgcggaccgggcttgccgttgtcggtgccgccggccgcgagacccgcctcatggaacgccttgatggcgtcggcggtcttggcgcggaacgcgacgtgtgacggcacgaccggattgccgtccttcggcgattccagccagatgccatcgccgtcctcgtcgttggcgaagcataccgcagtcgggtatgcggccttcttgacatagcccagcggcgccagcagcttctcgtagaaatcggcgcgcttggcggcgtcggcgacgaacagtccgatgtgatcgatcatgatgaacctcctatgaccatgtggatgactattccattatccttgcatcgctcgtgacgcgggtgaatatcagctttgggtaaagccccgtttcaggcgccgaaatcggtgtcgccggcggcgtcggcccgggccacggcagcctcgacatcgcatgcggcctgttcgatgacccgctcgtagccggtcaacgcggcgaacggcatgaactgggcggcccgctgatgacgggacatctgcggatgcctgcgcgacacgtgatgcggcatatcgatgatgtcgtcatatttatgcgtctcatgtaatgccatatggactccttttcacgcccgatagcgcaatacgctcgatatgctcatgcacgatggcctccgatctgccgattgcggtcctggccggtggcgccgtcctccatgtccatcgccttgatgacggcattgcggccgaatttcctcttgacctccagcaatgcagtctgcatgtcatgctcacgccgcacatcactgttcgaaatgccgacatggccatcgtccccctcctccgcggacgaatcgatccgggaaaacagatcaagctgctcgtagcgtttgccggccgcaagctcattcgccgtggccacatcatcggcgatgacggtgagccggcgcaccaacagacgcggatccacgatgcgctcgtacagcatcgtcatcgcctcacggatgcgagtggaagacgaggtgaactcccccagtccgatcgacccggtggccggcttggggacccgccgcccataccggtcgacggacaccggcccgcgatagctcttgcccgcctgatcggaggcccgtttcatcgccgaatccgcgcaggaatccagtttggtcgagtcaaggctgccgatgtcgtagccgaccgcgagcgtcagacgattcgtcagcacccgcttgccgacaagatccaaggcgagcgcgtccgccatctccttgacgatgagccgtcccgtggcatagtcggcgggcccggtgagcacctgcccactgctgatgctgtgcgcatccggctcatacgattggatgtccgcgatcgtgcacggctcccagccccacgcatggtcgatgagtagttcggcattcctgccgaacatgcggtagagcagatcctcgttgtagtagtcggaggcccggccgatcgagcatcgggcgacatcccccatggtcagcaggccggcatgctcaagcttccgggcatagccgcgaccgacccgccagaaatccgtaagcggacgatggttccatagcagtcgccgatacgacatctcgtcaagctccgccacacgaacgccatcctcatcggcgggcatgtgcttggccacgatgtccatcgccaccttcgccagatacatgttggtgccgatgccggccgtggcggtgatgcccgtctgcgcgagaatgtcacgcacgatggccctcgccatctcgtgcgggcccatgcccagcgcgcgcagatagggcgtggcatcgatgaacacctcatcgatcgaatagacatggatgtgctcgggcgcggcatatcgcaggtacacgccgtacaccctgccgctcacctccagataatgcgccattcgcggcttggcgatcaccatcgacgccttcaatctcggggaatgttcaagatcccgagaatcacaggattcaccggacagccgtccaccaggagccagcatcgcccgctcggcgttcaccgatgccaagcgctgccgaacctcgaacaaacgtgcgcgtccgggaatgccatacgccttcagcgaaggagacacggccaggcagatggtcttgtccgtacgctcctcatccgccaccaccagatgcgtgcgcagcgggtcgagaccacggtcgtgacactccacggaagcgtaaaaagacttcaggtctatggcaagatacacatgctcgccccgaaccatcgtcaccaccccctttcgcgctttcgtttcagagtacaatcattatgagacatatgttcgatagtatgtcgccgcccatgaggcccatctgccacacccccgagcgcggatgtagccgccgattggtactgtggataggtagcgaatcccctgtcccccatgttttggaaggagctttggcttgtcagctgaactcgaagacattcacgaagaatgcggcatcttcggcgtatggggccacccggacgccgcccgcctgacgtatttcggactccacgcactgcaacaccgcggtcaggaaggcgccggcatcgtctccaacgaccacggccatctcatcgggcaccgcggcctcggactgctgacccaggtgttcggcgacgagcgcgagatcggacggctcaccggcgacaaggcgatcggccacgtgcgttatgccaccgccggatcgggcaccaccgacaacatccagccgttcatcttccggttccacgacggcgacgtggcgctggggcacaacggaaacctcaccaactgcgtgtcgttgcgtcgcaagctggaggacgaaggcgcgatcttccactccaactccgacaccgaagtgctcatgcacctgatccgccgctcctccaagccgaccttcatggacaagctcaaggaggcgctcaacaccgtgcacggcgggttcgcctacctcatcatgaccgaggacgcgatgatcggcgcgctcgacccgaacggcttccgaccgctgtccctcggcaagatgaagaacggcgcctacgtgctcgcctccgagacctgcgctctcgacgtcgtcggcgccgaactggtacgcaacatccgccccggagagatcatcgtggtcaacgaccacggctacaagatcgtgcagtacaccaacaagacgcagctggccatctgctccatggaatacatctacttcgcccgcccggactccaacatctacggcgtgaacgtgcactccgcccgcaagcgcatgggcgcgcgcctggccgaggaatccccggtcgacgccgacatggtcatcggcgtgcccaactcgtcgctgtccgccgcgtccggttacgccgaggccgcgcacctgcccaacgaaatgggcctgatcaagaaccagtacgtggcccgcaccttcatccagcccacgcaggagctgcgcgagcagggcgtgcgcatgaaactgtccgccgtccgcggtgtcgtgcgcggcaagcgcgtcatcgtcatcgacgattcgatcgtgcgcggaaccacgtccaagcgcatcgtccagctgctcaaggaagccggcgccgccgaagtgcacatgcgcatcagctcgccgccgctcaaatacccgtgcttctacggcatcgacatctccaccaccaaggagctgatcgccgcgaagaaatccgtcgaggagatccgcgacttcatcggcgccgactccctcgccttcctgtcgctcgacggcttggtcgaatccatcggcctcaacgcgcaggcaccctacggcggactgtgcgtcgcctacttcaacggcgactacccgaccgcgctcgacgactacgagaccgacttcctcaagtccctcacccccgaggaccgtgtccgtctgcccgaattcgcgctctacaagagcaagtacgaaggcaacgagtacaccaccgcgccgacgcagcaataaaggcgttccagcaccacagaccaatcccaatcccgacacaacccaacaagcatcatccaagaaaggtacgtcatgccacaagcatatgaaaacgccggtgtcagcgtggaagccggctacgaggtcgtcaagcgcatcaaatcgcacgtcgcccgcaccaaccgtcccggcgtcgtcggcggcatcggcggcttcggcggcctgttcgacctcgcgtccctcggctacaaggagcccgtgctgatctccggcaccgacggcgtcggcaccaagctcgtcgtcgccaagatggtcgacaagcacgacaccatcggcgtcgactgcgtggccatgtgcgtcaacgacatcgccgcccaaggcgccgagccgctgttcttcctcgactacatcgcctgcggcaagaacgatccggcgctgctcgaacaggtcgtctccggcgtggccgacggatgcgtgcagtccgaagccggtctgatcggcggcgagaccgccgaaatgcccggcatgtatgacgaagacgaatacgatctggccggattcgcggtcggcgtggccgaaaagtccgccatcgtcgacggctccggcatcaccgccggcgacgtgctcatcggactgccatccaccggcgtgcactccaacggcttctccctcgtgcgcaaggccctgttcgagcaggccggctataccgtcgacaccatgctccccgaactcggcggagccaagctcggcgacgtgctgctcaccccgaccaagatctacgtcaagacactcaagcccctgttcaaggcaggcgtcgtcaagggcgtcgcccacatcaccggcggcggtttcatcgagaacatcccccgtatgatccccgacggcctcgccgccgacatcacgctcggatcctggcccgtccttcccatcttcgacgtcctggaacgcgccggcgacatcgaccacaaggagatgtacaacatcttcaacatgggcatcggcatggtgctcgccgtctccgccgaacgcgccgacgagacgctcgccctgctcaaggacaacggcgaagccggatatgcgatcggcacgatcgtccccgacaccgacggcacgcagatcacgctgaagtaagcatccactcccgcactccccactgatggggagtgcggtcacaagcgaatccgggggtggccggcacgcccccccccagtccgtctgcaacggacagccccgccagcggggcctgaagaaaggacacatcatgggtcagaaagtcttggtcatcggctcgggcgcacgcgaacacgccatcgcgcacgcgctgctgcgcggcgacagcgtcagcgaagtcaccgtcgcctccggcaaccccggcatggaactggacggcatccgcaccacccaaatcaacgaatcaaaccacgccgccttcatcagcttcatgcagcacaaccagtacgactgggcgttcgtcggccctgaagtccccctgatcgaaggactcgtcgacgacttcgccgcggccggcatcaaggccttcggccccaacaaggccgccgcccagatcgaaggctccaaagacttcgccaagcagctgatggcccgccacaacatccccaccgcccaataccgcaccttcgacaacctcgaagactccgtcgcctacgtgcgcgaacacggcgcccccatcgtcgtcaaggccgacggactcgccgccggcaagggtgtcaccgtcgccatggacgtcgacaccgccatcaccgctctcgacgacatcttcatcgaccaccgcttcggcaaggccggcgccaaggtcgtcatcgaagacttcctcgaaggccaggaattctccctcatgagcttcgtccgcggcaccgaattctggcccatgcccatctcccaggaccacaagcgcgcctacgacaacgacgaaggacccaacaccggcggcatgggcgcctacagccccgttccccagatcggccaggacgtcatcgacaccgctatcgacaccatcgtgcgccccaccgtcgaagccatggccgccgaaggcacccccttcaccggcatcctctacgccggcctcatcgccaccgccgacggccccaaggtcatcgaattcaacgcccgcttcggcgaccccgaaaccgaagtcgtcctccccaagctcaccagcgatctcggagcagccatcagcgccatcctcgacggcggcacccccgccttcacctgggacagcaacaacgccaccctcggcgtcgtcctcgcctccaacggctaccccgtcaacgtcatcaagggtgccaaaatcccctccatccccgtcgacgacgcctcccacgtctactacgccggcgtctccaacagcgaccaaggcctcgtcgcctcctccggacgcgtcctcctcgtcgaaaccaccgcccccgacctcaagtccgcccaagacaaggtctacgcaatcatcgacaagctggacacggagggaatgttttaccgccacgacatcggtgccaaagcgctgaagtgagttgtgcggcgcatctgctgcgttgcggagcgctcgaagtaccatcgtacgtcgtcgcattccgcgccttgcatctgcaccacacaactcacttcaggcggtaaaaagccgtgtatggcatgcctatgaaattgcccccgctagtagcgggggcaattgctattttgtgaggccttacggcagatccatgaagtcggtgtctttcagatagtttttgccggccgtgatgtcgtactggatgagcttgtaatcggtcatcagctgcttggtctgctcgtcgaactcgtcctcggccatcgggttgcccgccgcgtcaagatagatatcctgcccctcggggatgcggtcccatccctggatcttgttgaccaccggcggctccatggcggagaccttcttgtgcatgagcgtcaggaacgccaggtacggcgacaccttcgcgttcatgtgctccgcagtctgcgccacgaaatagttcggcgacgagtacacgctgttgtcgaccttcttgccctgcgagccggacgccttgttggaccatatgaaataatccgtcaaatgcagcgccagcgaattgttcgtatcctggctggcggtttcgtagatgcccggcagatggtcgccatagaacacgaccgtcaccggcttgtcgagcttgttgagctcatcgaggaagttcttcgtctccgtatcggtgatgctcgcgcccttcgcatacgtgtcgatggccgtcacttcgtcggagccgagggaatcggcgccgtcggccgcggtggccttgaactcgttgtcggcataccagtcgttgtacggcatatggttctgcatcgtgatgatctggatgaactggttcgaatcggtcgagctgatgtcctccaacgcgctctgatacgtggccttgtcggacacgtacggggaacggtcgatcttgtcccgatgcttgatgatgtcgtcgccctgcagcgtgtagaaatgcgcgaatccgaacttcttgtagttcgtcgcgcgcgaatacatcgacggctcatacgggtggaaggcgatggagttcttcggagccccccacatctggttgatcgtcggcgtccaatgctgccccggtaccagctgctggtacgggctggtcagagacgagtcgaaattcgccatgctcaggcccgacaatcccatatactccaagttcgcggtgccgccaccgtatccggacgacagcatcagaccgctggtcgtgccggatttgatggcacggacctccggaatggcgtccttgttgagcttcacaccgggtacgcgcgcggggtctgagaacgattcggacagcacgtagaccaccgtcgaatcggtcatgttcttcgtgcgcgaggcgttgatcttctcggcggcgacctcgtacctcttgacgacctccttcatcgtggcctcgctgtaatcgctcggctcatccatgatcgtcgggttgagctgccgggtgaacgagaccagcggaccgttgcgctgcgcgtcatacacggaatcccacatcgaaggagtgtcgcccagggccttggaaaaaccgttcgcccacgagccgacagtgctgacctggtcacagtacaggccgaagaacaacgacggcagcaggaacaccatcagacggattccggcggccaaccccttgttgtcgaaacggatcatgcgaccatgccggccatcgacatggttgagcaccacgaacagtgcgacgaacaccaggaacaccgcgaatgcgccgaggatgatccaatgggcccccggaggggtgaaactcatcagattgccggtattcgagccgaggaagcccaggtcggaaggcagaatcgcctcatagcgtatggacaccttgaaatgctcgatgacgcccacgatgatggccacggccagcagcaccggcgtggctatccagaaccggttgaacagcatgagcagcgccagatacagcgcgccgatgagcagcaggttcagcacgaacacgaagttgcccttggtccacatcttcgacacgaaaccccagcccacgacgggactggacagctgcacgcgcgtgccggactggctgacgccccactgcagcgcagcgaccgccgccatgtcgaacaccacgaacaggacaccgtacagccagccggggaacggcttatactcacggcgaccgccgtttctgccgcctttgccgccgttcctgccggaagaggagtcggcccgcttgatatccagcacctcgatctcgccggacgggctgacggcatcggccacgttcgtaccgtcatcgttcttgtcgtttatttcgtcgctcatatacccgcacttcgtgtgattcgcatggcgccatccgacccatgcccaattcgttatcggccatatacacgtcatcatggttcttccgccgcgtcacgcgcggaagggaacggccatgcgccgccatgatgaataccgaatgacattctagtaaagaaacgacgacaatggtacatcacgttcactgatatttccctgaatctccccgtatgagaccagtctgagacccgtatgggccactcgccgcccgttggaatccgcgcggaagagccccgcatgatccgcataagtgggccccgtatacagcatcgggcaatatcatccctgagacggacgaaaggcgccgggtcataccgggtaatatcaaccgatgacacttacaagggggatgatcgcatggaatcgttgccgagttgggtgacgaggttactgcatatacgactcgtctcaggcccgttgccaaccacgatatgggtgattgtcggcgtgggagtggcgatattgctgctgtggcaggtcttcaggagcgatcggtccaagctggcgaggcaggtgcccatcatgcttgtctgcggtggcttcggcctgctggtcatgtggctgctttccgaaaaattcatggtattcggcgtatcgctgggctggcccgtcatcatggctgcggccgcgtgctgcgcgctgttgggactgctggtgacgaccatcgtgcacgcccggcgcgcccggcgcctgatggccgcggtgctcatcccattcgtgctggtctccaccgcgctccgtatcgactcgatttacggggagtatcagaccatcggctcgctgatcggctattcgtcatatcatccgctcagcacgtcacacatgcagaaggggaccctgaccgtcgatgaatggctgcgcgaggtgctcgatggcaaactgccgcccgccgccgcgcacggcaaggtctattcggtggacatatccaacacagcctccggattccgcgcgcgtaccgcggccgtctacatgccgccagccgccctgagcgacacaccgccagagctgccggtactcgtcatgctcgccgggcagccgggcaatccggaccgcgtgttcgcggccagcggcatcgccgcgatcctggaccagtatgcgaaggcgcatcacggtctggcgcccatcgtcatctcgcccgaccagaacggcgacaacacggtgaacagcctgtgcgccgacacgaccaaggtcggacgcgcggagacgtatctgaccgtcgacgtgccacggtggatcaaagcgcatctgcccgtgtcccggcaggcgcgggattgggcgatcggcgggttctcgcagggtggcacgtgtgccacccagttgggaccgcggcacccggacatattcggctccatcatcgccgtggacggcgagctgaagcccaccgccggatccgtggagcatatggtcgccgaatatttcaacggcgaccgcagcgcctatgaggctcaagtgccggccaacgccatcgccgaccacgcgccttccaaccagatcatgattctgggggcgggcaagcgcgacgcgagatccataaaaaacgtcatcgtcaacggccaggccggtgtcaaggccggcatgcacgtcgtgaagatcgtcgtgcctgacaccggccatgactggcattccgtcaacgcgacattagaggcggccgtcccctggctgtgcgcgcaccgctggggtctgggcgaaacgggcctgacatggtccgactatccgagaatcgaggttctgcaatgagcgacacgaaagtcgaaccggagagcggcaaagaaagccgccgcaaatgccgtacccacggcaggatgcatgccttggtgcaggacgtgagcgtctggattcacgggcatcgcctcgcagtgacgttgtcctgcacgttcgcggggctcaacatcgccatgtggatcggcttcgcgctggccggccgtccactgcctctgcgcagcctgcgcaccagcctgcaggagttcaacctgctgcatctgctggccacgctgctgctgacacgcggaatcctgcagctgctcgtcgacacgatcgcgctgttggtgatgttcgccatcgccgagacgctgctgggccgccgccgcaccctgacggcggccttcatctgcacgctcgccggaacggccctgggactgctgctgtgcggaggcatcgcccaactgctgcaaggcactccggtggtgggccgcatccgtttcgcgctcagcccgctgacgctgggcgtgggcgcgatgatggcggccagcgcgttcacccgccgcctgtggaggcggcgcatccgtctgatcggctatgtgtccataatcatggttgtgatgttcagcggtaatcccggtgactactgcctgctcgcggcggcgggattcggccatgtactgggcgcgctgacatccaagcggaagaccgtccgacagctggacgacgcttcggcggcggatccgctgcactggcagctgagcacgtcgtacgagacccgtcgcgtgttcgcggccatcgcgctggtactcacgctcggcccgatcattgcgatctcctcaccaacccatatcggcccgttgagctcattgggactgattatgagcccggcctcacccgatgacggcaagctcgcctcctgccttgccggcatggcccgcaccgactgcttcttccagttcaatctgctgcgggtgtccatgcctggggcggtcctgcgttccctgctgccgaccgcggtgatgctcatcatgacctggggcctgtatcgtggcaggcgtctcgccgcgtgggcgttcatcatcgtcgggctgggggaatcctgcatcgcgatgctgtactatttcgtggcgcctctgtcccacgcgccgcaggggttgcgttccctgctgctgcacggcgcgattccggcgagcatcgccaacgtgctgttgccgatggtgttcgccatcgccgtcgcctgctccatgcgccacttcccgatccgcacggacgcggggcgtctgcggcgaggcagcgcggcggtcgtcatcgccctggccgtctgcatcgcggcgtatctgggcttcggactgttgcgccccggcgatttccggcctccggcgacatggcatggcctgatgcatgagctgccgtcacggttcattcccatcgggttcctcaaccgcagcaggccgtcgttcctgccgcgcaccgtggccgcatcggtggtcgatcaggccgtgggactggtcttctggctcgtggtgctggtcgtcgcggtccgatggatgcgtgagatcctgctggtcgacggacgcgcccgcgccaacgccggccgcctggtggagctggatggcgagtcgatgagcttcatgaccacgtgggagggcaaccattactggttctccgccaccggacggtcggccatggcataccgggtgatccacggcatcgcgctgacgaccacgggcccgttcggcgaccgtggcgaatggtcgtccgacctgcgcgagttcgctcgtttcagcatgcagcagtcatggtcgcccgtgctatacagcgtgcatcgcgagcagcgcgaccagcttgccgccatgggctggtattcgctggaggtcggcagcgagatggtggtcgatccccggcaatggaagacgaccggcaagaaatggcaggacatccgcaccgccatcaacaaggcgaaacgttccggcatcagcgacgtgatgtcgaccttcaacgaggccccgaacgacatacgcgaacagatcgaggagatctccgagcagtgggcgcagctcaaggcgctgccggagatgaagttcacgctgggcggcgtcgaggagctgcacgacccgcgcgtgcgcatcctgtacgcgatcgacgccgaagggacggtgctaggcgtgaccagctggctgccgacgtggcgcgacgggcgcatcatcggctggacgcttgatttcatgcggcatcgcaccgacagtccgaacggcatcatggagttcctgatcgcgcgcatggcggagcggctgcgtgacgaggggctggagcaccccgagtgcgccgtcgagttcatgagcctgtccgccgcgccgctggccggcatgaacccgcagcgcgacaatgccgacgagaccggacatatggataccggcaccgtcatgctgcagcatgcgctgcagatcgtggcggattggatggagcccgcatacggattccactcgctgttcaatttcaaacgcaagttccagccgaccgaggagccggtgtacatctgctatcccgatccggccgtgctggcccaaatcgggctggcggtcgtccgcgcctacgtgccgtccctgacggcgaaggaggccatgggcatgctgcgcacactgcagcggtagccggccatccggccctttatgggttacggacaatcgccgtgacggtcgtcgcccgtgtacacggcagggttgccacgcataaaaaacaacaatcgcaggatttcaccatcccaaccgtcctcccggcagccctgcgacgcattttggcgtgtctcccataagacgcatgttcggccgatgacgatgatcgtgcacccgccgcgtgaatccggatacggccggcgtgtccatcatcttgcccgtatatgcgtccggcgggatttcgcagttccatcgcggacgagctcaactgttacacgggtcaagcgtcactgtgcgtgggtaccgtcaccgtgcgtgccctcgcagcgtgactgcgtcacggaaatcattggaaaataagggtttctaccgcccgcgtcactgtgcgagccctcgcacggtgacggtacccgcgcacagtgacggccagatcatccatcagacgaaacggcatccacatcgtgaaaatgacgccattccagcccggccgaatcggatgattcgctccccggagcccgtcgcgaagcaatcggagactgctccgaagagcccctcacggaatgatgcccctccatgcgcaaaagcggcggggcccccgcaagaaggccccgccgttgaaggagatatagatagagataaaatcagcgcgccggcatcacgccttggcgaactggtcgacgagggcgctcatccaatcgagcaggttggtgtattccttcggcatctgctcggtgagctcgacgatcgggacgttggcgctcttggcggcaccggtgatctgatcggtggtggagttagcttcctgcgtgttgaataccagcatcttgatggagccgcccttgagggcgtcctggaacgccttgatgtcggacggggtgggctcgctctcgttggcggaggcctgcgcgtagccggtcggggtggcgtccttcatgcccaggtcgtcggcgaggtaccatgcgacggattcggtcgcggcgtacggcacatccttggtcttggcggaggcgtccttgatcttgctttccagctgatcctccttggcgtgccattccttattgagcttggcgtagtcgtccttgtggctcgggtcggccttctgataggccgcggtgatggcgtcggcggtgttgttgcgcaccttggcggagaaccagacgtgcgggttgtcgccttccttgatgccggcggtttcggctgcggtgaccagcgtggccttcgtcgcggatgcggccttggacgcccacggatcatagtcggcaccgttcacgacggcgaccttcgcggtgccgaacttcgcgacgtcctggctggtgggctcgtagtcgtgcgcttcgacgttggtcttcgtcatgatgttggtgacgtcgacgtgggagccgccgaggtccttggcgacggagccccactggttgatgctggcgacgacttcgatggtgccgccgccttctcccccggcggtcttgttgtccttgctcgttccgcatgccgcgacggccaccagcatagaggcggccgccacacccgcgacggtgcgcctgatgatagatgaaatctgcatttgttattccgttcctctccggatgatgacgggctttctcccgttctttcggttcacagtatacacgttattgagatttattatcattatcgttatcaaatgggcgtgtcgcgcggccgatcacgcaccgacggacgactcgacttcatacaggccggcgatgtcgcacaggtccgcctcatgggcatcctcgaccaccacggcgccccgcctggccacggcgcggatgatgtcgcggcacgcgcattcgccgtcggcatccacatgccgcgacaggcagccccggccgaccaccggcagctcaaggacatgcgtcgcctcccggatcaggcgcgacaccaccgcgccggtcgaccgctcgtcgaatacgccatcctcgtcacccgtgccatacacgcacagacggtcgtcgtcgaagaaccgctcctcgaactcgtccagaccgaccgcattgaccacggccgcgacgcccatgccatcaccccacgaatcaaggcgcatcatgtcttcgagataccgggcgaccggtgtcgcctccagtcccaccggaagactcaccaggaacacacgggcctgacctcgcagagaggcgagcgtcccgcccgcgtcgtgcttgaccgagcagctcagacaacaatccgacagatcgaagatttccgcgtcgcccaccccgacgccctgccccaccgggcggctgacacgcctgacgatgctcagaccggcatccgcctcgccattcgggcgcacatcgtacgagatcgcgcatacggacgcatacgagtcggccagggagaacgccacggagtccagactcagccgatcggcgcccgtcagcagcaccaccgccgtacccgcgtttccccgtgattgcaatgtcggatgaatcatgatcgcctttctttttgataatgattatcattatgatatattggcatccatgtccaaacaatgtcaaattctgggcacgcgcgcctcaacgggcaaccgcgtatcccactcgcacaggaaaacacgccgacgcttcaacccgaacctgcagaccaagcggtactgggttccctcgctcggccgtcacgtcacgctgaccgtcagtgtcaaagggatgaagaccatcgaccgcatcggcatcgaagcggccctggcacgcatccgccgcaacacgccggaccgtctggaactgacgaagttcgacccggtcatacgcaagcgggtcacattccgcgagacccgctgaatccgttccgacggcccgcacgaaccgcggccgtccgagcgtcatcccgacacacagccatcatcaaggagcctcaatggcaaagaccagcaaaatcaacaagcaactgcaacgcgagcagatcgtcgccaaatacgcgcagcgacgggcacagtgcaaaagggactcggtcaacccgcacctgaccgccgacgaacgcgccgaggcgatgcgccgactgcatgcgatcccccgcgacgccagcccgaccaggctgcgcaaccgcgacagcatcgacggccgaccgcgcgccttcaaccgtaaattcggactgtcccgtatcaacctgagggaaaaggcgcaccgcggggagcttcccggcgtggtgaagagcagctggtgatccagcgcggcgcaccaacatcgcatcatcagaaaggcatcatcatatgaaagacaacatccatcctcaatacgggtacgtggtattccgcgaccggtccaccggaaaggcgttcctcacgcggtccacgctggtcgcgaaggccgcgagcctgccgaccatcgaatgggaggacggcaacacctattccctggtcaacgtggaggtgtcgagctacagccacccgttctacaccggccgcaacgtcgtgctcgacacggccggccaagtgcagaaattcaacaagcgctacggacggagctgacagggccggcgaatgccggcatcccaatgcgcgaaccatccccacccgctacgcggaagcccccgctggcgggagctggctcgcgaagcgagactgaggatggtcggccgaccggcgcagcccatacatcaacactgcataaacccaccaacactgcataaacccatcgaaaacacgaaacggagcaacgatatgaaggtcaaatcgtcgatacgctcgttggcgcgcaaggacggctcgtacgtcgtgcgccgccgcgggcatctttatgtaatcaacaagaagaacccccactggaaagcgaggcaaggctgatggcactgccgaaagtcagaacgtcgcgcgcgaacacgcatgcgcgcaggtcacaatggaaggcgcaggccgcgcagctgatcgccgtgcacatgcccgatggcgaggtggtgcacgtgccacacagtctggtcaaggccgtgcgcaagggatacgtgaagccgcggtagacccgcgacccgatgcgtgatgggtcaatccacgcgaaccagccgccaagaccagtgacatggcctcagcagggacttatatgcagggtgccgcttctcaagacgagaggcggcacctttttgcattgggaaccattatcaccgtggtacgatatggcggcatcatcccataccgacagcccatgccggcaattcaaggagcgtcataatgtcatggggacatcacaccggcacggttcatgacggcaccggacggggacaccacgccgatggcggcagtcccattgacgccaacagcgccgatggacgcgaccattcggcgcattacctttttctcatcatcggcacgccgctggtggcgttcctcatcgccgcgtccgccatgttcgaatcgcgcggtctgccgattccgctggtgcgcatcggcaccggcgccgccgggctcatattgcagacgatcccgttcatgctggtgggcgcgatgatgtcggcagcggtcagcacattcgtcagcgccgatgcgttggagcggcacgtgccgaaatcgctggccggcggactggcgatggcgatgatcggcgggctgtgcctgccggtatgcgattgcatggtggtgcccacgttcgcgaatctggtgcgcaagcggctgccgctgccgtacgcgacggcgctgctgtgcgcggccccggtgatgaacccgatggcgatctggtccacgtggttcgcgttcacgggcagtccatggatggtggcggcccgcgtgggtctgggcatgctggtggcgagcgccgtgggattgtcgttcgccgtccgcccgtcccgctcccccgccgtacgggaccttccgctgacgaggggccggacgccggcctgtgatggctgcgccgtacaacatgcggggcaggatgggcgttcccgcttcatgcacttcctcaggcacacgcacgacgatgtcatgcgcatgatgccgattctgctgtccggcacgattgcggcatccatcgtacgcaccgcgctgtccccactgaccgacggctccggcacgatcgacggcatcggtgccgtgacgctgattgcggcggcgatggcgatagccttcctctgctcgctgtgctccacgtccgatgcggtgatcgtcgcgagtatgaccggcgtgttgccggcttccgccatgctcgcttttctgcttttcgggccgatgctggatctcaagaacacgttgatgctggtcacggaatgccgtccgcggttcatcatccgctttgtcgtgaccgtcgcggcggcctgtttcctggtcgccgtcgccatccatctgacgacgggagcgtgatgcaatgacgaatactctgaactttcccggctccgaccggcatgccccggcggcacggcatgctcccgcgcttcccgaccgtatcgaggcgatctgtttcgcggcactgggcgcggccatcgtgtattcgactacgagcggctcgtatatcacgctcaccacgccccgatcgctgccgtatctgatcgtcggcgcgatactgctgttcgccctgtccgtcgccgcgtggctcggcgtgttccatgccgacgagcgatcctcgtttcgtttcctggtcgcgctcgtcatccccgcgctgctcatcgccgtgccgttccaacccggcaacggcaccggtttcgacacgtacgccgcaggacgggccatcgccatacgccgggacgcgcacaagccggcgggattcgctcatctccacgggctcgacgaggagcgcaagaccatcaccatcagcgacgacgaattcggttcgtggttctcccacatcgaccacaatccgcagcgatacatcggctatcgggtgcgtctcaccggtttcgtctacaagccgtccacgctcggcgcccatgagttcgagctgtcacggcaattcatgtcctgttgcatcctcgatatgacgccgttcggattcaccacgcactatgcgaagaccgcgcaccttcaggagcatgactgggtgagcgtcgacgcgacgctcgtacaaggcacgtacggcatcgccgggcatacgcggcaggggccgatgctgaagatcacgtcgctgcacaccgccaaagccgcgcccaccggctatttctactggcagtgaccgtgctttcggcggcaatccccgccgccgaaagcacggtcggcttttgctgcggccgctgcgtcaccggtgactgctacgacgactccgactgcgagcacggctccaccgaggagtgcgagggcaaggcctgcgtgcacacctgccacgagaaccgcgaaagtcacgagtgcgccttctgccacctcgccttcgacaccagcgagaagtgccacgaggaaatcctcgccgacctcaaggaactcaaggccgaactggccgcatgatataggcgaatggcggcatggagggaccgagtggcatcccttcgcgccgccattcgtcgttatcggctcctccgcgcgcgagtgccacgccgccggaccaccccagtcagcccgcggccgacagccctccgccagcaggggcgaatccgcggaaaggtcagcgttttccctgacaatcggggcataggccgaacacctcaagggtatgcgactccaccgtgaacccatgcccgtcggccaccttgcgcacccaggattcgctcggcggatcgatctcgatcgtcttgccgcatttgcgacacaccagatgatgatggtgggcatcatcgccgcataggcggaacagctgctgcccatccatgcgcacggtatccgccgctccggaatccaccagcgagttcaactgccgatacactgtggcgaggccgatgcgcagtccggaatccaccagcttgcgatgcagctcctgcgcggaaatgaaatcatcacagccgcgaagctgcgccatcacggcatccttctgcttcgtatgcctcaccggcccgttcgccatcacacgctcctcaagtattatcatttaacaaccattaatgataatagcgcaattcacggcgacatgcgagcgcgccgcacatacaacgaaacgaggggcggacgccgcagcgtcacgcccctcgctcccgaaccgccaaaactaccggagactacttgaggtcatcccagcagccggtggcctccaacgcctcgacggtcgccgcagtgtcatccgtgagcacggtgatatgacccatcttgcggttatgacgcacctgcgccttgccgtaatcgtgcacgttccactcgggatggtcggcaatcagcgccctcgtgggcgcgacatgctggccgagcacgttcaccatgaccgccgggctgagcagcttcggctggatcagcggccagccggcgatgccgcggatgtgcgcgtcgaactgatcgatcgagcacgcctcgatggtgtaatgccccgaattgtgcgggcgcggtgccagctcgttgacgacgacgcgaccgtccttggtgatgaacagctcgatggcgagcgtgccagccagctcgaagccgcgggccagggccagcgccatctcgtgagcggtgcgcgcgatctccgggctcacctcggcgggggcgatcgtcatatgcaggatgttgttgcggtggtcgttgcgcacgatcgggaacgtgacgtaatccttgccgttgccggacacgagaatcgacgcctcgaacgcgaaatcgacgaacccctccaggatggacggtgggaagccgccgccgcggtcgccacgggcgcgaatcttctccaggtcgctgtcattgcgcagcacatgctggccgtgcccgtcgtatccgccggagcgggtcttgagcacgcacgggtaatgcaggtcgtcgatggcggcgtcaagctcctcgaaggtgttgacctcacgccagggtgcggtctcgatgccgtgcctgttgatgaaggtcttctcgtggatgcggtcctgggtaacgcgcagcaggtcggtgccctgcggggccgcgaccaggtgacgcacctcgtcgatggattcggcgtcgacgttctcgaactcataggtgagcacgtcggacttctccgccagatcatggatggcggtcttgtcgtcgtactcaccgacgacctgaaaatcggccacctgcgcggtcgggcagtccggcgtcgggtcgagtacgccgatgcggaagcccatgtacttcgcgctcaatgccatcatgcggccgagctgtccgccgccgatgatgccgatggtcgctccgggctgcagcatcttcaccgcgccatgtgtctcctcagacaagctgggcattggattcggccaccttctccttgagagcgtcacggtattcctgcagcgcgtcggccagacgcttgtcggtcgtgctcaggatctgcaccgccagcaggccggcgttcgtcgcgccggaattgccgacggcggtggtcgccaccggaatgccgccgggcatctgcacgatggacagcagcgaatcccagccggagagcgcatgcgagcgcaccgggacgccgatcaccggcagcgtggtctgggcggcgaccatgccgggaaggtgcgcggcgccgccggcaccggcgatgatgaccttgagaccgttgacacgggcgccgtgagcgaattcggccatcagttcgggcgtgcgatgggcggagatcacctgcttgacgtagggcacctcgaactggtcgagcatgtcgcaggcgtgcttcatcgtctcccagtcgctggccgatcccatgatcacggcgacttcgggcttgctgtctgtcataagaagaacctcctcttggataccgttacaactgtacaatcccctatatcctcaccacgaccttgccgaacacgtcgccggaaagaaccttggcgaaggccgcgcgggcgtcggcgagcccgaacgtcgagtcgatcaccgggtgtatgtcggcatgttccacgaagcgcagcaggcggacgaaatcctcgcgcgagcccatcgtgttgccctgcacgcgtatgtcctggaagaacacgcgggtgagttcggcgcccggctggtcgccggtggtggcaccgcagatcgcaatcgtgccaccggggcgcacggaacgcaccgaatgcccccatgtggcggcgcccaccgactcgatgacggcgtcgaccttgcgcgggaggcgcgctccggcctcgaacgcggcgtccgcgccgagggccagtgcacgctcgcgcttggtctcgtcgcgcgaggtgacgaacacctccagcccggcggcgtgggcgagctgaacggcagcggtcgacacgccgccgcctgctccctgaatcagaatcgtgtcgcccggtttgacgcccgccgaagcgaacaccagcgagtaggcggtcagccagctggtgccgagcgcggcggcctcgtcgagcgtcaggttcgcgggcttggcgaacacgttggcgctgggcacctgggtcttcgcggccatcgtgccggggtaccgctcggagaggatcgtgcgccgctcccccggcatcacgccggccccatcggcgccgatcacggtgtacagcacgacctcgtcaccggccttgagccccttgcgcacgggaatgtcctcgtcgagcacgccggcggcgtcggtaccgaggatcatcggcgtggcctccgctgcgagccccacgcccttgaggctccagatgtcatgatggttgacggtcgcggccttgacggacacggtggaccagaacgggcgaggctgcggctcgggcagctcccccacctccagcgcggccaaggggtcggcattgttgatcgttgcggcaaatacggccttcattggcccctccttgttcggggatatccatcgtcgataccattcaaccacgcgcacacgcccgcgcggaggccgggcgcggcatgcgcaacgggagcgggacgcgacagacggtacaggcggaacggagccgcaatgcctcccaggactcctgccgtatacggagatgttgggggcattttctcgtgccagcggcccgatgcgacggcatcgattatcatgtcgcttttgaaacatccgaggaaaggacatatgcgtatgagcgtcggcatattgagtgcgattcacggaccagccgacgtgcatgccctcgacgccgcggagcttccggcgctgtgcggtgagatccgcacgacgctggtgaggtacggccatgtccacggcgggcacatcggatcgaacctcggcatggtcgaggccactgtcgccctgcaccgcgtattcgactcgcctcgcgaccgcatcgtattcgacgtgtcgcatcaaagctacgtgcataagatgctgacaggccgcgccgacgcgtatctcgacccggcgcatcatgactcggtgacgggtttcaccaatcccgccgaatccgcccatgaccagttcgtgctcgggcacaccggcacgtcgatttccctggcgtgcggcctggcgaagagccgtgacctgacgggcggcatggacggcggcagcggcatacgcaatgtgatcgccgtgatcggcgatggctcgctcagttccgccatcgcgttcgaggggctgaacaacgccgccgaacagggcggcaacctcatcatcatcgtgaacgacaacgagatgtcgatcgcggaggatcacggcggcatgtatggcacgctcgcccgtctgcgcgctaccggcggcaggggtgggccgaacctgttcatggcgttcggactggactaccggtatgtcgaggccggcaatgacgtgttcgctctgatcgaggcgttcgaacaggtcaaggacaccgatcatccggtcgtcgtgcacatccacacgcgcaagggtctgggattgccgcccgccaaggaatccgcggaagcccgcgactccgggattcccatggagggtgacgccgcggtcgccgccgaggactcgatggtcttcgaaggacgacatgaggcgaaccattggcaggatcccgacagcacgaccgggcggcctttgggagcgcgcaagcattacgggagcatggcgatggcggcattggaaccgcggttcgccgcggaacctggactggtggtcatctcccccgcgacgccgggctcgaacggcatcacccgcgcgttccgggaacgggccggacggcactacgtcgataccggcatcgccgaagagcacgccgtggcgttcgcctcgggcatcgcacgggccggcggacgaccggtgctggccacttccgcgacgttcttccagcgcacgttcgaccagttgcagcaggagctgtcgctgaacggcaccccagtgacgctgctcgacttcggcggcggactgtccggagccgacaacacgcattcgggcgcattcgacatcgccatgttcggcaacatccccgggctgacctgcctggcaccgaccagcggccgcgcgttcctcgacatgctcgcctggtcgacgagccagagcaacacctctccggtcgtcatccgggtgccgggcgacacgattctcaaccgggagcgctcgggcgacttgcccggcgacgcgcaggacgtcacggacatgggctccgcggacgatacgtgcagtaatgcgtgcagcgaaaagaccacggccgatggaacagccacctgcccgtggtcccgttaccgcacgattcgccgcggcacgactgtggcggtcctggcattgggcaacacgctgccgttgggatggcgcgtggtcgaggctctggcttcggatgtccggcatccccttgatgccacactgatcgatccgcagcagttctccacgctggatgccgcgacgctgaccgagctgaccgggtgccaccgcatcatcgtgacgctggaggatggacagctcgaaggcggctggggagacaaggtcaccgccttctacgccaatgccgggctgcgcgacatgcgcgtgctgaatttcggcgcggcgaaggagttcaccgatcgcgtgccgctcgacgcgctcaacgagcgttatggcatgaccgtcggcaacatcaccgcgcgcatccgcagcgagagccgaggctgaaagccgcacttatcaggccccgtcaggcccacaaggacgtcgaaaaggaacagaaagcccgttggaaccttattggttccaacgggcttcaccgtgaccccggacgggctcgaaccgtcgaccttgagattagaagtcacatgctctatccagctgagctacggggccgaacaacgaaagaacagtgtaccatcaccgcggcacgttcagggatatgtgtccgcgggcggcgcggcaagtcatatccgccgccccctcaccagtggccgggaaccactgcgccgcagtcggggcagcatccgtcgggtccgatgcggtcggacagtatcgcgtaccagtcgcgcacgatcaggctcgccccgcacgccgggcagaatgtggtgtccgctccagcagcgcgtaggcgagggcggcgaccgaaccggagtacacgtatccggcatgcggcacaatcaccgccttcggagccccctgcggcagacgcggcgcgagggacgacaccagtctgcgcgcatggttcatctgccggtcaatcatggcctgcagttcgccggcgttggccggatagaacgcgccggctacggcggccgggcggacggtgccggcctccttgccggaatcggaaacaaccatcatcatgacgcctcctcacatctatctccatcgtagcctcgcgcggcgtcaacggctacggggacgtggccggccctgcacgactccccgcacgagccgcggacggaaccggcatctcctgttgcgtcgctaagtgcgcgccgaaacgacgagtacgcgaacataggaacgcaaatgatcctgtttgcgtatcaaagtgcgcgcggtcgtcgtttcggcgcgcacttagggacgcaaaccggccgacaacgtcgcgcaggccgcgcgcgaacaccacatagcggccaagcctccacccccgcaaggccctaatgcggccaaatacgccgaactgcgctgattttcgatgatgattcagcgtgtctcctcgcaacgttactatcagactatggggaatgacacaggacgaatgccggccgcggcgaacgacggctcggtcggcagtacggccggcggcagcccggacgccgccgccccctatgccacaccctctttcgcgcacggcatcgttccgttcgaccatgagatctcatcgaaccagcatctgacgttctcatacgccgagcaatcattcgcctcagcgaacatcccgtgggatccggatcatgacgcgctgcatctcaaggagcgcggcatgttcaccaacaccgcgctgatcatctccgaccaatgcccgttcaccatcaaatgcgcgacgttcgacggcgacgtcaaggcacccatcagcgagcgcatcgaactgagcggctccatgatcagacagctcaatgacgccatgacgttcctgaacgggcacaacagacgcgacgacggccgccaatgcccaccggacgcgctgcgcgaggcgctggtcaacgccgtgctgcatcgcgactacgcattccccggcccgactctggtcaacatcttcccaagccgcgtcgagatcgtgtcactgggtgggctgatggacggcatcgagatcaacgacctgctcaacggcatcagccagccgaggaacccccggctggccgaactgttcaccagactgggattcagcgagaattacggcaccgggatccgccgcatcatggaggaatacgacgaggcctccgacaacccgcagatccgcgtgggcacgtcctcggtggtgatggtgctgccgttgccgtcgcagccgtcgccgggtggatcgcgcacgcgcggcgacgccacaaagggcggctccgcacaaggcgccgacgggcacgacgccgcccaaggccacgcgaagatgtacgcattccccaccatcatgacgacggccaccagcgatccgaccgtggctctggccggcacacgcgtcatcgggtgcgtccccgtgcgcctgtcggacgggtcggcgctgcgcacgtcgccgctcatcgcgccgggacgcatcgcatctcccgcggcaaccgcccaactgccgccgaacgccggacagacgctcgaagaagtgaccctgcactgcatcgcacaggccggcgtgccgttgagccgccagcagatagccgacaatctcggcgcgaccaagaaccagatgacgtacgtgctgcatcatctggtcgagcagggactggtcctcaaacgcggcagatcccgggccacgcgctacagcatgccctgacgcgggcgccggcggagactcccccaccgaaaattcaatttccgttcatctgcgctccaaccgcaggcagtcatcccctcaactcggcacagtagtctcaagactggttccgaaacaaggagatagtaccgtgcaatcctcggtgggcgttcgcgaacgcatcgatcatgtgtatccttccctgcgcccggcggaacaggcggtcgcacgatacgtgcgttcccaccttgacgaggccgcgggactgacggtcggccagctcgcagaagtctcccgggtcagtcagcccaccgtcatccgtttcgcccgcaaactgggcttcggcggataccgtgagctgcgatacgtgctgcgccacccgcaggaggaacgctcggtgaccttcgacccgctcgaaggcttcgacctcaatccgtgggacaatcccgacgatgtgccgggcaaggccatgacccgggcgaagacgctcatcgacgagctgcattcggccatggacggcaaggcgctgcacaaggcgacgacgctgctggcgcaatcgaggatgatcgacatctacggcgtggagaactccatgtctccggcgctcgacctgtgcaccaaactcacttatctgggactgcaatgccggttcaacgccgacgcctacctgcagcagatcggcgcggggcatctgacgaaggacgacacggccatcgcgttctctcactccggcagctccgccgacaccgtgaaagcgctgaaactcgccaaatccgccggcgcgcacaccatcgctgtcaccaacaacaccggcaccccgctggccaactgggccgacgtgacgctgctcaccggtcgcggcgacatggcgatttacggcaacgccatcttctcgcgcgtggcgcacagcatcaccgtcgacatgctgtacatgagcgtgatcctcagcgattacggccgattctccaccgagctcgaccgttccggccgcatcatcgccgaccgcgagttccgcggctgaccgccatcatccgcatatccgcaaggctccataagactgcacaacacacgcaaggttccatgaaggctcgcgttccgtgacgctcagcccattccacccccgcaaactacagaactacgtgcatcagccgtaatcgaactcgttgttcactctcctttcccccaactttccaccagatcggaatccggccgccccgcgggagccgatgatggaatcacggcgagaagttcgtccgtgacacaactgaacaccggacgggatgccataggcatcacacgcaatggcgccgcatcaggcggcgcgacggaaggcaagcgacgaaatatgctcgactcagccgacggtgttaccgtagacctgcgcttgcaggtccttgcgagaggtctccaatttggtgatttcgccgagcagttccagtttttccgagccttcgggcatgccggccatgcgccggcgcgccgcggcgatgcgccgcatgtatcccatgtccagaagacgggccaacagttcggcggcgtaccgggtctcggcggggctcgccggacgcagctgcacggccgccgcattggcagcgcccggcacgccggatccggcgacggcccgatcctgatctgacggaggcaggggcagctgcagcaccgcgagctcattgatcaccgtcgtcagcgtcaatccgccggccttgttgagattatgcatccacaacccctgcggcgcatcatccggcggcaatccgcccgcggcctgaatggcgaggaacaacgcgcggaacactggggcgacgaacgagtcctcgttgagcgacgcgaacatcgtgcggttgatggcacgcggaatctgaatcagcgtggccatgaactgctgctcgcagatgaacaccgcatcgtcgatgcggaaatacgactgctctgtggcagctcgatgctccaacgcccggcgttcggccggattcgcatacggatccgagccgggctcgacacgaggctggcctgcgccctcgccgttgcccgcgccgaaacgacgccggggcgaataggcgtcctcgtcgcgcacatgcagctggccgtgcgccgaacgcacctcgcgctgcatgatgtccagatccaccccgatgcggcgcgtcgccttgcgtgcatacaggtcacgctgcgaacgatcgcgaatctgggcgatgagcggcgccacggccttcaccgcgcccatctgcccggtggcatacgtggtgtcgaaccggccgatcgcggcatcgatcacaaaatcatacaacggcttcgcatgctcgatcagcgagcgcaccgcctgatcgccacggttgatgcgcagatcgcacgggtcgagattgtcgtcggcaacggcgacgaacgtctgcgacaggaacgccgaatccaatccgaacgcgtgcagcgcggccttctgccccgcggcatcgccatcgaacgtgaacacgatgcgcgagctcaatgcctgcccgggaacgttcagcgggccgaccagctgcaccgcgcccagcgaatcatcggcgaccagccgccgcacgatcttcgcgtgctcggcgccgaacgccgtgccgcaggtcgccaccgccgtatcgatgccggccagatgcatcgccatgacatcggtgtaaccttcgacgatgacgacctgacgcttcttcacgatggacgacttcgccaagtcgatgccgtacagcacctgcgtcttacggtacagctgggtgtccggcgtgttgatgtacttcgcggcgatctgatcgtcgtcatacagcttgcgcgcgccaaagccgagcgtgcgcccggtcgaatcacgaatcggccatgtggcgcggccgcggaaatagtcgtacacgccgcgttgcccctgcctcgcaagcccggcgtcaagcatctcctgctgcgtgaaccccttggacgcaagatagcgaaccagattgtcccacccctgaggcgcgtacccgcagccgaaacgctcgcagtccgcccggctgaaattgcgtccgccgagcagcttgcgcgcggccagagcctccttgctcatgatctgcgacatgaaaaaacgctgagcctcctcgttggcctcgatcagcctggcccgcttcgacccggaatgctcggtgcgcccaccggaattctcgtaatgcagctcgatatggtatttatcggcgagaagctccaccgcctcgcggaaatcgatgttctcctgatgctcaacgtagccgaacacgtcgccgccgagaccgcagccgaaacaatgccacacgcccagcgcaggccgcacggagaaactcggcgtcttctcgtcatggaacgggcacaggccgacgaacgtgccggtgccggaaggccgcagcgtcacgctcgcggacacgatgtcgtacaggtccgcggcggcgcgcaccttctccacgtcttccttcagaatcattccagccatagcccaccagtctaacgtcagccgtgcctgaggccgccgcggccgtcacaggatcgaatgcaacgcaagggcggagctgtcggtgagggaggccacctggtcgaccgcgacgcgcaggcgctcgccgtcgttcgtcgcctcgtcccaatcctgcaggagcacggcctccagcgcactggaagggcgcggagaatcggccatgagcacgtcgatgagatcgttgatgatctggcgttcctcctggtggaacggctcgtgctcgcgaggagccatcacgaagtacacggcgatgcccttgagcgccacgatttcgtagctggtctcctcggggatcaccacgttcgccgaataccgggtcagaggcccgtcgccgtacgtgtcgcgggtcgcgttctccaccgaccatgcgaagcgtccgatcaggtccgaggtgatgttcttcagttgcgccagcgcctggcgcgacccgtcgaagtggtcggggaacatgcgcagccgccgcagccttccgaacgcccgctccagctcgtcggcatcccatttcgagccgtaccatgagcgcgtcgcctcgatgatgcagccgatcattcgcgggtcggcgagcaccagtgggttgaacgcgccggtcgctatggcgtcctcgacgtcgtggacgctataggcgatgtcgtcggacaggtccatgacctggcattccatgggtttgcgggcttcgggagctcctgtcttcagccagcggaacacgtcctcgtcatccgggtacacgcagaacttcacgccgcggccaccgtcgtacttggccgcttcggcgagggtccacgggtatttgacggccgcgtccagcgaagccctggtcaggttcacgccggccgaccggccgtcggagtggaagaccttcggctccagccgggtgagcaggcgcagcgtctgcgcgttgccttcgaatccgccgatgccggcggcgatgtcggcgagcgcccgttcgccgttatggccgaaaggcgggtgaccaagatcatggcacaggcacgcgcaatcgaccacatccgggtcgcatccgagcatggctccgacctgccgtccgatctgggcgacctcaagcgtgtgggtgagcctggtgcgggcgaaatcgtcggtgcccgcgacgaggatctgcgtcttcgcgccgagcctgcgcagcgccgacgagtgcacgacacgggcgcggtcgcgctcgaaggcagtgcgcgatttcgacttcggcggctcgcccgcccagcgctgctcgtcgaatgcggtgtacccctcccctgctggtatgcgttcgccgctgtcctcggatttcatgggacctcccttgccgtcgccacgttccggtatccagtttagcaaagggttccttggacggagccggtcacgccgtcctcgcaatgcgtgcaatgtacgcgacgcgcggcgggtctacagcaggctcgccggatcgagcttggcgaggtccgcggcgggcagcacgtcggcggcatgcaggtagagcctcgggatgcgattgcgcagacaggtgaacacctcgtagctaatcgtgtcggcggcgcgcgcccagtcgtcggcggtcggctcgccgtattgctcaccgcgaccgggcccgaacaactccacggtgtcgccctcatggacgccaagctcggcggccgacccgtgcaggtcgacgatgaactggtccatgcacacgcgaccgcacacgtgcagcaggcgcgggccggcgctggtcatcacacgcacgggaccgccggccttctcgacatgcttggcgccctgcatgtcgaagccggacgcggaacggtggatgccgtcggcgtagccgaggggcacgatggcggtgctggtgttgtcgggcgtcaggtacgtgcgaccgtacgagacgccgtgcccggcctccacgtccttgaccgtgccgagctgcgcctgcaatgtcatggcgggcttcagatgccagtcacgcggcgtgcccatcgccgggtcgggctcgtagccgtacaggccgatgcccggacgggtcagttcgaaatgaatctcgggacggttgagcgtggccgcggtgtttgccagatggcgtatttcgggcgcgatgcccgcggcttccatgcgacgggtgaattccgtgaacgattcgatctgccggtcggtggaggcgacgaattcaggcacatccggcgagtcggcgaccgccagatggctccactggccgacgatgtgcagcacgccctcatgcgcgagcggcaccagcttggcaagagccgcgtcgaatccggccggcgtgaagccgttgcggccgaagccggagtcgaccttgacatgcacgcgtgcgggtttgccgagccggcgcgcggcgtcggcgagcgcgtcgatgcccgccagcgagccgacggagatgtcgatgtcgttgtcgatcagctcgtcgaacggcacatccatgccgttgtacacccatgtcagaatgcggcagcggtccgggccgatgccgagtttgcgcagcagcagcgcctcatgcgattgcgcggtgcccagccaggtcgcgccgcccgcgagcgccgccagcgcggccggcagcagaccgtgcccgtaggcgtccgccttgaccacgcccatcaccgccgtgccggaatgcgggccgcccaccacatcgaccaagtgggccatgttgtccctcaacgtggccaggtcgacgatcgcctgcgcggggtaccggcgtcgcgccgcccggtagttggcctcgccagccggggatgaaaactgcaattcggatgctgcgttcaaagtcatggctcttattgtggcgcggcatgatgacgaatgccggagcgcgtcgcatgacggcacgaatccgacctcagccggcagcggcgttgtccggcgcattgccgtatgctgtacgacgcatattcgcggcgtccgcggtcgaccgccgccgcatcagattcccggcgttgaggcgtgccggggtcccggaacgccgtccggtacagcccaatccattccatatattgagagaagaccatggatctatttcgcaagaaatcggtggatcagcttgtcgccgaatccaccccgctcaaacgcacgatgcacacgttcgacctgacgatgctgggcatcggggcgatcatcggcaccggcatcttcgtactcaccggcaagggcgcgctgaccgccggcccggcgttgatggtgtcgttcctgctggccgcggtctgctgcggcttcgccggcctgtgctatgccgaattcgcgtcgatggcaccggtttccggctcggcatactcgtacgcctatctcgcgttcggggaactgatcgcgttcgtgatcggctgggacctgattctggagtacgcgctgcaggcggccacggtgtccgccggatggagcggctatttcaacaagctgctcgaagggttcggactgcatctgccggtcgagctgaccgccgcgtacggcaccaaccccaatacgaccacatacttcaatcttcccggtttcgtgatcgtgctgctcatcacctgggtgctgtcgatcggcatcaaccagacgaagaaggccaacgacatcatggtgctcatcaagctcgcgatcatcgtgttgttcatcgtgtgcgtcatctggtatgtcaacccgtccaactggaagccgttcgcgccgtacggcatctaccagttccagcccggttcgacgcagccgtatggcatcgtgccggccgcgtcgatcgtgttcttcagcttcatcggcttcgacgcggtgtcgtcgtcggccgaggagaccgtcaacccgaacaggacgctgccgcgtggcatcctgtattcgctggtcatctccacgatcctgtacatcgtgatgacgctcatcatgaccggcgtggtgccgtatgagcagttcgcgcagttcatcgacgcgccggtggccggcgtgatcctgaagaccggcatgaactggctggcggtgatcgtcaacctcggcgcgctgatcggcatgaccacggtgatgctggtgcagctgtacggccagtcgcgcatctgctacgcgatgagccgtgacggcctgttcccgaagttcttcggcgacgtgcatgacaagtaccgcaccccgttcaaggggacgtggttcttcggactgctgaccgcgttcgcgggcggcttcatcaacatcaacgtgctgttcgagctggtgaacatcggtacgctgtccgcattcattattgtgtcggccggcgtgatgtggatgcgcaggacccagccggacgcgcatcgcgggttccgcgctccgggcgtgccgttcacaccgattctggcaatcgcattctgcatggtgctgatcgccggtctcaattgggagacctgggtgcggttcgcggtctggttcggcctgggactgatcgtctacttcgcctacagccgcaagcgctccaagctgaacgcatccgacgcggaataacgtgctcccgctggcaggggctgtcgcgaagcaactaggggtggtcttcacggccagtagtgcatcagaccaccctcggtctcgctgcgcgcgacagctcccgccagcgggagcacgttcggcgactgaggagcaacgcaggcgacgcgccgttgtttcgtgccgggcgttaccactcgtgacgctggtatgcgatccttgtcgtatcggtgggccggtcaagcagctgtatcaggccgcagcgggcgaatccgctggtttcgaggacgtgctgcatggccttgttgttggggtgggtgtcggcgcggacgttgccgtaatgcttgagggcccaggcgatgcagtcgcgggcggcatgcttgacgaggccggaggacgcgatgcggtggatggtgacgtaggaatcgtcgtcgagccaggcgccgtcgatgtgatggtaggtggggtcttcgccggggcatagcgcgaattgcgcgaggatgcgctcgtgtccgcccacttcgtcgacgagcagcatggcgcgtcgctgcgcgatgtcgtcgcgtacgacgtcgtctttggggaaggtgtcgccccattgggtggggttgccgttgcgtgccatcagctcgcgggcgcgcgcgtagttcttctgcatgtgcgggtagtcgcgcatggtcgcgtgtcggaatcgccgctgggaagcactgtcagtcaccggtcacctcatgttcgtgtgttggacaactggccgtaaggctatcatgggcactcgtccgattggagtgcatgtgccgtttaccgggagtcgttatgatgagggcggatgacattcatcgaaggagagcaagcgatgagtacgtatacggtctcgctggaaccggcgtcggaggatgacctttcgctgttcgcgcagtggtggaacaactgcaagattgcggacggatgccgcaaggaggtggatccgctgccggtagaggacaacatcgagcgtttccgcatctggtgccatgaggagtcggattccggtttcgggtatgcgattcgcaatcaggaggggctgtgcgtcggctgcatcagcgcctggggtattgccgatcccgagcgtgacgcgacgctgtcgatcatggttggaccgtactatcaggggcatgggtatggcagccaggcgctgacgatcgcgctgcaccggctgcatgacatgcgagtggccacgatcacggtgcgtgtggcggctcataaccttcgcgcccgtcacatgttcgcggaacgtggcttccgggagatcgaccgaatgcagcatgcgatcgagcgcgacggcaagccgttggacatcatcgtgatgcgggcgagcgccgaggatgcagtgaagacgctgtggcaggataatccgtatgatgattcggtccagctgattccgcggcgcaacatcttccgcgtggaatagtcgacgcatgaggtagtgacgaaacaacgatgagggcggcaccggtccgataccgatgccgccctcatcccataacccggaccaatgccgggaatacggctgtgtcggccagtcccagcctcagacgaccttgcgctcgaacgggtcggagctgatgcccttggcgaggatgtccttgcaccactccttggcggtgaacaggctgtggtcacggtagttgccgcagctttcgacggtcgtggcgggaatgtcgtcccacgtggccttatatgcgatgaattccagcgattccttgagggcacgggccacatcctcggtggagtgcgtgccccaggtcagcaggtggaagccggtgcggcagccgaacggagagcagtcgatgtagccggggatacgttcgcgcagcagcacggcgatggtgtgctcgatggtgtgcaggcctgcggtcggaatcgcgttctcgttgggctgtaccagacgcaggtcatagttggagatcacgtcgccgttggggccggtctcggtgtcgatgtaacgcacgtacggcgccttgaccttcgtgtgatccagctggaaactttcgacaatcggcttttcttctgccatcgcagactccttttgctcgatatgacgccggcgcgtacgaccgttagccggcattccatcgaccattgtctcactatcgcgcgcgtctcgccgcattcttggctataggcgttcctcatatacggcatatacggcacgaggcgagtccggtgcgctgtaacggcgctgtcaatcgtcgaagccggcgatggcctccatgaatcgcttgccgtatttggccagcttgctgtcacccacgccgttgacggcgaggaactgcgcgtcggtgatggggcggagacgggccatgtctcgcagcgtgcgatcgttgaacaccatgtatgggggtaggctgttctcgcgggcgatggacagacgcagttcgcgcagtttctggaacaacgtctcgttctcgtcgtcgggggcgtacgagcccaatgccgggccgtccgacgccgcggatttcgaactggaatcggtccgtgacgtcacgcccgttccggcgccggcggccttgcgctcgacccgtttgatctcatatcggaattcgggcgcgaccgtttccgccgcgcgctgcccgaagccgacgatcggcagccgcccttcggcgatggagaggaatccgtcggtggccatctggctgagcacgtcgcggattcgggcttcgggcgcatcgtgcagacgaccgtagctcgggcacctgtcaagatgccgcgcgatgaggtccttggccttggagccgcgcagtatcgccacgattttccccgagccgaggccttggcgcacggggccgcacgccggtcgcccctgatcgtcgtaatcgtacatggcatcgtgcacgcatcggctgattgaccgcgcgatgtcggtcacgtcaagggtttcgaacgtgctgtcgcaattcgtgcaaccgcccgtgcatgtgccggttcttgacgtgttctcgccgaagtagcgggtcatgtagacgtgcaggcagtcggtggtacggcagtagccgatcatgccgtccagcagacggcgcttgctcatgcgcacggtctcgcgctcttccggggtcagtcgttcgttgtcgttatccatgtcgagcaggcgccgacgggtgacgatgtcggattcgttccacagcagcgtgcagcggctcggctccccgtctcggccggcgcgaccggcttcctgatagtatgcctcgatgctttccggcatgttgtggtggatgacgtagcggacgttcgacttgtcgatgcccatgccgaacgcattggtagcgacgactaccggcacggcgtcggtgacgaagtcgcgttgcgcctggttgcgtacgttggccggcattccgccgtggtaggcgaccgcgacggggccatcgcgcatgacggaatctgccgcactgccgcccgccgctccgcgcaacgccggcacggtgtggttgagggccgcggcgagtgcctccgtctccttgcgcgtggcgcagtagacgatgccggattcgtccggatgctcggctacgtatcgtgcgacccatgccgccttgtatttggtctcgatcttgagcacatcgaagtacaggttctcccggtcgaatccggtgacggtgacttgcggggcgttgagccccaggataccgatgatgtcgcggcggacgcgctcggtggcggtggcggtgaacgcggctacggtcgggcgggccggcaggccggcgatgaactcgccgatgccgaggtacgacgagcggaaatcctgtccccattgcgacacgcagtgggcttcgtcgacggccaccagcgagataggcacgcgtgtggcgaagttgcggaaccgttcggtttccagtcgttcgggggccacatacagcagtttgatgtcgccttgcgcggcctgcgccagcaccatggcctgctcgtcgccgccctgcgtggtgttgacgtatgcggccgggatgccggcgtcgttgagcgcgtcgacctggtcgcgcatcagggagatcagcggggagatgacgattgtgacgccgggcagcagtgtggccggaatctggtagcacacggattttccggcgccggtcggcatcacgccgagcacgtcgcgcccggcgaggatcgcgtcgacgagccctgactgccccggtcggaacgagtcatagccgaaataccgtttgagcgcccccagcgccgccacctgatctgtcatgcctcccaacattaccgcattccggccaccgctccttcgagtacagcgtcggggctgcctctctccccttctctttccttctccgtcgtcccaaaagcgtcgttaagtgcgcgccgaaacgacaagtgcgcgcacttatggacgcaaaccggaccttgcatgcatgcccgtcggcgtgccgccgaatcagatggcggcgaaggcctgctccaggtcggcgatcaggtcgtcggcgtcttcgatgccgacggacaggcgcaccaggttcgcgggcacctccagcgtggtgccggccactgaggcgtgggtcatcgcgcccgggtgctcgatcaggctctccactccgcccagtgactcggcgagcgtgaagatctgcgtggcgccggcgaaccgcttggccgcctcgaaaccggccgcgatctgcacggagatcatgccgccgaaaccaccatgcatctggcgggccgcgatctgatgccccgggtgggattccagtcccgggtaccacacgcgctccacttccggacgggtttccagccattgcgcgatcttcagcgcgttttcgctgtggcgctgcactcgcacggccagggtcttcaggccgcggatgtccagccacgagtcgaacggggatggcaccgcgccggcggcgttctgcaggaacgcgaccgcgtcgcgggtttcttcgtcgttgagcacgatcgcgccgccgaccacatcggaatgcccgccgatgtacttggtggtcgaatacacgaccgcgtcggcaccgtcgtcgagcggatgctgcagcaccggggaagcgaacgtgttgtccaccacgaccttggtgccgtgccggtgcgcgacgtcggcggtcgcggcgatgtcggtgatgttgagcagcgggttggagggcgtctccacccagatgtaccggtattgcttggcttcaagcgcggcggcgacggcggcagtgtcggtgatgtcgaccacgtcgagcccgatgccccacggcacgaacaccttggcgagcagacggtaggtgccgccgtacacgtcgttgccgagcaggatgttgtcgcccggcttcagcgtggcccgcagcagcacgtcaatcgcggcaagtccggaagagaagctcagcgcgtatttcgcgccttcgacggcggcgagctgcgcgtcgaagctgtttcgcgtgggattgacggaccggctgtaatcgtagccgttgcgcagtccgcccacgccgtcctgcttgaacgtggaggtcatgtagatcggcgtgacgacggcgccggtggtcgggtcaggctcctgtccggcgtggatggcgcgggtggcgagagtggtgttgacgagggctgcggcgttggtggagatggtcatgatggttgtttccttatattgcagtttgttgtattgattcgatattgagatattgaagttcgggttcgcggacgcggttcaggcgggccttggccgggccttacaggtactgttcggcaagtgatggcttggaggtccgctcgacgatgtcgccatagccgttctcgcgcatccagtcgtcgttgaagatcttctccagatagctgcggccggagtccggcagcagcacgacgacgacctgattgctgtccagatcgtgctcacgcgcgtatttcagggcgctgacgacggccatgccggacgagccgccgacgagcagtccttcctccgaggccaggcgacgtgtcatctcgaacgcctcgcgatcggtgacctgcacgatatcgtcggtgatgttccggtcgaacgccttcgggtagaagtcctcccccacgccttcaatgtcgtattggtgcacgtcgctcgggtcggagtagatggagccttccggatcggagcccacgaccgtgaccgcgccgtcagaaacctccttgaggtatttgccggtgcctgagatcgtgccgccggtaccgatgccggccacgaaatgcgtgaccttgtggtcggtggcttcccagatctcggggccggtggtgtagtagtgactcagcggcccgttggggttgtcgtactggttcgggcggaatcctccgggaatcgtgttggcgaggcactcagccacctgatagtaggaccgcgggtcgtcggggcccgcatcggtgggggtgacgacgacttcggcaccgtatgcgcgcagcacggcacgcttggattcggagaccttgtcgggcagcgtgaagatcgtacggtagccgcgctgctgtgcgacgagcgcgagcccgacaccggtgttgccggaggtcggctcgacgatcacaccgccgggcttgagttgtccggagcgctccgcggcgtcgatgatgcgctccgcgatgcggtccttggaggatccaccgggattgaaatactccactttgacggcgatggtcgccttgatgccgtcagtgacgtgatgaagctttacgagtggcgtgttgccgatgagttcggaaagactgttgtgaatggtcatcgtggatcctgtttccttctgcgtttcgattggtgcgttattcggtttcgtataccgggcagatgggttgaacgcagttgaaacaggtggatggtgatcgtcgatgatggtgttggtctttgccgtcccgttgtatgacctgctacagatattgttgtgccaatcatgcgacatcggggaatcatcaagaatgaaccgtatttcaagtatgcgtcgtcaaccgttcgcccgcaggcgtcggtcagcgacaacaacatgaaagatacgtcatgcctgacatagtatcagcatctcagaaagacacgcgacagcgcatccacaatgtgatatcagatgactgccgtcattgcgctagcccataaattgcatagcggcgtgagtggacccatcgaatgtcatttcgacgaatccactcacgtaccggctagtctttcacctgttcgtacacttgcgcaggtgtcagctctgatggaagctcatcccccgaatctacgttgactcgctcaaataccggctgccatgcatcagaagcgttaccatgttgagaccgcaaaacgttccacgattgttgcgtatcgtcggtcactcggtatacgccggcagtcgcaccggtcacatagtactgagatgactgttctccaggcaaatcggtcggcgtaagaaacaacatgaccacgtcaccggtctgcagcagagtctccgcgctcccctgctccgcggaaccagtctgacgtacaataatgctgccactgttgacggttcccttaagcgtctgcgagaccttcacgtcaagtaacgtgaaatcagtaatatcatcaatatcccgaatcacggaagttctcgatatttctccggtaataatcaggggactatcgtcctcaagttctaccatggattcataaatgcgtacccgcgactgagaagcatccggcttgggaacattagattgtgccgctgtctgaccgcaacccgcgcacgtaaacatcaacactaccaaccccataagggtcgttagccatctaatccttgaaatcttcttcatcgtgtcacctcaatatctactgttaatacctttgatatcatctgacgtgagatatctgacaccattgttgtaagcgtcagatgcactcttgtacatcactgtattgatcgtagaatgccccaatccccaacaatgagaaaactcatgaagccaaagcactctcatgcgggcaaccgggtaagatgacttcatataataggtatttacacgcgaaaccgcgtctttagtatacccggacgctaaaaatgtataggccgattgtccttcccacccattcttgccgaaattctgagaagttgcctgccaaaccatccgcgttccggtcgagaatccaactttcgttgctgaattaatattggagacagcctgcttggccgaagtcaagtaattgcctttcaccgtggccataagcattacaacctggttcttattgagccaatgactcttgctataagaataggcactcgcgactggcaccatgctcatcaaaaataagaatgacaatagcgttgatactaaacttattggccacttcctgcagcgttgcagcttagacatcttcgcacctttctgataagaacggaaagttacagagacaggatttatatccgtgaagtagcaacacagcaacctatgctgttattaatttataatactcgatttataagaagaaagcaaaaacatacacaagaagggcccccgggggttgttgtcctcgtccgggggtccttgtcgtgtggtgcggcggcgtgctactctcccacacccaccgcaaacaccttggactggccgtctaaccgtccaaaaaaacatccgcacccccctaccgcaattcgtagtgccttcaaagagaatgctcgattgcttgatttaggatgggaagattatgttgaggaggcaagagctacagaagataaaaataattgggagttcctctatgacagaaaacaacttttgaaatattataaatttgatccagaaagactgctttgtccttattgtggaattgagccttctagaacatttgatcatttcttacctaaaacgatatatgcatcgttgagtactactccgttcaatttgattccatgttgtcctacatgcaattcaaaaaaaggatcatttaatcctacaaagaacgctttctttaatccctatcttgatgaaagttattctaattggctggctattgaggactttaaattatgtgagcatactttattgattacatataaaattaacgaatttgatagttacaaacaagggaagaagtttaaaaatacagctgatacgttggatcttctttctcgttacagcttaagggctgttcaatttattctaaataaaaaggactatataaaaagaagatgtacagatgaaagagaggtcagagaactctttgaagactatttgggttttctttcatcggaagaaaatgacaattggaaaagagtactgtgtgaatatattcagaaagaatcttctaagaaagcgcgagagatgttgctgaaatattgcaacgtctcaaatagatgggcatcttttagagatggtgtgcgtattccagaatatagacaatctttagataattatttggaaaacaccattagtaatggcgaggagaggaatatttattttatctctgatgaaaaatttgatcaaaaaattgtatgcataaccaataagatcagtcgagtcttactcaaagatgagagtaatttaagtgtttttgtgccggagataatcaatctttcagattgcatggatgcagaattctatattttcgattcgcagggttgtacgggaattcgttataaatgtattggttgtgaacatggtgtgattgtcttgaagaaagacgcacaaagaacatctgaggtaggctgattgaaagtaacagaattattatctgcacaataattgaactgctattcaaaggcgataggaagtgaaatcaccatggacgccggcaagaaaatcctgttggacttattcaccggttcgcttcggttcgtcgtgccggtgtatcagcgcagatactcatggggcgaggcgcagtgccgtcaattgtgggccgacatcatagccgccggcagacgcccggatcgaacgcatttcaccgggtcggtcgtatggatgcaggagggcggcatcagcccggacggcgtcagccgttgtctgctcatcgacggtcagcagcggctcacctcggtgaccctgctgctcatcgccttggcagaatacgcccacgaacacccggagaacctgcgcttctccacagacatgatcatcgaccgcggttatcttgtcgacaagtatgcgactggcgaaggccgctgcaaactgacgctttccggcgacgaccgggacgtgctgcgcggcatgtgcgaccatgtgcttgcccttgaccggccgaatcatgggaaccaggccggaacaacgtcccagctggaagcgaacctcgatctgttccgttccctggtcgccgcaatcgatgacgtgaacacggtgtggaacggactgcaacgccttgaagtcgtgtccatcaccctggaccagggacgcgatgaaccgcaactggtattcgagtcgatgaattccaccgggcttgatctggagacttccgatctggtacgcaactacatgctcatggggtgccccatgaccgagcagaacaccctatacgtcgactactggctgcccatggaacgtgttctcggcaacctctcattcgatgcgttcctgcacgactggatggtcgttacattgaaaaagcccgtaaccaaaggccgcgccatgtatacggaattcaagcgttttgcagccgatagctccatgccgcgcatggaacgcacacacaatcttctcgagaacatgctggaatatgccgggtattatgccgccatcaaaggcatcgcgtctgccggcagcggcgacgcgaacgtggaccgccgtctcgcctcgatccaaaccctggacagcactgttatggatccgatgctcctgtacatgttcgcggcatggaagcatgaacgcataacccgggacgggctgcggcgcatgctcgcggatctcgaatcgtatctgttccgccgaatgatctgctcggtatccagcaacggactgaacaagctcgtcccgtcgttgatcgccaagctcgaatcagcggaagacgatccggccgaaaccttcgccgcgctgctcctcaccgaaaccgccaaagccacgcgcatgcccacggataaggaattcaggcaggcactgctcggcgagaatctgtaccgccctgcctcgcgctgcaaatatctgctcgccggattggaaaaccacaaccatcccaaggacccgcggtccttcgacgaatacaccgtcgaacacatcatgccacagaacgccatggcgcatgccgaatggcgcgatatgctctccgaccccggacgattcccgctgctggtgaacagtctgggcaatctgacattgaccgcatacaactcggaactttccgacggaacattcgaacagaagaagaaccgtgcgatcggcgggtatagtagtgaatacctgtccatttccgccgaactgcacgacgctacgcaatgggatgaacaggcgatcgcgcggcgcggcgtgcgacttgccgatcttgcattgcaggtgtggacaagccccacagcgggggaacaggctatgcagactctccgcagcaggaacttgagccaaggagagcgcgaacagaatgccgtcgatttcgccgacttatgcaagagagggatccttacagccggtgacatgttggaaagtcggtatgccggcgtaaccgccacggcaaccgtaaccgaagaccatcgcattcgcctgtccaacggcgagatattcgatagcccatccggcgcgttccgccgcgccagaatgctcgaaaccggcgagaacaagcagatcaacaacggttggacagtgtggaaagtcgcggacggcagaaccttggacgaactgcggcaagtcagcaacaatatctcactgcggcgcagcttctggaatggcctgtatagatatgctgcaacgcggcccgactttgttgctgtatacggcgacccatccggtcgcaagacgaacagcgacacatggatcagcttcggcgtaggctcggggttctgccacccggatggagcgttgaatattcgagacggctacattacggtcgacctgtatttcatcgacacgttccagtacacgaaactttacggcatgaaggattccgttgaacggatgctgtctgctttgggcgaggcggcttgggacgagccggaagccgacaagaagaaccgccaccttttggtacggcatgatgtggatttctccggcggtatgacggaagcctaccaatggatgacggacgggttgctcgccatgcgcagcgtgtacgatctgcttgtctgattgctcgatctgctacgtgttcagcactgtatagaatgagcataaccatccgaaaagaggccgccatgaaatacgggatgaggaaacccagctggaagaaaagcctgtctgcgcgtacgaagggccgcgccacccgcgcggtcaagaaagcgttgatctccggctacggcaagaagggcatgggctggctgcaccccaagcgcaagctgtacaacaccatctacaagaagaccacgttcagtctgttcgacctgttcaagtaaccggggctaaagggggaaatcacatgtgttccaatccagatacgtacgagttccgactttcattagaccttcctcaacagagcgccgttcctactgatacgttttctgccttgcgggaagtccatgaatattcagcggagaacggcccgcgtttccatacggctgctgagatgtttgattctctgggaatatgacaggtcccgccatgagaacattacgtatggcgggatctgtcttttccgttattgcttagctggcagcgctcagacgagcatggcctcgatgttgttgccttccggatcgtgcacgaaggcggcgtagtaggtcggaccgtagttcagacgcgggccgggctgtccaccgacttcgttcgtatcctcgttatcctcggcactttcgtcgtattcttcgctgaacgagtatcccagattgcgcgtcatcgcattctcgatcacgtcataggcccacatgcgtttgtcatcatatcgagcgaaagcgagcgtgctggaaatcaacagcatgctgttcagtggttcccattgccgcatgtccttgtcgttctcggcctgtgcaatggcgtccaacggcacgcagcgtttgagcagaccgtagacggagaaactggtggcgagcacgatcgccatccacgggaacgtcggtgactgcgcagtgaacatgcccacgcccagcgccacgttgagcagaggcgtagtcaggtacgcgattgaggtctgcagcgcctggccgttgaccaccagatatatgtacagcaaccaattcacgctgatagccgtggtggcggcgagttccagtgcgaacagccttttgctccgctgtgcgcgtcaaagcgcgacgatcgcgcgatgatatgcgcgatagcggcggaacgccatcagcagcgcaatcatgaccaccagcgtggcgatcagccgatacgccagcacgctgatggcattcatgccggacagcgcgtgccagtagagcggcagcacgccccagccgatattggaaacgagcggcgcggcaatccccatccgcgtctgctcgacagcacgaaccgaagtcatacccgccaccatagtgcctgatgtgtcactgccgtgcgtgtgctcacacggcatttgttagaagcttttccgggaatcgaatacaagttatccccgacccaatacggtccgattatctcagcaccgctcccgaatgaaatcgaagatcatatcgaacacctgcgggctccagaagtcgtgctcgtgttctgcgccgtcgaccagcaccagccgcgagtccacgccgtgttcgagaagcctcttgtgcatcttgaccgactgccggtaggggaccacggtgtcggcggtgccgtgcagcagcatcgtaggcggataggccaccccgtcacgcacctgcaggtacgggctcatgtcggccgcccggcggcgcacgtcgtcgctcaatccggtttcatgggtcgccccgaccactgcggcgaacgggccgaaatagtacagccggaacgggtcatcctcgttgccgaacgcgtcgatcgcctccatcatgtcggtgggcgggaagcagctgaccacgaagctcaccgcgtcgctttcggtggcataactgccgtcttcataccgcgggtcgtcggcagtgagccccaccagcagagacgtgttgccgccggacgacgtgccccagatgcccagccgctcagggtcgacgtgccagcgccgcgcgttcgcccgcaggtaccggatcgccgccttgacatccttcagataggcagggaacacggcactggcgtcacgcgaggcgttgcgatggttcaccgtcgccaccacgaatccctctcgcgccagttcggatagctgcgggatctcgtaatcacggtccggtgtggtccacgcgctgccctgcacgaacaccacggtggggtagcggcggtcatcatcgtcgccggtggattgcggcgcgatgatgtccatcaccagatcatcggccccggtgcgatacgccacgttgcgggtgagccgggccaggccggtgagcgtgggattattcggtacgtgaacggtttcgacggttcggtcttctgacggcgtgatattcggcatgaggcaatgttacagcgaatggttctcaataagaaaggtgcgagtccgttatgtgaggaaacgaacacggattacttcataagcccggtattttgccggtctctgaaatgttcgattgtgcggaaatgttcggaatcctcgcacttttcttattgagaacgattcgctgctacatccggaacgcagcgcgcgggtacgctaaactgtgtacagctcagaaactcaccccaaggagatgccatgaacccgagacgcgggccgatcgtcgcaggcgagaagatccaattcaccgaccgcaagggcaagaagatcaccgaccagctgaccgccggtggcgtcacccagaccgagcacgggatcattctgcacgacgacgtgataggccgcaccgagggcgtggtcgtcaccaccgtcaccgccaagcgcgaggctcaggtcaatgcggaccatcccgaacgcgaccggaacaagccgtggaaggcgacccgtgcgatcggcggctggcagtatgcggtcatgcgcccccgtctcgccgactacgtgctctccatgccgcgcggcgcccagatcatgtacccgaaggacatcgcgcaggtcatccagctcggcgacatccgaagcggcctcaacgtgctcgaatctggtgccggatcgggcgcgatgagcgtcaacctgctggatgcggtgggggagtccggccacctgaccaccatcgagctgcgacccgaattcgcccgtgtggccgacgcgaacgccacgctgtattacggcgaacgcccgcggtggtgggacctcaagaccggcgacttcgactcggtcgcggccggcctgccggagcactccttcgaccgcatcgtgctcgacatgctcgacccgtggaacaggctcaaacaggcgtaccgggtcatcgcgcccggcggcgtcctcatcgcctacatcaccaccaccacgcagatgagccgactcgttgaggctctgcgcgaagccggccattggaccgagcccgccatccaggagacgctggaacgcacgtggaaggcgcaggggctcgccgtgcggccggaccatgcgatgatcggccacaccggcttccttgtggtctcccgcgcgatggaggaggggttcgcggccctgcgcaaacgcgaccgcgccaccaaggatacgaccactgacatcgattcgctcacccccgaacagcgcgaggcccagctggacgatctggagctgcgcgacatttcggaccacaagctgcgcaaggtgctgcgtgacctcgacctgcagacgtcccgactgtcgcaggacgaccaggcctgcgagcaaggggaggcgacggcgatctgacagcccaatcaggcgcggcgaatcttaacggcaggcaatgatttggtgatgacgggaagtcgagcgcccctcgtctgccacaatggaggcagtgacgtcgtacggaaaggtcctgaagaatgggcgtgaatctcagcaaggtcgagaaaaaggcgaagaactattcccacgtgctgctggtcatgcggcacgcgaaggcggaaccgttcaacgacaagggcgaccatgaccgcgagataaccgacaagggcgagaagcaggcgaagatcgtcgccaaggggctcgtcggcatgaaactgctgcccgaccgcgtcgcgtgctccggcgcggtccgcgcccggcagacgctggagagaatgctcaaggtattcggcgaccatcccaaggtcgaataccgccaggccctgtacgacggcggcatgcaggccgtgttcgacgagctcgccaacgccaaggacaagacccgggtcctgatggtcctcggccatgagccgaccgtttcggtgagctgccagtggctcgcctcctcggattcggacatggtcaagctggatctgcttaacctgggcatgtccaccgcctccgtggtggtgttcggctccgatcagccgttcagccgctggcaggtacacgacgccgagctgctcgccgtgctcagtcccaaggatttcgactagggatgacgcctttttgccggccggcctctctcgcgaacggtgacggccggcttgtgttataaccaccgtttataacgacaccttaatgcttctgatggcctcgcaatcggcgggttttggtaatctaggcgggtcatagtcgtacataacggaggattcatgcctgcacttacatccgtctcgggattcccgcgcatcggacagaatcgtgaactgaagaagatcatcgaagcctactggaagggcgccgcctcactcgacgaggtgcgcggcaccgccaaggaacttcgcgcgaagcactggaagctgcaggcacaggccggcgtcgatctcatccccagcaacgacttcagctactatgaccagatgctggacaccgcgatcctgctcaacgtcatcccgcagcgttacaagcgactcgccttcacgaaccccgaggagacgctgttcgccatgggccgcggctatcagggcgacaagggcgacgtgaccgccctgccgatgaagaagtggttcaccaccaactaccactacatcgttcctgaaatcgaggagagcaccgagatccgcctcaacggcaccaagccgttcgacgagttcaacgaggcaaaggcccggggcatcctcaccaaaccggtgctgatcggcccctacaccttcctcaagctcgcccgcaacgcgcaggccgaggagctcacctacgacaagggcctggtgaacgcggtcgccgccgtctacgcggaagtgatcaagcgcttcgccgcactcggcgcccagtggctgcagctcgacgagccgtacctcgtgctcgacaaggaggacggcgacgtctccctcttcaagagcctgtacgcgaagatcctgcccgctcgcgaagacaagatcaaggtgctgctcaacacgtacttcggccacatcgccgacgtgtacgagaccgtgaacctgctgggcttcgacggcatcggcctcgacctcaacgaaggcaaggacgagaacctcgccgcggtcgagaagtacggcgtcgccgagaacaccaccctgttcgcgggcgtggtcaacggccgcaacatctggcgcaacaactacgccgtcagcctcggcctgatcgacgcgcttcgccagaagaccgacaacgtggcggtatccaccgccagctccctgctgcacgtgccgttcagcaccgagggtgagaccgcccttgacccggccgtgctcaagcacttcgcgttcgctgtcgagaagctgaccgagctcaaggagatcgccgtcctcgccgactccgatgaggacgccaagaaggcatccgccgatctggccgccaaccaggcgctgttcgacggcacccgcgttgccgccgatccggcggtcgccgagcgcatcgccaagctcaccgacgccgacttcgtgcgccagccggcccgcgccgagcgtcagaaggagcagcgtgtcgcccttggcctgccgctgctgcccaccaccaccatcggctccttcccgcagaccaaggagattcgcgccgaacgcgccaagctgcgtaagggcgagatcaccaaggccgaatacgacgagttcatgaaggcccagatcgacgcctgcatcaggcaccaggagcagatcggcctcgatgtgctggttcacggcgagttcgagcgcaacgacatggtcgagtacttcggccagaacctcaacggcttcctgttcaccaagaacgcctgggtgcagtcctacggcacgcgctgcgtcaagcctccgatcgtgtggggcgacgtctcccgcgccaacccgatcacggtggaatggtccgcctacgcgcagtcccgcaccaaccatgtgatgaagggcatgctcaccggcccggtgaccatcctcaactggtcctggccgcgcgaggacatcacgcacgagcagcagacccagcagctggctctcgccatccgcgacgaggtgctcgacctggaggccgccggcatcaaggtcatccagatcgacgaggccgcgctgcgcgagaagctgccgctgcgcaagaccgactggcacgccaagtaccttgactgggccatcccggcgttccgtctcgtgcactccgcagtcaagccgaccacgcagatccacacgcacatgtgctactcggagttcaacgacatcatccgcgacatcgacgcgatggacgccgacgtaatctccttcgaggcgtcccgtggcgatctggtcgtgcttgacgcgatccatgacgcgcacttcgagaccgaggctggcccgggcgtctacgacatccactcgccgcgcatccccggcgagcaggagattgaggaccgcatctacgagattctcaagaagatggacatcgagaaggtgtggatcaaccccgactgcggtctgaagacccgtggcaacgccgagacctggccgagccttgagcacatggtcgccgccgccaaggcggttcgcgccaagatcacgaagtaggaccctataggcccctgctggcgggggctgtcgccgtaggcgactgggggtggtggagcatgacccgaccacccccagtccggcatcggccggacagccccgccggcgggggcaacttcatacttgtagtaaggaacctgatatgcacacacccatgttttcgctggaggtgttccctcccaagcgggacgcccccgtcgggaccatctacgacacgcttgacgggctcgaaggcctgaaccccgacttcatctcggtcacctacgggcacggcacgcattcggaccgcaccgccaccgcgcgcatcgccaacacgatccacggggaatacggcatcccagccgtggcgcatctgaccgccctgtactcggacgaggcgaagatcgacgaggcgctcgacatgttcgaggcggcaggcgtctccgctgtgctcgccctgcgcggcgactacatcgacggcgaggagccggtcggccgcttcaaccacgccagcgacctcgcggcctacatccacgaccgcaagcccgacctcaaggtgttcggcgcctgctatcctgaaggccactattcggccgcctcgctcgacgaggacatcgggaacctgaaaatcaaggtggacgccggcgtcacgcatctgatctcccagctgttctacgacaacgacgacttctaccgtttcctcgacaaggctcatgcggccggcatcgacgtgccgatcgaggcgggcatcatgcccgtgcgcggcggcaagtcggtgcggcgcatggcgaaggtcaatgcctcgcgcataccggctaagctcgaagcgctgctcgaccgctggggagacgacatccagaacctgcgcgcggccggcatcatctacgcctccgaccagatcgcggacctcgtggcccacggcgtcgacggcgtgcacctgtattcgatgaatcatcccgccaccacacgccgcatatggcgcaacgtggagccgctgttcaccgtggaatgacactcccggcaaacagccgattacggcaaaatcgttggggccagacagtcatgcggctgtctggccccaaccatatgagaatgcgcggccggcaacagcacgccgcgtatctgccgtcagcgacggcgacgcttgctgcgcctgaagtcgggtttgggcgcgaaccacgcgatccgcgtggtcacggcccggcgaatcaccggaacgttggcgatagcgatgcccagagccacggcgatgagcgtcgtccacatggcgacgttcatggaggccagggcaagcacgacgacgaccgcgacgatggcgaagccgagcaccttctgcacggtcgcctgcacaggcgtcatcctctgcggctgcagcggcatggcaccggaaacaaagcccatcagcaagccgacgatggcggagacgatggttacgatcagttctgcggatgacagttgcataccgccattatgtccatccggccacgacacggccgtgtcatcgcggccgaggaagcacggtttcttgtaaaattgtaggttatgactgttccgggaacctttgacaccagcgcgcgcgaactcatccacgcaggcctgcagaatctcgacgaagcccgttcactgttccgccagctctccgccagcggattcgatgcggcacgctgcggcctgctgcttgacgcgcttcagcatgtctgtgatcccgatgtcgcgctgcgcaacctcgtcgacatcgtcaacgcgcaggtgagccagggccgcgcgctggacgacatcatgcccgacgacacggcgttccgacagctggtcgccgtgctcggcgtctccgacgcgatgggcaagctgatgcggttccgccccgacctggttcaggccgcggcgaccgaccactgcaacagtcacctctacaaccatgaccagcgccgggcgcacgtgctcgaatccgtcggagccgacccgaacgaccgcatgtccccgacagccacgatggaccttgccgacgccgccaccgccctgcgcaggacgtaccgcaaccagttggccgccatcatcgcgcaggacaccatgagcgacgaccccatcgccctgcagccgcgcatcagcagtgagctgtccgacctcgccgatgcggcccttgaaggcgccctcgccatagcccggcatgagatcaccggcagcgagcactgccgtttcgccatcatcggcatgggcaagctcggcgcgcgcgaactcaactacgtgtccgacgtcgacctgatctacgtggtgaaggccgccgacgcggacaccagccagcagcagctgtaccgcatcggcacgaagatgggcacgatgttgcagcgcgtgtgccagtcggtgattatgggagtcgccgaaccggcactgtggcagatcgacgggggactgcggccggaaggcaaggacggctccctcgtgcgcacactggaatcacatcaggcatactacgagaaatgggcgcagaactgggagttccaggcgctccttaaggcgcgcccggtcgcgggggacccgcagatcggcgacgcatacatgagcatgaccaggcctatggtgtggagcgcgtcgaagcgcaagaacttcgtctacgactgtcagcagatgcgcaagcgcgtcgaggacctcatcgcgcccgcgctcaaggaccgcgagatcaaacttggccgcggcggcctgcgcgatgtggaattcaccgtgcagatgctgcagctcgtgcatggccgcaccgatgagacgctgcgcgccagcgccacgctggaatcgctgcgcaggctgtccgagggcggctacgtgtcgcgcaagcaggccgcgaaactcgcccgggattacagcttcgaacgggtgatggagcatcgtcagcagatgtgggcgctcaaacgcacgcacctgttccccgacctcggcgacggcagcgtcggcggacttgagaagaagcgcgacgtcaacgtcgaaaagctcagccagaaccccgagctgcgcaggctcgcccgcgcgtttggtctgcacgccgaggagctggtcgcgaaatacgacgagacgcggcgcgaggtgcgccggctgcacatggacatctactaccgcccgatgctgccgatcgcggcgttgaacggcgaggatttctcgctcgccccgcaggtggcctacgaacggttcgcatccatcggattcgccgacccggaggccgccatgcggcatgtggccgtgctcaccgcaggcgtgtcccgagcctccaagatcaaccgcatactgttgccggctgttctgcaatggctggggcaggggcagaaccccgacatggggttgctgaactggcgcaagcttgaggagcgtttcggcacggacagcgagtacctgggcttcctgcgcgactccaattcggccgcgcaacggctgtgccacgtcctgtcgaactcccgtttcctcggcgacgcgctgaacaagtccgtggagtcggtcacctggcttggcgacgatgacgcgctgatcgcacgctcgcgcgagagcctggacgtgcaatgccggtcctctctgagccgcaacgccgacggcatcaacgatttcgcgacatcgatgcgagccatgaggcgccacgagatcgagcgcatcggtctggcccggctcagcggcgtgatggacgagacggcgtgcctgaccggcatgaccgacgtgtacgacgccatcatcgatgcggccttgacatgggcgatccgctatcagacatcggcgatggggctcggcgagccgcctgccgcgatcgcggcgatcggcatgggacgctacggcggccaggaggtcaatttcagctccgacgccgacatgatcctgctgtataggcccgcggacggcgccgacgagcaggtcgccaaccagttcgcccgcaaggtggtcgacgcgctgcggcaggtgctgcaggggccgaccacgcttgagccgaagatcgagatcgacctggaccttcgccccgaaggcaagaacggcccgctgattcgctcgtacgcctcctgccgggagtactactcgtcatgggcgaacacgtgggaacatcaggcgctgctgcgcgcccggttcgtcgccggggaccgggcgctcggcgaggatttcctccacgacatcgcggacccgctgcgatacccgataagcccgctcaccgatgcacagctcggcgagatccgcaagctcaaggcgcgcatggaagccgaacgcctgccgcgcggcgtgaggcgcgacaggcatctcaaactcggcaagggcggcctgtcggacgtcgaatggaccgtgcagctcctgcaactgcagcatgccggcgacaacgcctcgctgcggctgaattcgacactcgcgacgctggacgagctggaacgccgcaggttcatcgaccgcggggacgcggcggtgctgcgcaaggcgtggcgcatgtgcacggcggcccgcaacggcaactacctgtggaacggacgcgtctcgcaggccgacatcctgcccgacgacatgtattcgctgggcggcatcgccgtgtatctgggatacgatgcccaccgcgggcagcatttcgaaaacgacctgatgggaacgatgcgcaaggcccgcgacgtggcagagcatctgttttatggacgctgatatgagacggtcgtgtgtgtcgcctgtgaaaaatcagaaatctgcattatagtcggataggtcacttcagtggccaccttatccgcttcacgcatgaaaggtgagctgtgtcagtcacagaggagccggcggagacgccgttggtcggtcaaagcgtcatcacgctggatacgctttccatttcccagattcgagatttgctgcacaaggcggcatacatcgatgcgaaccgcaaacgcgtggcgcatacctgcgacggcagggtgttggccacgcttttttatgagcccagcacgcgcactcgcctgagcttcgagaccgccatgctgcgtctcggcggccaggtcatcgggttcgccggcgcgcagctcgcctcggtgtccaagggcgagtccatcgccgacacgctcaagaccgtgtccaactacgtggacgtggtcgccatccgccatccgaaggagggagcggcgctggtcgcctcgcgcgccgcgtccgtgcccgtgatcaacgcgggcgacggcggccacatgcaccccacgcagacgctcgccgacttggcgacgctgcaatcgcgcttcggtcgtgtcaccgacctgaccatcggcctgtgcggcgatctgacgttcggccgcaccgtgcattcgctgatcgagacgctgtgccgcttcggcaacgtgcgtttcgtgctgatcagccccgacgagctcaagaccccgcgctatgtgatcgaccgcatcaaggcgacgccgtcctgctcctacgtggaggtcaaggacctcgtctccgtgatcggcgacctcgacgtgctgtacatgacccgcgtgcagcaagagcgcttcttcaacgaggatgactacctgcgtctgcgcgacacgtacatcctcgacgaggacaagctctccaaggccaagccgagcatggccgtgctgcacccgctgccgcgcatcaacgagatcgccgtcgaggtcgacgctgacccgcgcgccgcctacttcgagcaggtcaagaacggcatgctcatgcgtatggcattggaaagctcgttggtcggagaccagctgccgggatatgagccgctcgaccccaaggaggttcaggcctgatggaagtcaccagcattcaaaacggcatcatcatcgaccatgtgcccgccggcaccgcgctcaaggtgctggagtacctgaagatcgatccgtccaagacgcggctggcgctcatcatgaacgccgacagccacctgtacggcacgaaggacatcatcaagatcgaggatgaggaaaacgtcgatctcgacgtgctcggcctggtcgcccgtcaggccaccgtcggcatcgtgcgcggcggcaagatcgtccgcaagctcaagcccacgctgccggaacacgtggtgaacatcatcacctgcgtgaatccccgttgcgtgaccaccaccgagcgtggcatcgaccagatgttccatctcgtgcattcgcagcgtcaggagtaccgctgcgactactgcgacgaggaagccaagttctgacctcacgcccgtcgtttcgcggtttcggacgtcaagccctggcgaccgaaaccgcggtccagcgggtgcaaccgtcttcatcagagccaaccccacaaggagatgcatatgctgaccttacgcaacattcgcgtctgggacaccggcgagatcatcgacatggtgattccctcggccgacgcacgcaatcagccggaggacggcggcgtcatcgaaggtgacttcgacgccaccgggctgacggtcgcccccggcttcgccgatccgcacgtgcatttccgcgatcccggccagacctataaggaatccatggtgtccggctgcagggcggctgcgtcgggcggctacacgaacgtactcatcatgccgaacactgtccccgccatggacgggcgtgcggtgaaggccggcgcatccggtgccgcggaggtgctggacgcaggctgcagcgacgtcatcgactacctgcagcattacgagcgggtgcacgacgtgtcgctgccggtgcgctacgacctgtgcgtatgcgcctccaaggaccgcgccggcgtcgaggcgagcgacccggccgactggctgcgccatctcgacggccatgacatggatggcaaggacgcgtggcaactggcccacccggtcaccgccatcagcgacgacggggccgcggtgacgcccggcctcctcgaccaggtgctcgccaacgtcaaggagagcggcctgtatctcatcgagcattgcgagcatcacgacaccggtgcggtcaacgacggcccggtttcccgcaagctcggcgtgccgggaatcccggaggacaccgaactgaagatcgtcgcgcgcgacatcgagaaggcgcgcgagaccggcgtgcacatccacttccagcatgtcagtacggccatctccttcgacgcgatccgcaaggccaaggcggaagggctgccaatcacctgtgagaccgcgccgcactatctggcgctgtgcgacgaggacctgctcgaatacggcacgctggcgaagatgaacccgcctctgcgatcggccgcggatcgtcaggcaacgattgccgcgatcgcggatggcacggtcgacctgctggccaccgatcatgcgccccacacgctggaggagaaggaacgcggcttcctggaggcgcccaatggcatcatcgggctggaatgcgcgtacggcgtgtgccacaaggtgctggtcgacgggggttacatctccgaccagcggctcatcgagctgatgagcgtcgcgccctcgcgcctgatgggccaccggccgaccgacgtcgccgcgctgctcaacgtcaccgccccctgcgcgtccaagcgcactctggacctgtccgccgtggagcacccggagaacgtcgacctcgccatcctcaacacgtccgaggcatggaccgtcgaccccgagaagttcctgtccaaggcccgcaacacgcccttcggcggatggcatgtcaccgggcgtccgctggcgaccgtcatcggctccacgctggtattcagccgcattcactgacggcagattcgaaccggcccgcaaacccgccgtcagcggcgggacagacacatgaaaggaagcaccacgcatggatcgtttgatcgaagccattgaggaggcacagaaccccagcgtcgtcggactcgatccgacgcctgcgctggtcccgccgcaggtcgtggattcgttcaccgacgaggtgcgggaatccatcgaggatgagtccgaattgcccgcggcacgtctggccgtagcgtatttcgaattcaaccgggcgatcatcgatgcggtcgccgacatcgtgcccgcggtcaagccgcagatcgccatgtatgaggcgatcggcccggccggggttgacacatacacgatgacctgcgaatacgcccagcagcagggcctgtacgtgctcggcgacatcaagcgcggcgatatcggatccacggccgccgcatacgccggtcatctgtccggagtcaccgacggcgacggcctgtatgacccctggcacgaagatgccgtcaccgtcaacccttatctcggcacggatggcatcacgccgttcgtcgaggcagccacggcgcacgacaaggacatcttcgttcttgtacggacgtccaacccttccagctccgaattgcaggagctggagcttgccggcggcgagaagctgtacgaacgtacagcggacctggtggagggctggggcgccgacaccatcggacgccacgggtattcgcacgtcggcgcggtcgtcggcgcgacccatccgcaggagggcaaggcgcttagggcccggatgccccacactttcttcctcgtgccggggtacggcgcgcagggaggcaaggcgggcgacgtcgccgggatgttcgacgccgacggctccggtgccatcgtgaactcctcacgcggcatcatcggcgcatggcgcaagagcgaggaataccgcgaggacatgagcgccgacgacgcgctcgacctggtggcgcgctgcgcccgcaaggccgcgcaggacatgcgcgacgacctgcgcgtcaacgtgtaccgctgaggcggtgaaccgcatgcggtgattcggcttcgggagacgccgccgaatcaccgcatttcgttgcgccacgagcgcgtcacggcatcgtcatgccgtaatcttgaactgatggtcacatggatggaggagtgtatgccagcagccaccttcacgccggtcgatgatgtcgtaagccaagcgacttccgccggtttcttccccggacgacatgccgtcgacgtcaccgatgtgcgcaggctgtcggacggcgtattccgcctgacgttccgcgacggatacatcgccgcccacgccaaggcggcgcagttcgtcaacctgttcagccatgacagcatgatgctgatgccgcgtccgttcggggtgagtgaggtgcgcgacgatctggtcagcgtcatcttcgccgtcgtcggcaaggggacgcaggagttctcgcgtcttcatgccggggaccggatcgacgtgctcggcccgctcggccgcccgttcaacacgaaacgcgacgcacactatctgctggtcggcggaggcctgggtgtgccgccgctgatctatgccgcgcaacggttgcaggcgtcgggaaagtcacactcgaccgcggtgttcggctacaggaacgtgcatttcgccgatgagatcgtgagctcttacgcacaccgcacgctgagcatcgacgagtcggaaggcaacgtcatcacgttgcttgaccgcatggaatcacaaggagaactggcggccggcggcctggagccggtcgtgctgtcgtgcggcccgctgccgatgatgaaggcggtggccctgtggacgaccgcgcggggcatcgaatgccagctcagcatggagcagcgcatgggatgcggatacggcacatgcgtgacctgcgtggtcgatacggtcgccgggcgcagcaaggtgtgctctgacggaccggtgttcaccgcccagcagctcggatgggaggcgtgaccatggatgccgtcaccgacacgaacgtatatgagccgcaccagtggaagcattcgaccatcgtcgccggcgtcgaatggaagaaccccgtcggcaccgcgtccgggacgttccagctcgcggcatgccgttggttctatgacgtgagccagatgggcgccatctgcaccaagggcgtgtccccagagccatggcagggcaatcccggcccgcgcacggcggagacccccgccggcatggtgaattccgtggggttgcagaatcccggcgtggatcattatctggtggacgagctgcccaagctcaaggacctcggagccacggtcatcaccaatgtcgccgggcatagcgacgacgagtacgccgaagtcgtggcgaaactggccgactcgcgcgctgacatgctggagatcaacgtcagctgccccaacgtcaatcacggcggcatgagcgtcggaaccgatccggagacgctgcaccgcctgatcgaccgcctgcgcaagatcacctcaaagccgatgatcgtgaaactgtcgcccaacgtcaccgacatcacgacgatcgcacgagccgcggtggatgccggcgccgacgcgctgagcctcatcaacacgctggtcggcatgcgcatcgacatccgcaccggcgaaccgatcctctcgaaccgcacgggcggcgtgtccggcccggcgatcttcccgatcgcgctgagctacgtgtggcgcgtgcgtcaggcgctgcccgacattccgatcatcggcatcggcggcatcgactcgggggagaaggcactggaatacctgtatgcgggcgcgaacgccgtcgaggtcggcgcggctgccctgtacgatccgacggcgccactgcgcgtggcccgcgagctcgacgacctgttggattcaaggcccgaacttgcggcgaagctcgcagcgggggaaacttggagataaccatcaattgaggagggtattgtgaccatcgcgactcttgaccatcgcttcaccgaattcctgctggaatcgaacgcgctgaagttcggcgacttcaccctgaaatcagggcgtcaatcgccgtatttcatcaacgccggcgcgttcaatgacggtcgcaagatcgccacgctgggtgcgttctacgccgagaagatcgccgaggagatcaaggccgggcgtcttccgcacgacatcgacacggtgttcggcccggcttataagggcattccgctggccgtatccaccgcgatcgcgctgacctctggccacggcatgcaggtcggctacacgttcgaccgcaaggagaaaaaggaccacggcgacggtggcatgatggtcggcacgcagctggccgacggcatgaaggtgctgctcgtcgacgacgtgatgaccgcaggaaccgcggtgcgcgaggtcatccccaagctcaaggccgaggccgacgtcgacatcgtcggtctggtgttgagtgtcgaccgtatggagaagacgaaggactccgacctgtccgcggtggccgcggtcgagaaggaattcggattccccgtgctcgccatcgccaatgtgcgcgagatcttcgaggccgggcgcaacatcgtcacgtccgacggccagccgtacgtgaccgacgccatcaagagcgcggccgacgactatctcgaacgctacggcgcctgattcgtatccggcgctgacgggctgcggcattgcatttgccgtagcccgttttcttatgggcgtgtcgccgttttacttcaagtacttgaggtttttagagttgacgatatgagcacaacgaccacatggcatacgattcgcgaggcgtcgatgatttccgggcttccggagtccacgctgcgctactacgagcagatcggcattatcgctcccatcactcgcgacccgagttcggggcatcgcgcctattcggacgccgatctcgaacggctgaccacagtatcctgtctcgcagccacgggcatgccgctcgaatcgatgcgcacatacctcgccaactcgcagggcgggcgagaaggtgcacgccgccagctggaactgctcgacgcgcaggccctgcgtctcgctgccaaagccgaatccattcgaatgcagcaggcgtacgtatcgttcaagacactgtactggcgggctaaggctgaggggcgcgacgaggaggcgcagcagctcatcgaagaaaaccggaacatcatcgaacaggtgaagcgcctgcaaaccgacgtcaaacaataaacgacaatagacagatattcccaacaaaggagtgattgacatgaccgaaatgatgaaagccgcgattttcgtggagcctggcaagatggccgtggaagaagtgccgaaggcgacgcttgaacaggatgatgacatcgtgatccgcgtggtgcgcacgtgcgtgtgtggctctgatttgtggttcttccgtgggctgagcggacaggccgcacacagccaggtgggtcacgagtccatcggtgtggtcgaagaggttggcgcggcggtcgaatccgtcaagcccggcgatttcgtggttgtgccattcccgtacagctgcggtaaatgcccggtgtgcaaggctggcttcgaatccgtatgccctcacggcggctacttctccgcctgtcaggccgaatacctgcgcgtaccggaggcggacggcaccgtggtcaaggtgcccggttcgtcggaagactacgatgacgcgacgcttgcttcgctgctgaccgtttccgatgtgatgtccaccggttatcacgcggcggtttctgccgaggtcaagcccggtgacaccgccgtggtcatgggcgatggcgcagttggcctgtgcggtgtgattgccgccaagatgcgcggtgccacgcgcattattgccatgagccgtcacgaggatcgcgcggcgctcgcccgcgaattcggtgcgactgatatcgtgcccgagcgcgatcaggccgccgtcgacaaggtgctggggatgaccggcggctatggcgccgacgctgtgctcgaatgcgtgggctccaagcagtccttcgacacggcgattggcctgattcgccgcggtggcgtgattggtcgtgtgggcctgccgcacgacgtggagatcagcgccgaaggcacgttctacggcaacatcggcatcaagggcggcccggctcccgtgcgccactatgacctcgatgacggtctgctggatgcggtgctcaagggcgaaatcaaccccggtcgcgtgttcaccgccgagtacgacctcgaccatatccaggacgcctacgaggcgatggaccagcgcaaggtcatcaaggcgctgattcgcctctaggcgaggcggttgtatcagcgaatcgttctcaataagaaacgtgcgaggattcctcacaaaacagcacaatcgaacatcaaggggatgcccggaattgcaacgttcctggcatccccttgttcgttttggcctcagcgccggctcgcacttttcttattgagaaccgttctctgaaaacccggcgcgcgtctactgcgccgtcgaggcgcccaccgaagcgagtcgctgattcacgcgggtctgaacctcgatatagtactgctgctcttcgggggtcagcgaattctcgtcgatggcgtcgagcttcttcatggcatcgttgtacttgaccattatcttcgcgtagtcggccgccatgctcgccgggtgcccgccggcgttgtacttctccatgaagtcggcgtactcgttcatcaacgactcgtagctgtccatcgcggccttgaaatcggcgtcggagctggatccggtggaagcgtcgccggaacccgaatcaccgttgttttgcgtagcgccgttcccggatgtgccggaagtcgaggagtcgtccggggcgaagacgtaaatggccatgatggagtcgcccttggaatcgtatctgatattgaccgagtagccggcggcgttcttcgcgttgaacacggaggagctcctgaagtagtcgacggtgaatcccttctcctgcagagccttgacatagttgtcgtacgcggtggcatcggtgccgcacaccttgatgtagaacgtgctcgagctatccctctcgatcttacccttggcggattccggcttgggcagctgactggccagatcggtcgtcggccatgagtaggcgtcgcatttggccttcgcggcttccttcgcggcctgttccgcggcgtcatgagaggccttggcctcgaggccgttgcgtacgacatccacgccgccgacgatcagcgccaccacggtgataccgaccgcgacccaggcgagcacgcgcccctgcgccttgccgtccttgcgggttgtgtagacggcgaatccggacaacaataccggcaacagcgcgaagaacgccaacagactccagctgttcacaccgatgaaggcgatcagcaggaacaccgcggcgacgatgatcgcgaacaccgccagcttggaggtcttcttgttgcggacattgggtgcgtcgggtgtattgggattgttaggagtgccggggacgatggggatgacgcccggcgtctgcggcggcacggtgttccccgcgggctggaccggcatgggctgattgggctggacgggttgcggccctgatccttggggtggctgtggcgtgaaatcggatgggttcgtcatggtctgctctttctcttcaatcgcgcgtttatgcgcggacactggtgacatcgtccattgtcatgggcgatgcggcggcccgtcatcagttgccaactgaatttcggcaagtttttccgcatggatgattccggcaccggagccgtgtcacacgccgccgcgccatgtagtctggtcacagtgaaacgaacgggccagtcgattgacgctcccgacgggagatctcccggcggtccggcatgtgaagacataccaagggaaggcgaggcatgaacgtcaacgatccggcgcatctgaccgaggaactgctggaacgtctgctcgccagcgacgacatcgaaacgcaacggctgctgcgtctcgccggagtgcccgaactgtactgcaggcagcggcgcgacgcgatcatcatttggtgcctgcgacagggtcgtgaccgcgtcgccacggatgacgagctgtaccgcatgaacgagccgacgctgctcgacgcggactgaccgcggcgctcgggggacgacgacgattatggacgaacggcagaccatgcacgccatgatgctcggcgacgcctactgcgtcgaacgggtgctggcggacggcgcatacggcgtcaccgaaatggtgagcctcgatggagcctggccgttcgtgcgcaagaagatgccgctgcggctggcgaggcggcgcgcatcgccatttcgctcatcctgcgcgacgagaaggggaacttcgtgttctggcgtagtgagtatgtgcgtaaaccggccaaaggcgaatcccgcgcgttctccatccagatctatggtctgcccaagtacgcttcctatgaggcgtacgcctatgcctcgtagatgtttctcctttggaagaggtacatttgtcttgttgcggagagctatctgcgttcaatgaggtgcctgaaacatgagaacccgagtatcaacgttgcaatgacggcgtttgtactcgagggttcccattcggtacctctctgaagacagttagcattctgcaggaggtcgaatgtacctcttgcaacgaagatagatgcttgcaacggtccgaatatgtcccttgttggccagttgcgtccctacaatgggcgatgacgtgacgcgtcgtaggagacttgagtgaggggggtgcccaatatgcagcggatacgggacgatgcgcgcccggagtcgatcgaggtgcgcggcgcgcgcgtgcataacctcaagaatgtcgacgtcgacgtgcctctgggcgaactggtcggtgtggccggcgtctccggttcgggcaagagctcgctcgcactcggcgtgctgtatgccgaaggctcacggcgctatttggaggcgctgtccacgtacacgcgccgccgcctcacccaagcgagccgcgcgcaggtggacgaagtactgcacgtgcccgccgcgctggccctgcaccagcggcccgcggtgcccggcatacgctccaccttcggcacgatgaccgaattgctcaacagcctgcgtctgttgttctcacgtctcgcctcacatgtgtgcccgcattgcggcgcacgcagcgaaccgactctcaacgtggccgccggcctgcccatcgtctgcgcgaattgcggcaaggaatttcacgcgcccggcgctgaatccttggccttcaactcggccggcgcatgcccggcctgcgccggcaccggcatcgtgcgcgaggcgaaccgcgcggcgctcgtacccgacgaatcgaaaagcatcgacgagggcgcggtgctgccatggggttcgttgatgtgggacctgatgaaacaggtcgccggcgcgatgggcgtgcgcaccgacgtgccgttcaaggacctcacccccaaagaacgcgacatcgtcttcaatggcccggccgtcaagaagcacatcctgtacaagccgaagaaaggcgacgacttcgccgaactcgacttcacgtatttcaacgccgtgtacaccgtcgagaacgcgctcgccaaagccaaggacgagaaggggctgaaacgcgtggcgcggttcctcgaggagaaaacctgcccggattgcggcggcacgaggctcagcgaggcggcgcgcgccccacgggtgcgcggactgaatctcgccgaggcgagcgcgatgaccttggacgcggcggtggactgggtgcgtagcgtgcccgggtcgctcggggccgacatgcgcccgatggcgacgaacatctgcgaatccttcctcgatgtggcccgccggttgttggagctcggactcggctacctcgcgctcgatcgcgccggagcgaccctgtcgaccggcgaacgccagcgcgtgcaattggcccgcgccgtgcgcaaccgcaccaccggcgtgctctacgtgctcgacgaaccgtccatcggcctgcacccggcgaatgtggacggtctgctcggcgtgatgcgcgatctcgtggcggatggcaactccgtggtggtcgtcgaccatgatgtgcgtgtgctcaaggcatgcgatcatctcatcgaaatgggtccggtcgccggtgccgaaggcgggcatgtgatcgcgcagggcacggtcggcgacgtggcggcgaatccacgcagccgcatcgcgccgttcctggccgatggcgaaagtgtccgtgaacgcgggtgcatgcccgtctcgcatatgttcgaccttgggcatattcgcatgacaaccagtcagctgcatacggtcaagccgctggatgttgatattccgcgcggccgtctggtggcggtgaccggcgtatccggctccggcaaaaccacgatggtgctcgaatcgttgattcccgcgctcaagacacggtctgcgggggagaagccgcccgagcatgtgcgctcgattgacgccgacggcatcgagcgcgcgaacctcatcgacgccacgccgatcggcgcgaacgtgcgttccacagtggccacctacgccgacatccacgacgacctgcgccgcgccttcgcccgaagcgacgaagccaaggcgggcggttggaaggccggcgacttctcctacaacaccggcagactgcgctgccctacatgcgacggcaccggttcgatttcgctcgacgtgcagttcctgcccgacatcgacatcgaatgccccgactgccggggctcccggtatgcgcccgaagccgacgcgattcaccgcacgaccaaggacgggcgcgaactcaccctgccgcagctgatggcgatgagcgtggatcaggcgttggccgtgaccgtcgacatgcgcaaggtgcatgcgcgactgaccacgctgcacgatctgggtctgggctacctgacgctcggcgagccgacgccggcgctttcgggcggtgaggcgcaacgcctgaagcttgccagcgaaatgggcagggctcagtcgcacgccgtgttcgtgttcgacgagccgaccatcggcctgcatccgctcgatgtgcgggtgctgctcggcgtgttcgaccgactcgtggcgtccggcgcgaccgtcgtggtcatcgaacatgacctcgacgtgatcgccaacgccgactgggtgatcgacatggggccgggcggcggcgaaagcggcggacgcatcgtcgccgccggcacgccggagcagatcgcggccgatgcgaacagcatcacgggccggtacctgaggtgactgtatccgtgggcgacccacatggcggtcatgcacggctgcgagggatgccgcgcgagtaggatgaccgtccgtggttcaggttcatggcatcagacgcgcgagcgcggacgcgaaataccggcagatgaccggtcagccggtcaaaccgttgattctcagactgtgtctgccggcggtgatctccaatctggtgaccaccgcctacaatttgaccgacacttttttcatagggcagctgggcaccgcgcaatccggcgcgatcggcatcgcgttctccatcatgaccgtgatgcaggcgctcggcttcttcttcggcaacggcgcgggcaactcgatgagccgcgaactcggcaaacagaacaacgagcgggcatcccggctgctggccgtaggcttcgcgggcgcggtgatctcaggtctgacgatcgccgcgatcgggctgctgacgttgcggccgctggccgtcatgctgggttcgactcccacgattgcgccgtacgcggtgcaatacctgacgccattgttggtcgccgcgccctgcgtatgcgggtcgttcgcgctcaacgggctgctgcgctaccaaggccagtcggcgttcggcatgatcggcttggtttcgggcgcgctgctgaacttcctgctcgcgccgctgctcatcttcgtggcgggtctcgggatattcggcgccgggctggccaccgccatctgccagacggtgagcttcgcgattctgacgacgatgagcgccagaatcggcgtgatgaaactgtcgttgcgcaactgccggccggatgtgctgctcatgcgcgaggtggccggcggcggcctgccctcgctgattcggcagggtgcgggctcgatctccgtgacctgcgtgaacatcgccgccaacccgttcggcgacgcggccatcgccggcatggccatcgtgatgcgcatcatgttgggcgccaactcggtgatcgtgggcctcggccagggcttccagccggtgtgcggatacaactacggcgccggcctgtacgcgcgcgtcaaggaagggtactggttctgcgtgcggctcgccaccggcgtgcttgtggcgttggccgcgctgctgtggatgttcgccccgcatctggtcgagatcttccgctccgacccggccgtggtggcggtgggtgtgtccgcattgcacattcaatgctgcacggtggtgttcaatggcttcaacatgatgggcaatatgatgacccagaccatgggccgcaccggcatcgcctcgttcctggcattgtgccggcagggcctgtttctggcgccgatcgtactggtgctgccgttggcgttcggcgtgctcggcgtggaaatggcacagtcggtgtccgacgtgctcaccttcgcggtcaccattccattcatgcgccgcatcctacgcgaattgagctgattcgccgccccatgcgcaggcgatggcgacgggtcggacggattcgataaaatgcattgtgcatacgttttcaacagcgtttcgtcgcggcatcgggcagtgatcgccggacggcgacgaaccgacgaaggcagggaggcatacgaatcatggaacggacgaacggcaaacgcatcgccatcgtgacgggcagcgccctcggactgggctatgaactcacgcgacagctcatcgaccgcggatggttcgtcgccggcatcgacttcaacgccgaacgccagaccgaactggccggcgaattcccccggggctcttaccacgggttcgtcggcgacgtgtccgacgaggacttcgtcaaagcctcggtggccgagatcgccaagatcgggcacatcgacctgctgatcaacaatgccgggcagccctcgttcaagacgccgaccgcctacgaggccgccgacgtggacaaatgcctcaaaggcctcaagggcatgattctgtggtgcgtccagacgctcaaggcatgcgacgaacagaacctcaaaatcgccaacgtgatgagcaccgccgctacgcgcggcaacgccaacgaatccgtgtactgcgccaccaaatggggtgagaaggggtatacacagagcctcaaggccgcgtacaaggggtcgagcgtcaccgtcgtgggcgtgtaccccggcggcatcgacaccgacttctaccgcgagagccacgactacgtctcactcgacaagcagcacacgttcatgcccgccgccgatctcgccggcgtggtgctcgacaacctgctcagcgaggcgcgcctcaccgtctccgacattctcatcgagcgcctgtaccgttgaccatggcatcggcgcacggcaatggcaggcaatcccggcgcaggcccgcagccggcgacatcgagtcgctgtaccgcgcgctgtccgcggagctgagcccgaccggatggtggccggcggacaccacattcgagatcatggtgggcgcggtgctcacgcagaacaccgcgtggggcaatgtggatcgttcgctcgcggcgttgaaggcggagagcatgctcgacccccatgcgttgacggtcgtggagccggagcgtttgcaggagctgattcggccgtcgggcttctacgtcaacaaatccaagaccctgcgctcgttgagccgttggtatgtggagcgttgcgacgcctctcccgaaggagccgacggcatcaccgacgccgagctgcgcgccgaactgctcggattgttcggcatcggcggcgaaacggccgacgatatgatgctctacgtgttctcccgccgcacgttcgtggccgacacctacgcacggcgcctgttcgcgttcctcggcttcgatgcgccggacggatacccggcgttccataaggcgtatgcccccgtggtgctggacaccgggctggacgtcgccgaccttcaggaattccatgggctcatcgacgagttcggcaaagcctaccgcgacgatgcggcaaaaaacgagtcgtttctccagtcgtggcgaccgggagaggctgctcctcgcccgacggagtgacgagacggtgccacgggtatgttcaaacgagttatgatggacaatcatgagcttgattgagatgatgattctggggttcctttcggagcgttccatgtgcggttacgagttgcgcaagaagatggagcagctgcaggggtatgcgcgcaaattcagcgacggcgcgatttatccggcgaccaataggctcgtcgaagcgggattgatctccgaacaggcgtcgattcgcgacgggcgccagcgtcgcgtgttcaccctgctggacgcggggcgcgccaagttgatcgacgagcttaaaagcaccagtggtttcaatcccaccgatttcacccggtggaccgtcgtgcttaccttcctgtccgtcgtgccagacaaaaccgaccgtgacgcggtgttgcgccgccgttacgatttgctcaacggccacgacgtgcatctcttctactgtgacgcgggcaatccgttgagcgccgagcagatcgacgacccgtaccgcaagggtatcatcaccgtgcatgacgcgcagatcgccgccgaactcaaatggctgcgttcgatgctggagatgtaaggggcaatgggtcaattcgctattatggttggccagttggtcggcttcttcatcatgctgatggtcggatacggatgcgtgaggcttcgcttctacggccagaccgcgctcgacggcatgtgctcgctgctgctcaacgtgcttatcccgttgctggtgttctcgaacgccatggcgggtgcggaccgcgcgcaggtcgaggccaattggggcgtcatgctgctgaccgcggtgatgtacgccctgcttatcctcgtgttccgcttggtcgcgtgggtgttgcggcttgagggatcgcgtagccacgtgttccaggcggcactgatcttcggcaacgccgggttcatcggcattccgatcatcatggcgttatggccgcacgagggtgcgatctacgtcgcgttgatgtcgatcgtcgatcagacgctgctatggacgtacggcgtatggctgtgcgagccggttcccgaacccggtaccgtcgcatcacccgacgccgccggccggcccacgctcggcctgcgcgtgcgcaatctgctggggaggttcgtcaaccccgcgttcatcggggttatgctcgccttggtgctgatcatgctcggcgtgaggattccctcgatcgtcctgactccgctgcgcaccatcggcggcatggccacgccgatgtcgttgatctacctgggcggcctgttcgcgctgaccaaatggtggggcgtgctgaaacgctacgaactgtacgtggggctggtcgccaagatgatcgccttcccgctgggcctgtacgcgctactcaccgcggccgccggcgcgctgccggagctgccgatcacccacgacatgatcatgatgatcacgttggtggccggtctgccgaccatgaccaccatcgccatgttcaccgcccgcaggaacaacatgcccgactacgcggtcggcttcgtgctcgtaagcacgctgttctcgctgctttcactgaccatcgtgtcggcggtggtgttctgacgagcgcgagcgacaggccttcgattcaacgcaacgcgtcgtattcggcctcgaccgactccagccactcgttcgaggcaccgtccaccgcgttcatgatggcgatatgcgcgaagtcggaatccggcgcggccccatgccagtgcttggtctccggcgccacgtacaccacgtcgccggggttgagctcaactggctccttgccccactcttggtagtagccgcgcccgcccacggcggtgagaatctgacaggccttgtgatggatatgccagttgttgcggcagcccgcctcgaatgtgacgttggaaacgttgacttccttgcccgagaccagcggtgccagatagctctgcccgatgaaatacttggcgtatgcgtcttcccgatgcacggccgcatccgcaccacgcccgccgcgacgccctgctcgacgaacgtttccgctgaatcgacttccggtgaggtcgggtccgctcgaaggtgttcggtccaccttcagttgcgtacggtaaaaccggcatccgcgatgcgttcgcgtatgttccgcgcaatcgatatgcaccgggttcgtgggatgccggctttcatgccgatgtctgccatgtcctcaacggtgatgccgcgccccttaccattgaccgcagtggtgtgttcgccgttgataccgggattctcggtaaggtcgtacgcgggggagaggctccaagcgccggactccgcatcatgcaggtaggagaagttcttcgcgtggtcgtcgcgattgccgatgaacacattgaaacacatgagtcgatacaatcgttcgcattccttgatgccgccggtcatgcgcatggtcaatcgcatcagcaaggcgtagtccagattggcgatgcggtgtgaagtctccaacaggccgccggcggaaaccatgtgcaccttgccgatttcgccgttcgtgagcggtatgcggtcaaagcgcttgacgccaaaatagcctgcgcatcgacgtgaagggaacaacctggtttccggcatgtcgattccgcaagtgcgtgcaagattcgatatgtggtattccatctcgccgatatcgggtgcgtccacggatgaggggaacttgatgatccattcctcgccattgattgtggtgaggattttcgggcgggctccgcctgacgaaccgccaagaacaaacagctggtcgaggtcattcgagaagtcggcgctcaacacattcaggcattcctcggcgagtgagtcgagatcggggaatgattgcatgtcatcgtcgattgttgaagcgggttcgtattccagtgcgcccatgccgccatgacctacgatcgatagacgcgccagcgggccgaccgaatacgggtcgatgccatgttgacgcagcattcggtcggtcagcagtcgtccccatccgtcgggcatgctgtcgtcgaacacgccgaacatgccgttcagcggatctctttgggcgacgaacacgccatctctgagcggaaggcttatcgggctgatggaaaaaccgtgcgtcagccaggtcttgtcgtaggcgaacgccagtgtgcgggaaggtgacatggtaagcattccgacggtattgcctgcgagcagcacgcgcacgcggtctacatccagcagcggggtcatccgatgtcctttccgtggcgcgtcgctgtgaccacgtcatcgatcgagcggtaatacggctgggagaacagtgcgtcgaaatcccgttcgcagtccaaggcgaaggcgatgccgaccagtgcgttcagtgatatctcatggagttgttcgaatcgacgaatcgacccgagactcacccctgattttcgggcgagatcggactgcgtcatgccgtgttccttgcgtctcatggtcattcgccgggcgataccggccattacttctccgggaagcggctcatctaacaaatcatacatactaatattttagcaatacttatgaaattatatagtaattactactatattagtagcattcattatgtcgtgtcagtcctatccggcgcttgtaggtggcctttgccagaggacggcggcggcgtcaagcgcatgctggatatcggctgcgggccgggcaacagcacggccgtgctgcgcgaacgctacccgcacgccgagattctcggcgtcgacagctcgccggacatgatcgaggcggctcgcaaggcctacccggacatcgatttccagctgtgcgacgtgtcgacgcatcggtgaagttcgtgacgttcatcgacgcgatgctctcgctcgtggtcacgcaggacgttctgccggaggccgagggcgcgcaacatgccgcacaatcctccgggctgctcggcatcggactcggagcgttgaccatgatcatcggattgtggatgctgctgcgtcggcgctgggccgctgtggattcggtgctcgattccgagcaatagcggcgcattggccggcaatggccgactgcaggaggggcagaggtcccgttttccgatgtgtacgaacgtacatatacgagggggacagcatggaacccgcatgaatgctatgattgccgatatgccatcccagtcatcccgagtcgaccccgagcgacagcagcacatcatcgacgccgcgctgcgcgtcatcgcgtcacgtggagtggcaggcacctcgcatcgcgtcgtcgccgccgaggcgcacgtgcccctcggctccatgacatactatttcgacggcatgcacgatctgctgcaccaggcgttcgaccagttcgcccgggcctccgtactgaaattcgccgcgcgcatgcagcccgcctcgaccgtcgacgaagcctgcgacgccatcgcgctgagcatcgaacgagacatgctcggtaaccagcgcgacctgaacatcaaccttgagttctacacgctcgccgcgcgcgacctgtccttccgcgacatcagtgaccgctggatgtcggcgacacagaaggtcatgggccggttcttcgactccgagaccacggtgctgctcgacgcgatgatcgaaggcctgacactgcaccgggcgctgggcggggaaccacgcaacccccagtccatccgcgacggcatccggcgcatcatcgaccaccggcgctgacggcaacgggagtgcgccaaaatgcgccatccactgatggatcacataattcaggaacacggacctgtaatgggaaacagggtaaatcaacgccgtttgcccataacagtgaaggtcttcttgggaagaaggatccatgaccaatccgaacgcgccatatgccgcccagccgcagcaatccggctttcaaccgcagcccccagttccagctgcaacagccctatgctccccggccggtcgcacccctgcgtacgcagcgcggactgctgaaatacgtgctgctcggtctcgtcacgttcagcatctacgacatctggcagatgagcgaagtgggagacagcctgaacctgctcgcgttcaaacgcgacggcaaacacacaatgcactactgcctgatgttcttcctggtgggatgggtcacgctgggcatcggctggctggtgtggtatcaccgcgtatccggccgcatcggcgaagaacaggccgcgcgcggtctgcccgtcacggtcaccgcctcgacattctggctgtggggcatcctcggctcgctcatcgcagtgggaccgttcatctatatatacaagctgctgcacgcgatgaatgacctgtccgcggactacaacgtgcgcggcttctgaacgagacacggatcgaaatcgggctccccgccacagggagcccataatcgcattcagtcaatcagcttgtaaccgtggtcggcaaccacggacttgagcttctcgatatacgtctcggcggccttcgacagtttggcgcgctcattggtgacccagcccaccagcatcgtttcgtcggtgtccaacggcacggtgacgatcttctcgttgttcaggtcgccgttgtcgatgccggtgcacaccgtgtacccgttcaggccgatgatgaagttcaggatcgtcgcacgatcggtcacgttgatctgcttgggggagtactccggccacacggcctcctcggcgaagaagaagctgccctcctcgccctgctcgtactggatgaacgggaacggcttgaggtcgtccatcgtgaccttcttcttgccggcgagcgggttgttgcgcgagatgaacacgtgcagcggcgcacggaacagcggatggaactccagatgcttctcgcgcagcatcttgccgatcacgtccttgttgaagtccgacaggtagatgatgccgatctccgaaagcatgttcgcgacctggttgatgatgtccttcgtgcgggtctcacgaatcgtgaactcgtactcatcggacttgatggagtcgatcatctcgacgaacgcctcgacggcgaacatgtagtgctgcgtggacacggagcacagctgcttgcgcggcttcgcgttcttgtagcgctcctcaagcaggtcggcctggtcgagcacctgacgggcgtaagtgaggaattcggcgccgtccaccgtcagggcgatgccctgcgaggaacgagtgaagatctcgatgccgagctcgttctccagttccttgaccgacgagctcaacgccggctgggagacgtacagttcatgcgacgcctcgttcatggatccgcactcgacgatcttcacgatgtatttcagctgcagcagtgtcataagcagcatttataaggccgaccatggacgaaaccattgaaatcattgggattgccggcatttcaccaggtgcgggggtataagctcaatttatcatgcggcgggcttgcggtgcggtatgcgcaaggcacgctctcaaaactcgcagatacaccggacgactgacgttttttgccccatatctgcgagttttgagagcgccgaatccggttattcctacagcctcacaccgagcgaagcgagcgattcgcgggcctggagagcattgtcgaacagaagaccgtggataccgacctcgttggccccgacgatgttcttcgccgtgtcgtcgaagaacacgcaatgcccggcttcgaggccgaatcgttgcagtgcgagctcgtagatgtcggcgttcggcttgtgcatcttctcgatgccggagaccacagtgtcctgcagcagttcgccaatctgcgggaatttctcgaacgcgatgtgaatcgtctcatgagaccagttcgtcagtccccacacaccgtacccatgccgcttcaggtcgcgcagcagatcttccatgccgggcagcatgcgcggcagggcgtcgccgtaatgttcgatgtaataggcgaagatcggagcgatgtcctcgccctgctcccgcaccacgtcggggtagatgtgagagaagtcctcgccggcgtccatgcggtcctcatagcggaagaacccgtgcgggtcgtcgggcgcgcatatcgcgtccaccgtgtcctgggggaaatgcccggtcaggcatgcgcgggtctgccagtccagcagaacgccacagaaatcgaaaatcacatcggtgatgggggagttgctcatgatgctcctcaacgttggaatagggggaataggatggtgtctgatttgttgatccggacggaataggtctccggccggcgcagtcgcgcaagcggtcgggatgcatcgacgccgggtatcatgcgataccggcctccgcatcccgaccgccctcgcgcccttacgacagcagttccgcgaaagtcgcgggaatcatgccgatcacatcggatgcgacgatgggatgccccagcttggtgcgcagatgacggtcatcggaaccgtaaatcgtcgggggcgtgaacccgcgctgatccgactgcgacgcctgagcggctgcatatccgtgcaggtaggcagcgcaggcggcgacatcgggagccgaaacgtcctcgtcgtcctgttgggcgagcaacgcccccagcatgccggcgagcacatcgcccgcccccgcggtgcccagccacgccggggcgcggccggagacgaccacacgcacatgctgctcatcatccgcgaatccaccctgcgcatccgactcccgatcggtgtcggccggctcgcccacgacaatcgtgaccgcacctttgagcagcacggtggcgccggtgagctcatgagcccgcaacgcccaatgcaatggctcgttctgcacatccgacgcatccacatcctcgcccctggcggtgagcagcgaggcgagctccccggcgtgcggggtgatgacgacctgcggcggcacctcgtcgggcagcaggtcgagagcgcccgcgtcgaccaccagcgggggcatatcataggcgaggtcatcatcgtcatccgggtcatcgtcagaggacagcgcataatgcgtcagaagcttggcgatggtctcacgctggaaatcatcatcctcggtctcacccgtcggaacgccggagcccacgacccaggcctgcacgcgccccttgccgagtacggcctccgggaccgcggcgagcaccatatcacggcacacctgcggacccatgtagcggatcatgccgatgtttgtcttggccgcggccttgcacgacagcaccgcggcgccggggtatcgttcggagccggtgatcagaccggtcacgccacgtaagtacttcgtgtctgcaagccgggggagtcggacggtctcagccgcgttgtcgccggaaaccgcctcgacgaacggcatatggccgtcgatgtcgaaactgaagtccaccagcgtcacgcgaccgcaggcgtacgccgcgggaggcagcataaggcacggcttcagggcgccgaacgtgaccgtgacatcggcagggatatacgggcctgtgatggcaccgtcgtcgactcccacgccggaggggacgtccaccgcgacgaccaacgggaactcgccggtcgagtcgccggcgggaagggcggtgcggtcggggatcgtgccgtcgacgcccagcgaggatgcgaccgtgcccgcgatgccgtgcagcgccccgctcaggccgatgcccgtcatcgcgtcgatgatgacatgcgcgtgctgggcgagttccaccgcggcccgaagcctttcaccggcctctccagcgctgaagccggcagcgcaccccggaatctcggaggccgggtcgaggatcagcaccttgccgccggcgcggacgaatgcggcgaagccctcgccatgcagcgtgcggccgaccgcgacggcggtgaccgaagcgccgttgctcgccagcatcgtcgcggcgaacagcccgtcgccgccgttgtcgccgctgccggcgagcagcacaatgttcgactcctccaacgcgacgccctcatcttcgatcatttcggcgacgacatgggctgtggcggcggaagccatcctcatcagggggacaccgttctcaagcagtggccgttccatctcccgcacgtctcgcgccgtgaaggcggcgtgacgaagaacgtggagcctgttctcatctgtctgccctggcatgatgcatcctccttggttcatggatcgtttccatcaatcggactttgcccgtccctccactctactcgctgtcgagccgtcgcggcgacgcgtctgcgataccgttacacgagttcgcgcgcgcgagcggtacgagcactcgcggcggacggctggaccgtgggggctctcacgtgacggctgcggcgacgacacgcggaagtgtcgccgccgctgtacttcaagcgctcgaagcggctaccgtgacatctcaaagcgagtcataatgaccgccgatcgcagtcaaaccgcaaggagatatcatgttcgatgagctgaaaagccgcatgaacaagttctggaacgatgacaggacgctggcacagacagacccggaattcgtcgagctgttctcgaacttcgcttatgacgaggtcgtcaacgagccgggagcgaatcaccccgatctggacgactccacacgctccatggccattctggcggcgttgatcggatgccagggtctcgacgacttcgagctgatggtgccggtcgcgttcgaatccggcgtcagtgccgtccaggtcaaggaaatcgtctaccaggcggtcgcatatctcggtttcggacgtgtactgccgttcctgaagaagaccaatgagatactggaggcgaagaacatccacctcccgctcgaaccgcaatccaccacgacgcccgaaacccgcgccgaggcgggcgagcaggcgcaaatcgacatcttcggcgagcgcatgcaaggcttcgcgcaatcagggccggagaagacccgtcacatcaacaagtggctggccggcaactgcttcggcgactattacacgcgcggcgggctcgacacgcgccgccgcgagatgatcacgctgtgcttcctggccgcgcagggagggtgcgagccgcagctcacctcccatgcggtggccaacatgcgcgtgggcaacgacgagaggttcctgatcgccgtcatctcccagtgcacgccgtatatcggttatccgcgcacgctcaacgcgttgcggtgcatcgccgacgcggcggcgaaggcgtgacagtcggcgcgggccgtcaggcttcctcgtgccagtgcgggttctacgcgaaggaacgtccctcgggattgtccatcgcggcgatgcgcacgatcgtcggatccttaagcatctggttggcgtggcccaatgggctccacgcctcggtgatggtgccatgcgcctgatcgtaggcgcgctgcccggcctgctggaagaaggggtacagctctactcggttgacggccggcgtgactccggtggagcggatcagcaagtcgatatgacccggcaggaagttgctgacgccgatgtgcttgacgatgccctgcttctgcgcgtcgacgagcgcctgccacgcctcgacgaactggccctgcgacgggttgggccaatgaatcagatacaggtcgatgtagtcgagtcccatgcgggccacggactcctcgatcgtgacgcgtgcctgatcgtactggtgatgacgacccggcagcttcgacgcgacgatgatgtcctctcgcggcacctctgattcgcggatagccttgccgaccacgccctcgttcggacatctatctgcgtttcgaggggttggtgcctgagtagagccgggccggaaaccgcatgattccaatgcgggatgtccccgcatactccggatatcgcgtttgggcaaccccttgaaacgcagatagatgttccgagagcgcgaaatcaacccctcgaagcggagataccgggtatcagcctgccagcggaggcaatgaggcacggtaaaaacgggttataggccagaatgtgtgtccgggataagccgtcacgtcttgtgctgactggtgcgtcgccgggttgaatgtgggtgccgggaccttcggggccggcaggcggctgcgccgtatcgcggtggcgctcatgcgcgtcgggggcggttcatcgcggaacacgtggtggaaccgtgttcgtgaagttcatgtcccccaagtatgacaaagcgggattccagcgacttgtaatcgttgggatcccgccattcttgtcgggccggcgggatttgaacccgcgaccccttgacccccagtcaagtgcgctaccaaactgcgctacggcccgaacagtgcgaaaagcaccgagaagagaatttaccatatgacgtcaataacgcaaaacaagcgtgtcgcgactcgggtaattcccgactatcacctcgcaatagggagacaccagctacatagacggcatggcccatccaagtcttatccaagttccatctgcgcataccattgcagtgcggcagccagccgccccaccccggatacccccgtaatggatacgtctgcgggatgattggcgaacgaagcaccacgcgagtagactataggaatgtttgccgaagatctgaaacggacggagaagatgacagtggacgatgtgttcgagcagtcggcgcagaagatgcgcgagcagggcatgagcgagatcgccatctcgcagttcaggcacgcataccatgtgtgggccagcgagaaggagagcgcgtggatccgcgaggacgccgtcgagccgctgcgcggcgtacggagcttccatgacgtgtacaagaccatcgatcatgacaaggcagtgcacgcgttcgccaagaccgcattcctcaagctcaacggcggcctgggaacctcgatgggcctgcaatgcgcgaagtcgctgctgccggtgcgccgccacaaggctcggcagatgcgcttcctcgacatcatcctcggtcaggtgctcaccgcgcgcacgaggctgaacgtgcctctgccggtcacgttcatgaactcgttccgcacttcggatgacacgatgaaggcactgcgacaccagcgcaagttcaagcagaccgacatccctctggagatcatccagcatcaggagccgaagatcgacgcggccaccggagcgccggcgtcttggccggccaacccagatctggagtggtgcccgcccggccacggcgacctgttctcgacgctgcgggagtccggcctgctggacactctgctggagcatggcttcgaatacctgttcatctcgaactccgacaatctgggtgcgcgcccgtctcgcacgctcgcccagtatttcgaggacacgggcgccccgttcatggtcgaggtcgccaatcgcacgtacgcggaccgcaagggtggccatatcgtgcgcgacacggccaccggccgactgatcctgcgggagatgtcgcaggtgcatcccgacgacaaggacgcggcccaagacatcgccaagcacccgtatttcaacacgaacaacatctgggtgcgcatcgacgtgctgcgcgacatgctcgccgagcatgacggcgtgctgccgcttcccgtcatcatcaacaacaagaccgtcgacccgaccgacccccagtccccggcggtggtccagctggagaccgcgatgggcgcggcgatcggcctgttcgaaggcgcgatctgtgtgcaggtggaccgcatgcggttcttgccggtgaagacgaccaacgacctgttcattatgcgttccgatcggttccaccttacggactcgtatgagatggaggacggcagctacattttcccgaacgtcgacctcgatccgcggtactacaagaacatcgaggacttcaacgaacggttcccctacaacgtgccgtcgctcgccgccgcgaactcggtcagcatcaagggagactggacattcggacgtgacgtcatcatgttcgccgacgcgcgtctggaggatagaaacgagcccagttacgtacccaacggcgaatgcgtcggaccgatgggcatcgagcccggtgattgggtgtgatgtgtccgccgtacgaagaaaaaatacctatttttgacaaaatgcgagccgcacacaacaaaaccctctatcatgggatgtggtgtgcgtgatacccatgcatatttaattggaatgctaacgatacgtgaggactaatggcagagggatcgaacgggagacgccgcttttccgacaaatggggcaaacatgagttggatgtgttggccgtgctgtcgtctgcgtttccgcagtggctgacctcgcggcaaatcgcccagcgcgtcaaggcatatgccgactcctacggggaacttgccgatcaggccgcgaaggccgcgttcgccaagcagttccagcgcgaccgcgccaagctcgcggcaatgggaatcgccattgagtcacgccagcctgaatactcctcgaagtccgagggacaggacttcgcgtcgtaccgactgcagctcggggacgagccgcgcatccgcctgcgcttcgagcaggaggatctgccggttctcgccgcggccaactatctcgcacgttcgatttccgtatcgtccacgcaatcgcagaccgtgacgccgcagcatgtgtcccgcaccacgccaagggtgccgcagacgcccatccccggcctcggattggattccatcgccccgggactcggcacgcagacgattccgccggctctcgtgcgcgtcgtcgactcccgccgtttcgcggcgacggtcgacgtggacggagagaacatcaacgtcgcctacaccgattccgacgacctcgccatgttcgtgctcgaacatcccggcgcagtgatcgtcagcccgcaggaggccgtcgacgccttcaaccgtcgtctccaggcggcgtcaaacatggcgctggccgacagatcgtcggacgataccggcagcgccacggtcgccacgcccaccatcaccagcacgacccccgagccggaggacgccgaccccaagaaaaaccaccagaagaagtccgggacctcgttccagaccggcagtgaggtcgaccgcagactgcgtctgatgctcttcctgtccgcccacctcggtgaggaattctccctcgcggaactcgcggaacgcttcatcggcaggcccaagtcggatgacgagctcaagaaatacgtcaacgtgatccacaaagacatcaacacgctgaccacggtctccgacgacggcgagatggccggaagccagttcttcgacatcgattggtcgctgcttgacgccgaaggcatcgtgtccgcgacgaattcgctcggactggaacgcctcgccggcatctccccgcaatacctgagcatgctcaccgcttcagtgagctacctcgcgcattcgccgctgctgccggaggcgcagcgcacgcaggcggcctcgctgtatcagcgtctgcgccagctggtcaagccgggggagaccccttggctgagcctgaccggctacgagctggagccccactgcttctccgtcgtcaagcgcgcgatctccaccgaatcgctgctcgacatggagtacacggacggcgcgggacggacccgccgcaaggtcgtcgccccgtccaagatcttcgtggatgagggcgtctactatgccgccgtctggaccgacgtgctggactccactccggaggaccggcgcaagttcgtctcacgcgaccagctcatcaacaaggcgaacggcaagccccgcacatggcaggtgctcaggctcgcccgcatcgagcacgccgaggtcatcgctccggtcaagcgcgtggacattcccgacatgccggtgagtgagttgcgcaagtggagcttcgacaacggcactccggccgtgttcatcacggatcagccggatcttccgttcatcaagtcgatgccgggagccaccgtcgagccgtgcagcccgggcgagaaggtgcatatcatcgtgtcgtccgattcctggttcgtcgccttctgcatcgcccatgcgcgtcacatcaccgcggtcgcacccgagaccctgcgcacgatgatcgtcgcccgtgcgcagcgcgagctcagcctcggcacacgtgaagaagacaccccggaagaggagtgatctcatgccctggtggatctggctcattctctcgctgttcatgctggcgatgatcgtggcgggcatcgcgtacgccgcccttcacggcttcagggcgttgaacggcattgcggagatcggcagccgtctcggcaagcccctctccgagctcgcggacgttccgcagggtgcggacgtgcgcgagccgctcgcccctccgacattcacccaaccgttgaacagcgccatcagccggtatgacgatgcgcaggtcgacgtcatcaggcaccggaacgcgaagcgcgaacgtcacgcgcgtgcgtgggcgcggtggtcacgtttcaaccgttgacggactgcggctgcaagctgcggcgcggcccgcggcatcgtctcatgcacgcaggcgaatacgagaatccgacggcgatggccgtctgtgacgaacggggtttcacgcatggtcaaacatcagcgcaatcattcggcggcggatcgacccggcccatcgccttcccagcggtatgccgcattccagaagcgtcaggcgcataacgcgagcgtcgccgcgcgtttcgcagccacgctgccgttcgacctggacgatttccagcaggacgcgatagacgcgttggagcggggggagaacgtgctcgtcgcggccccgacgggcgcaggcaagaccgtggtggccgacttcgcgatgtatctggcccgcgagcgcaatgtcaaggcgttctataccacgccgatcaaggcgttgagcaaccagaagtaccatgacctgaccgccgtttacggcgccgaccgcgtcgggctgctgacgggcgacatctcgatcaactccgaggccgacatcgtcgtcatgacgaccgaggtactgcgcaacatgctctacgagcattcgaccacgctcaacgcgctgcggttcgtcatactcgacgaggtccattacctcgccgaccggttccgcggcccggtctgggaggaggtcatcatccatcttccccggcaggtcagcgtcatcggattgtccgccacggtctccaatgtcgaggatttctcgtcctggatatcctccgtccgcggcgacactaagctggtggtctccgagcgccgtcccgtcccgctggagcagcatgtgctcgtgcaggccgacgaccacaccgagccggagctgctcgacctgtaccggcgtgacgcccagggcgagcagaccaccaagctcaacgcgcgcctgatcgaccggctcgatcagcttgaccgtcaggcggcgcgccgccgcggcgccgagaactcacgctcccgcggccgcgtccattcgcggggccacgcgccggcgcagcgccacacgcccaagcgctgggcggtggtcgacgagctcaactatctcgacatgcttcccggcatctatttcatattctcgcgcaacggctgcgatcaggccgtcgagcagtgcatcaatgcggggctggaactcaccaccgaggacgagatgcggcgtatccgcgccatcgtcgacgagatggtcgccgggcagttgagccaggaggatctcaaggcgttgcagttctcccggttcaggttcgcgctggaggagggcttcgcgtcccatcacgccggcatggtcgcgctgttccggcagatagtcgaacgcctgtttgaagagggactggtaaagatggtcttcgcgacggagacgctcgcgctgggcatcaacatgcctgcgcgctgcgtcatcgtcgaaaagctggagaagttcaacggcagcgggcatgtgccgctgacaccgggggagttcacccagctgaccggccgcgccggccgtcgcggcatcgatacgatcggacacgcgatcgtcgtcgaccatcgcgatttcgtacctgcgaccgccgccgcattgtccagcaagcgcgtctacccgctgcattcgagcttccatgccacgttcaacatggccgtcaatctgctcaacaccagcgactacgagacgactcgcgccacgctggaccattccttcgcccagtgggaggccaacgagtcggcctggcagctcgaatcgcaactgaccacgctgaaacaggcgttggacggctatgagcaggcattccactgcgagtacggggatttcgcgtctctgatgcgcatccgcatggagctgtccgacctggagaagaacggccggcgcaagctcaagcagaccgccttcccgaccgacgagcagcgcaagaacacgttccgcgagctggaccagtctatcgagaccctgaagaagcgcgaccgcgaacatccgtgccggcagtgccccgacatgcagcagcatatgaaatggggtcatcgctggattcgcgagatgcgcgaatacgagcgggtgcagcacaggtacgagtcgcgcaccggatccgtggcccggcagttcgaccgtatctgctccatcctggaacagctgggatacgtgaagcgcgacgggacggacatgcgattgagcgagcaggggcaactgctgcgccacatctacagcgagcaggacatcgtgcttgccgaagcgctggaacgcggcatgttcgaccatctgacggcgcgacagctcgccgcggtgctctccgccctggtgttcgaagccaggggaggcaccgggggagaaccgaggcgctggcccggcggcatccaaggcccggtcgcccagacttcgcaatctttggaccgtctgcatgcgcagctcacgatgctgtgcgaggatgaagggcttgacgacctgcagcaactcgacttcggcatcgtcgacatcatgtacgactgggccagcggcaacagtctggcatatgtgctgcatgaccgggacatgaccggcggcgatttcgtgcgcaacgcgaagcgtctgtccgacatcctccagcagatctcggcggcagagccgtatctgccgcaggggagcgcgcacctcgcccaggtcgcgcacaaggccatggaactggtcaaccgcggcatcgtcgcctattcgggcattggcgagggctgacggaatcgtcgcaggcggcaaggcaggaccggaacggggaatatacgactcgtccgaactgttttgtagcgtgataatagttttcgggaaagatcgacaagaaagaccacaaggaggaacgtcatggcggaacgcagcctacgcggtatgagcatcggcgcaaaatcactggaatccgacgacaacgtggacttcgccgcacgcagcgaagtggcgtacatctgtcccaagggacaccggaccatcctgccgttcgccgagggcgccgaaatccccgacgagtgggaatgccgctgcggcaccatcgcgcaccgcgagggcgacggcgacgaggaggccaacgagatcgccaagcccaccaggacccactgggacatgctgctggagcgtcgcagcgaggacgaactgaagaagctgctggacaagcgtcttgaaatgcaccacagcggctggattcccgactacgagtaaggggagaggcatgtctcagcatcaggtcacgacccggcagcgcaggaacgtggtgctgctcgaccttgacggcacgttgacgcaatcggatccgggcatcatcgcctgcgccaccaaggcgttcgaggagctcagcctgccggttcccgacgatcaggagatgcaccggttcatcggaccggccatcatcgaatcgttcagacgcaaccatatgccggacgagctgctggaccgcggcgtggagatataccgcgaatactatgcggacaaggcggtgttcgacgacccgaacaatcccggccacaaaattcccggacgactgtacaacagcgtgtacgccggtattcccgagcagctggcggcattgcgcgccgacggcttgcacctggcaatcgccacgtgcaagccgcaatatcaggccgagccagtgtgcgagcatttccatctcgataccatggtcgacggcatctacggcgccagcacagacaattcgcgcatcgacaaggaccaggtcatccgatactgcttcgacagcatcggattcgatgcgaatgccggtgaccgcgccctgatggtcggcgaccgttggaccgacgtcgacggcgccgtcgcatgcgggctcgattgcctgggttgccgttgggggtacgccgaagccggtgagcttgaggaacatggcgcataccgcatcatcgataccgtcgatgagcttgccgccgcggtgaatgattattttgcgaagtgaccatctgacataccgtactattatccgataatgtacgttatgtcagatttatgatcttcggggcagttgacgttccgcttttgcacttttatccggcgaaagtcctatttttcaagacgtgattatgggactttcgccggataaagatatcttcgtgcagattttggctgtgtttttcaggtaggtggcgatgaggatgagccggaggtcggcgaggaaggcctcgtcgagcctgtcgtactcgtgcgcgcggtccatgagcaggcgcgcgcccatgaacgcgttcgatgacttctcatgcatcatcaccagcaagcagacggtcaacatgccggtcgtagaggtcaagttcggcaacgacgacaacgaggtgcagggagacactttgttgggggaactgcccatcacgttccaaaccgacagctcgggatcatggaacatcgaattggacgcgacgaaactgacgccggatgctcttggtacgaacgcattcatcgtaatctataacacttgcagcggtgaacgtacggccagatatcgttatggattggggtttgccatatgatggcaaaccccaatccataacgatatattctcgtctcacagacgcatgcgtcacgcctcggtatgcgtggcgccgcggaccacacggtcgacttcggtgagatgcgcacgatgcgcctggatacccatcagcaacagctccacaaaaaccagcgcgatgactatcgccgcgccgatcaccaagtggtcggtgtagaaatcgtggaatgcgggggacagttcctcgctcgccatgagatacaccatgaaggggatgcccgcgaacagcacggacaccatctgggccagcaccacattccagctgacggggttcacctcggggtgcctctcccccgtgccgaaccggcttctcacaatgcagatgccgcacaccgagagcatccacacgacggcgaacacccacaacaacagcggaagcagctcatccatacgccagcctccggttatgccgcctcgcgtgcggcacgctgggcggcaatcttcctgcgcatgcgcatggcagtaagctcgtcgattggccgaccggcgacacgtcccgaccctgcggagccgacgttcgccgaggacgactgcagatcgacgtagtcctcggtctccagcgcgtcatgaatctgatgccacagcgagccgacggacacgccgaacacggccttgccgctctgcagcagtgcgatcatctggtcgctggtggtgcattcatgcacctcttccccatcgcacatgatggtgacatgctcaagctggtcgacatcgcgctgcatcaggaacccgatggccgtagtgacgttctgcaggttcacgcctgcatccagcagcttcttggacaccgcgagaatcaccacgtccttgaaggagtacagccgcctcgaccccgatccgtgagatggggtgatcgatggttcgacgatctgcttgcgcgcccaatagtccagctgacggtacgtgatgccggcgaccttggaagccaccgtaccacggtagccccgtgtcgggcggctggcgccttcgtcgacgaacagctccccctgcacggcgtcggacgcaccgagatcgagcctctgctccagcggcacgaccagatgcagcccggccgtctggctccctgtctgctcagccatcgcactcccccgtcctgtgcatgcgccgaaccggcacatgcacgatcacatgaatgtcgtaccgtcccagtctaacgcgcacggcttcgcatcatcacgcgataacggcggatttggtgaagaaaaccagacggaacttaccgatcatgatctcgtcgccgttgcgcagctgctgatggtccacccgctggcggttcacataggtgccgttgaggctgccggaatcgtataccgcgaatgtgtcgccgacgcggcggaacacggcatgggaacgggataccgtcgaatcgtccagcaggatgtcggcgcgggagtcgcgcccgaccgtcacctcgtcctcatcgagcaggtagcgggacccggaaacggcgcctctggtcgagatgagcagtgcggtgcccggtgcgagccgcgcgatggtttcgatgtcctcctgcgtgaggggacggtcacctgtggtggtgatgggaatctggatggcgggcagaccaatgatggtcgtctcgcctgcacttggaatcggatctgtcataaacgctattctacagcccttgcatacgtattgtcggttgacttgcgaatttggctgatggtaatcgaatccgaggacgtcacgctcaccgtcgcgccgtacttcaccttcagactcgaacccacgccacccgcgatattgacggcgttctgaaggttctggggatcgccgatggccaggatccgatacggcgcgttcagcgcgacaccgtcgcattccaggccgtcgtccgtgtcgctgacataggttttcgtcacgacacgcacgctgttgatggccatcacctcggcgcctgcgttgcgcagttcctcgatgagtttgtacatcgtcgccgcgtcgatcttcgtcttcgacccttgggagatgctgatcgacacgcccttgcccgtcgcgggcaaacgaccggcgaggatgccgttggtctcctcgttctgcttggcgatgcgctccgcctcctgcgtcttgttcgccgcggccttgagcgatcccagctgattggtcagctccgacttgcgctgctccaggttctgcacctgtgtgccggtctcgctgatcagcctggtcagctcgtcctcgctcagcgtctcgtatgtggcgtcggcgttgttgatctggatcatgtacccgtatcccagcagcgcgcacatgatgaggatgagcacgctcgtcatcaggcgcatgcgcgccgagccgtccttgacggggcgcttcggcttcttgcgcaccacggggaacgagccggtctccatgcgatcgttcttcttgtcctgcgcatgctgctcgtgcagctgcgacagcacgtcacgagacgatttgtgcgccaccatggttcatcacccccggaagatgaagcgacggatcgccgacacgttcgagaagatacggattcccagcacgacgatgacggccgtctgcagctgggatccgacgcccagctgattgcccaggaacaccagcagcgtcgcggtgaccacgttcgagatgaacgagatgacgaacaccttgtcggagaagctgcgctcgaagtacgcgcgggccgctcccagtagcgcgtcaagcgcggcgaccaccatgatgggaagatacggctgcagaatgatggggatatccggcttgacgaacacgccgagcaccacgccgatgatgagacctagtaccgctgccatctactcgctcctctttgcataggacaattcgccggaaggcgccgcttccagtgtaatcgaactctctttattcacctgagggtatatgcccgcctgggcgaacgaatcatacagactgcgctgcgtggacttgctgaccgcggaggccagcgtgtcgcggtcccctatcgcctggattgtgtacgggctggtcacggcggtgacgccgacgagaatgttcgatcccgccttgcgcaccgatgtctgcacgccgagccggttgccgttgatggctatgccctcggcgcccgcctgccacagcagtcgcaccagcagccgcaggtcggcgtcggtgaccacgcgaatctgcatgccgctggactcgcgtggcgtcgatgccccgtcggagccggcggcgatggggtcggccagggtcaggctgatgcccggcccctccacggcgacaagcccgttgaccatctcgtcgttgaccagcgtcgaatcctcacccgtgccgcccagcttcttcgatcgttccgtgacctggttgcgcagattgttgacttcgttcatgagcgtgtcggcctggccgcgcgtctcgcgcagctcgctggcaaggctttgcctgacgaccttgcgcgggtcggaatgcagccgttcgatgaacagcgacccgtagaaaccgacggcgatgcacatggcgaacaccagaaacttcgtcgcccacgtcgacagacgcgagcgcggacgctggtcgagcctcgaatccgagaacagcggatccatggggcggttggtgagatcgtcgatgagcttgagcgaatcgtcatgcagccgtctgcggcgggccggcatggtctgcccgccttccgcgggcctgacatgccgggactgcgactgggccacggaatccgaaaacaccgcgcgacgtttcaccggcgcgttctcggccggcacgggaaacgacagcggcttgatcggatcagcgtccatcggcacgtttctctttcaccagcagtgaaatgccctgcttgctgtagatgcaaccggcgagccaatacagtccgacgccccagatgccggcggccagcgcggcgaggtgcagaagcccgacgaaggggttcacccagatgtcgcagaaaatcagcgcgacgatggagaccatcagcatgaaagtgccggccttgccgacgaaatgcaccggcagcgggccgtaatcgtattgagcaagccacagcacgagcagcatcatccatgcgtccctggccgcgatgatgatgatcatccaccaggggatgatcccggcgacgcccaatgcgaggacgctgcagatgatcagcaggcggtcggcgatgggatcgaggatctgcccgatcttgctcacctgattgaaggcgcgcgcgatgatgccgtcgaggctgtcggtgatggccgaaacggcgaggacgatcagtgcgggcaccatccggtgatcggcgaccagccatgcgataaaggggatggacgcgattctcaggacgctgatgaggttcggcacggtgaagtagatgtccctcggctcggggctgtactcctggttgaacttctgcttgatcttctggcggtatccgccgtcggcgtgctgctgtgtatccattgtcgaacaccgttcgtcacatgcgggaggcctgcagcgcggtcacgatgatggcccgggcacccacctcgtacagcttgtccatcagctggttgaccttcgccttgggcaccatcacgcgcaccgcattccactgcttgtcgtgcagcggggatacggtcgggctctcgaatccgggggtcaccgcgacggcggccgccaccttgccgacggggatgtcatagtccatcagcacgtagcgctgcgcggtcagcacaccctgcaggcggcggctgaggatggtgagccgctcgtcctcggggtcgaggcgcggggagcggatgagcaccgcttcggagtgcatgatggggtcggcgaagatgcgcaggccggcgttgcgcagcgtagtgccggtggacaccacgtcggcgatgaggtcggccacgcccagctgcaccgaggactccacggcgccgtcgaggtggatggtctcggcctcgatgccgtgcgccaccagatagtcgtgcacgagcttgtcgaaggacgtgcccacacgcttgccctgaatgtcctgcagcgtatggaagtcggaatcgttcggcgcggcgaagcggaacgtggacgcaccgaagccgagctccatgtgctcgctggcctcggtgccggagttcagcagcaggtcatggcccgtgatgccgacgtcgatggtgccgcggccgacatacacggcgatgtcgagcggccgcagatagaacagctcgatgtcgttgtccgggtcctccaccacgagctgacgcggattggaacgcagacgataccccgcctcggacagcatgttccaagcgggctccgacaacatgcccttgttgggcactgcgattctgagcatggtgtttctccctccagaccggccggtctgtttgtcacaggtgcttataaacgtcctccagggtgatacccttggcgatcatcatgacctggagatggtacagcagctggctcatctcttcggccgtgcggtccgcgccctcgtattcggccgcaatccaggtctcccccgcctcttcgatgatcttcttgccgatgaagtgcgtgcccttggcgagctcgtccacggtcagggagccttcgggcttggtgacggccttctcggacagttcggcgaatagcgattcaaacgtcttcatgatatgtgtcccttgagattgtgcatggttgaggcactcgacggcgtcgccgcgatcgcggtccggcattggtgtcggagccgtcgcgtgccatgttctgcgtttccgccgtcagtcgcggtatgcggcagtggccttgtccctgatctggtcgatggacagggccgggctctcagcgccgtacacggcggagccggcgaccagcacgtcggcgccggcctcggcgacgatgtgggcggtcttcgggctgacgccgccgtcgacctgaatatgggtggacaggccccgacgcgtgatctcgtcacgcaggcgacgaaccttcgccatctggttgtccaggaacttctgtccgccgaaaccgggttcgacggtcatgatcagcaccatgtcgaactcgtcgaggatgtcgaaaatcggttcgaccggctcggcgggacgcacggcaaagcatgccttgcagcccatgtcacgcagctggcgggccagacgcaccggcgcgtgggtggcgcccatatggaacgagacggaggcggcaccgagcttcgcgtattcgggggcccaacggtcggggtcctcgatcatcaggtgcacgtcgaccggcaggtcggtgacctcgcagatgcgcttgacgatgggctcgccaagggtgaggttcggcacgaagtggtggtccatcacgtcaacatgcacgaggtcggcgttggcgatggccttgaggtcgcgttcgaggttgcagaaatcagcggaaaggatgctgggtgcgatttgtatgctcatggctctcattctatggtggaagaacgacgagacggcttgcgcctacacgacgttcttgtttgtgtgttatggtattgcggttttctatgctcttgtgcgatatcctgattcggacggatgcgggcgctcagtcctgatggacctcgctctcggcggtttcgccgggagtctcgggcttcgcggtcttggccgtcttgccggatttcgcggcggcccgctcctccagctggcgctgacgttccatctcgtcggccgtgaccgcgcgcagtctggatgtcagatcgcgtgtctcactgccgaagcgccacaacacgacgaacaggatgcacccggcaaggaacacgatgatcgcggtccacacgttgactcgcaggccgaggatgatcgtcgaatagttgatgcggatgctttcgatccaggtgcgtccaagcccgtaccacatcatgtacatggcgaactgctgtccggatttgagcacgtcgacgagtttgtggccgagccacacgataatcgcggcgccgatcaggttccagatcatctcgtacaggaacgtggggtggaacagcgtgccggtcgggcatgcctgtccgttgtagcagatctcacttttgccgatggcgtccgcatcgttgagcttgaggccccatggcagcgtggtcggcatgccgtacagttcctggttgaaccagttgcccagtcgtccgatggcctgcgctaccatcagcgccggcgcgatgcaatcggccagcagggcgaacggataacgccggtggcggcaccacaggaacgcggccaaggcccccaccccgatgccgccgaagatggccatgccgccttcccacaccttgaggatgttgatgaggttgccggttggcgggaagtagatgtcgggcgtcgtgatgcagtggtacagacgggccccgaccaggccgcagggcactgcgaccagcgtggtgtccagcacctggtcgaaggtgcccccgttcttcttccatctgacggtgaggatccacacggcgaagatgattcccgtcaggatgcagatcgcatacatgtggatcgtcaccggtccgatggagaacttggagaaccccggtgaggggatatacgcaagattcatgcagtgcctcgtttgtctagaccgctgttaccgccatctaccctaccccatggccggcggatgcacggtaaaggcagcccgccggcgcggggtgtgtcagcgtgactcgttgtggatgccctcggacagcgcctcgaccttggcggccaggtcgcgcagtccttccttcggcgccttcgcggtggcgttgtcgtcgtcaagcagggtgtgcaccagagcagaaccgacgatgacgccgtcggcgtaggcgccgaccttcgcgccctgctccggggtggatacgccgatacccacgcacacgtttctcgccccggcgttgcgggcacgctcgacaagcgttgcgggcgatgcgctgatggtgtcgcgctcgccggtgacgcccatacgggatgccgcgtagacgaagccgcgtgcgttgcgggcgaccagttcgagacgttcggaggccgaatccggggagaccaggaagatgcggtcgagtccgtgacgatccgaagcctcgatccactcgccagcctcatcggggatgaggtcgggggtaatcaggccggcaccgccggcgttctcgaaatcgcaggcgaaccgttcgacgccgtaatggtagatcaggttccagtagctcatgatgagtggcacgccgccggcgttggccaccgtctcgaccgccttgaacacgccgttgatgctttccccgttgttcagggcgatctggctggccgcctggatgacggggccgtccatcaccgggtcggagtacggcaggccgatctcgaccgcgtcgacgccgtgctcgatcatggtcctgagcgcgtcgagtgagatgtcggggttcgggaagccatacggcaggtatccgatgaaggccggcttgttttcggccttgagccggtcgaacatggcttccgtcgcgctgggcttgtgactgatgccgagcggctgtccggacggcgtggttgctgcattcgtcataatcaaaaactccttctgcttcacgggccggttcaggcgacggtgtcgccctgcgcgccggtgatatcgagcgccgcggcctgctcgtcggtcaggtatccgaaccatttgcccgcggtggccatgtccttgtcgccgcggccggagatgttgacgatcatcacggccttgtcgtatcccttggccttcagatcaacggcggccttgaaggcgccagcgacggcatgcgagctctcgatggcggggatgatgccctcggtctggctcaggtcgcggaaggcgttcatagcctcctcgtcggtggcccaggagtagttcacgcgcccgatctccttgagccaagcgtgctcggggccgacggaagcgtaatcgagaccggccgaaatcgaatacgtgtcgagagtctgtccttcatcggtctccaacaggtagctcttggcaccctggaacatgccgagctgtccggtgcccggtgcgaaacggatcgcatgatggcccgaggccggcccgttgccgcccgcctcatagccgtacaggttcacgcgctcgtcgtcgaggaacgcgttcatcacgccgatggcgttggatccgccgccgacgcacgcgcacaccgcgtccgggtggtcgatgccgtaccagtcctgaagttgctgcttggcctcctcgccgatgatcttctggaagtcgcgaaccatggccgggaacgggtgcggtccggcgaccgtgccgagcaggtagtgcgtgtcggcgacgttggtcacccaatcgcgcagcgcctcgttgattgcatccttgagaatcttgtcacccagtgtcacttcgacgacctcggcgcccagcatgcgcatgcgggccacgttgagggcctggcgtcgggcgtcgatctgccccatgtacacgcggcacttgagccctagcatcgcgcacacggtggcggtggccacgccgtgctgtccggcaccggtctcggcgatcacgcgggtcttgcccatgcgcttgacgagcaacgcctggccgagcgcgttgttgatcttgtgcgcgccggtgtggttgaggtcctcgcgcttcaagaagatgcgggcgtcgagtccggtcctgtccttgaccagcgcggcgaatcgcggggcttccgtcagcgggctcgggcggccgacgtaccgctgctgcagcgtcatgaattccttacggaactcggggtcggccttggcctgatcatagatgcgctccagctcgtccagagcggtgatcagtgcctccggcacgtatcgcccgccgaaccgtccccaatatggtccctgatgctcgctcaacggggtcgattcggatgctttcactctctgacctgcctttactagtcgttgtacggcggccacatggtcgtcggcggtggccacgccttcgcccaccagcacggcatccgcgccggcgcgaccgtaatcctcgacctcgaccgaaccgaacacgcccgactctgcgacgcggatcacgtcatcgggcagtccttcggcgagttcggcgtatttgttcacgtcaaccttcaggttcttgagattgcgcgcgttgatgccgatgatccgggcaccggccgcgaccgcgcggcggatctcctcggtggtgtgcgtttcgacgagcacggccatgccgagctcgtgggcgagttcaagcaggtgcgcgagcttgtcgtcgtccagcgcggcgacgatgagcagcactaggtcggcgccgtgggcacgcgcctcgtagatctggtagtcggtgacgatgaagtccttgcgcagcagcggaatgtgaaccgccgagcggaccttgtcgaaatcgtccagcgagccgaggaaccgccggccttcagtgagcacggaaatcgcgctcgcaccgccgcgctcgtattcgcgggccagggccgccgggtcggggatatcgctcaaatgccccttggatggggaggcgcgcttgatttcggcgatcacggggatgccgtccggacgcttgagccatcgcgtcgcgtcgataggcgccggcgcggccagagcggcccgcctcacatcctcaagagacacgacacattcgcgggaacgctggtcttccaacgccccggcaaccaattcgtccaaaaccgacataatgctcccttatagatcgttcggtcagtcgccactgtaattcatggcagacgacaaccgcgcgttccgtcctacattctgggcgtggccgcgggccggagcgggccgggatcgtggcccggcaacgaaagcggccgccgcggaggaatccgcgacggccgcgcatgcacgctcatccgtgcagggagagaccccgcgtcacttgcggcgcttcttctccctgatgttgacggagatctggatcggagtgccttcgaagccgaactcctcgcgcagggagcgctcaaggaaccggcggtagccgtgctccaggaatccggtggcgaagatcacgaagcgcggcggacgcgtggacgcctgcgtggcgaacaggatacgtggctgcttgcctccgcgcagcggatgcgggtgcgcggcctgaatctgaccgaggaaggcgttgagacgcccggtgggaatgcgcttgtcccaggattccagtgcgttgcgcatcgcgtcggcgaggcggttcgtgtgccatccggtcttcgcggacaggttgacgcgttgcgcccacgtcacgcggttgaactcggtcttccacaggcgctccagccgctgccggccgaaatcgtccatcaggtcccacttgttgaacaccagcaccactgcgcggccggcgtcgaccgcctggctcatcaccttcagatcctggtcggagatgggctgggacgagtcgaacaggaccagcgcaagctcggagcgctcgattgcggcctgcgtgcgcagggacgagtagtagtcggcaccggacaccttgtgcagtcgacgcttgatgccggcggtgtcgataaacagccagtcctcgccgtcgatgtcgatggtctcgtcgaccgggtcgcgggtcgtgccggcgaggtcgttgaccacggcgcgctgttcgccggcgagctggttgagcagcgacgacttgcccacgttcgggcggccgacgagcgcgacacgccgcagatgcgtaggcgtgaggaagcccgaggtcttgtccgccttgcgcagcgaatccagcgcggcgtcaagcaggtcgccgactcccctgccatgcatggccgagatcccgtaaggctcgcccatgccaagcttccagaactcggcggtcaggtattcgctggccccgtcgtcgaccttgttcaccgcgagcgtgaccggcttgccgctggcccgcagcatcttgacgatgcgctcgtcggtgtccgtcagccccacgtggccgtccacgacgaggatgaccgcgtcagacagctgcacggcgatctgcgcctgcgaggcgatggcggattcgatgccttcgacgtcggcctcccagccgccggtgtcgacgagcttgaattcggtgccggaccattccgcgtcgtagctgacacggtcccgggtcactccgggcgtgtcttcgacgaccgcggcgcgacggccgaggatgcggttgacgagcgtcgacttgcccacgttcgggcggccgaccacggcgagcactccgacggccttgggagccggcgactcgtcttcgatcccgtaccgggaaccggcgatgatctgctcgtcgccctcatccagttcgtaatcgctcagattggcggcatactgctcgtactcctgcacttcgaccgcgtccgcgaccagcgtgatcagcacatccagcgtctgctggaaatccatatcggagttgtcgacggtggtcacgccgtccgccgcggtcaggaagctggtgaccttggaatcggcgcggtcgcgggcggccacgtcctcgccccccacgccggcgccggcgacggcctgccccgtgcggcgcgcctgacgcacctcttcccgggcggtcagcagcacacgcacctcggcatcgggagccacgaccgtggtgatgtcacggccctccgcgacgatgccgcggcccagcgagaaggagtcggccgcggactcgcgcgcaatgtaggcgcgctgcgcggcgatgagcacgtggcgcaccgggatgacgttcgacaccttcgacacgtgcgaggagacctcggaggagcggatggcctcactgatgtcctcgccgtcggcggtgatgctcggatggtccgggtcgacgccgatgtcgaagtggtcgccggtgaagaattcggcgactgcttcggtgatctgctgctcatccacctgatcgccgtcgaggtcgatgccctgatgcaggcaccaccaggcgcatgcgcggtacatggcgccggtatcgaggtaggcgaagccgaaatggcgggccagcgccttcgaagtggaggactttccgacgcccgcagggccgtcgatggcgactcgtatcacagcccgacctccttctgcagggaacggacctcgacctgggacagcacacgataggtgccggacttaaggtcaccgagcttgatcggcccgatctgggtgcgcaccagacggcggaccgggtatccgatggcgccgaagatgcggcggacgatacggttcttgccggagtggagcaccaccttgacgatggtctggtcgcggttggcgtcgatgatggcgcaatggtccagcttgaccaggccgtcatccagctggacgccctgggtcaccaggcgccggcagacgttgccgccgatcttgccatcaatcgtggcgatgtaggtcttctccacttcgtacttcgggtgcatgacgtgctggctcagctcgccgtcgttggtcatgaggatcaggccctcggaatcgtagtcgaggcggcccatgtgaaacacgcgctcgtacttgtccccgatgatgtcggccagcgtgtagcggcctttcgggtcgtccatggcgctgagcaccttcttgggcttgttgagcgccaacgtgacatggttcgggttgaggtggacgcgcgagccgtccacacggatgtgctgcttcttcggatcgacgcgggtgccgagttcggtcaccagctccccgtcgacctcgacacgcccatcggtgatcatctgctcgcacttgcggcgtgatccgaagcccgcttgcgcgaggatcttctgcaggcggattccttcgttgttgttgtcgtcatgcgctttgagtgcgcgcgaatatacgtttggcatcgttctcccaacgtggccggacattgacaatgaatctgcgctcccggacgaactcacagggaaaacacagccaatacattgtatcgtatcgtccccccgttggtaaacttgcaacgttcggcgggtcgcaaagcccgcaacatcagaaaaaggacactacaacatcatgactgaagaacagaacaccgagccaagcgcttatccgatcggggcgcgcgtgtgcgcggagcttgcaggcagcttcctcgtctgcttcgccatctatatgatctgcacgttcggcacttcgatctacgggcttgacctggcgtacatcgtcgtgggcaccgcgttggcgtacgcggtcgtcaccgcgatgctcgggcgtgtctccggaggccagttcaatcccgccatcaccgtggcggcgatactcaccggcaagaccaaggtagtcgccggcatcctgtacgtcatcgtgcaggtggtcggagcgatcgcggcggccggcgcggtcaggtggatcctgccgacctcgcagaccgtcaccatgaagacgtggctgacgcccgccgtcaacggctatggcaccggttccgtatcgagcgccaccaccagcagcgcatcggtgagcttcggcatctccatggccatcgtcgtcgaggtgatcgccgcgatcatcatcatcgcggtcgcgatgcgtcacaccgatgcgaacggcaagccgaatgcgacgtacgctccggtgatcggcgccgcatacggcctcggcgtggccatgacctatacggtcaccggtgccgcgctgaacccggcccgcgccaccggcatcgcgctgttcgggcagaatcagggtctttcaacgcagccgctgcagcagttgtggatcttctggctggcgccggtcctggccgcggcgatcgtggcgctggtcatgatcatcgctgatatggcgtcgaaacgcaagccgaagacgcctgcggatgcgcccatcgacgaggcgacggacgctgaggcggatgcacatgacatcgccgtggacgcggcggtcaatgcggcgccccaggttccgtcaacgaatccagaacagtgacggtgcgaaatacaacagaagcagtcccagccccaaaccgatgccgataatggcgtcgaacaggactgaccggactttccaagggctcttctcgcgcatgatgatgcgcagcagggccgtgacgatggccgtgacggcgatgatcaccgtcgcggccatcgtatatccgaggaaggcgacgaccagggcgacgatgacgacgccgagcacgcaccactcgaatgccggcttgccctcgtggacttcggacacgtatggatgatgctgattcatggagcttcctcggggattggttatcgtgatggatcggccgcgaacccttgacggtcggcggccgatccgtgaatcggtgaccgggcggaggatcagtggaagaaatgacgggtgccggtcaggtacatcgtcacaccggccttcttggccgcctcgatgacctcctcgtcacggatggatccgccgggctgcacgatggcctttacaccggcgttcatcagcgtctcggcaccatctgcgaacgggaagaacgcgtcggacgcggcgaccgaaccggtggcgcgatcggcgccgtcggccagcgtgttggcgcgatcgacggccagatggcaggagtccacgcggttgacctggcccataccgatgccgaccgtagcctgatcgtgcgcgagcaggatggcgttggacttgacgcagcggatggcgcgccaggcgaacacgaggtccttgagcgtggcctcatcggcgggttcgccggccacgagcttccatgcgtccggatcgtcgccggtggcattgatgaggtccatgtcctgcacgagcaggccgccgtcgatctggcggaactgcgtgtggcccttcggcggctcggccaccttgaggatgcgcaggttcttcttcttggtcttgagcagttcaagcgccgcgtcctcgtaggcgggggcgacgatgacctcggtgaagatcgggcgaacgctttcggccatctccaacgtgacggtggtgttgcaggcgatgacgccgccgtaggcgctcaccggatcgcaggcgtgggccttcttgtgggcctcggctgcggtggctccgatggcgaggccgcacgggttgttgtgcttgaccacggccacggcgatggcgggtgccatatcccacacggcacgccatgcggcgtcggcgtccacgtagttgttgtagctcatcggcttgccgccgagctgttcggcgtgcgcgaagccgtcgcggtcgagcgggtcgaggtagagggcggcctgctggtgggagttctcgccgtagcgcagcgtgtgcgcgcggtcccaggtgcgggtgaacgcggccgggaacttcgcctcgttgaccgggttctcgccttcggccgggtcggcggattcgacggtggcgggcttgggccagtgcttggcggtccactcgttgatggtagcgtcataggcggcggtgtgggcgaacgccttgccggccagccagcggcgctcctccagactgaagccttcaccattggccacacgggccgcgacgagcgcatagtcggccgggtcggtgacgatggcgacggtggcactgttcttcgccgcgccacgcaccatggacgggccgccgatgtcgatcttctcgatgaccgcggcctcgtcggcgccggaacgaaccgtatcggcgaacgggtacaagttgacgacgaccaggtcgaagggcttgatgccgaacttctcaagctgggcggcgtgatcggggttggtcatgtcggcgaggatgccggcgtggatgtgcgggtcgagcgtcttgacacggccgtcgaggcactccgggaatccggtgacctcgctcacctcggtgacggcgacgccgagttcggcgaggcgcttggcggtcgagccggtggacaccacttcggtgccggccttgatgaaggcctcggccagtacttcgatgccttccttatggaagacggacaccagagcccgtcgtatcggtcgattcgtgttggtcatcgtgctccttcttggttgttggttgtatggacttgcgggaaacgatggtacgcgggtgcgttgttgcggctcgttgtgcccccgttcttcgtgcaatccagcgtatcccgaaaacaatggcgacgccaatcagcgccagcacccaggccatgcacagtcccatggcgctcggacgtccgacggcctgcgcggactgcatcacgtcgacgccgacgtatttgagcctggcctttcccagcgacccgttcgacaccccgaacatgaccgacgacagcagggatatgaccacgctcgacaggcagaacccgcccgccgggtaggcgagttcgagaatcaggtccttgcggtcgaggggatcggacgcgctgccgacgatgatgcggaaaccggatttcatcgccatggatgccagcccggcgacgaatccaacaaccagcggaatcagcacgacggcgaaccgtatgccttcatcgccgactgcctgcggaagcaggccgaaaacaggaagaggcggaagcgaacgcccctgcccgatccaaggggtgaatgtcgcaagctctccgatgtggaatccggcaccgaacagccacgagaccgcccatatgcacaggttgggcagccatgcaagcgatgcgatcgtcgtcagtatgcgcgagccggtccccatgccgatgtcggcgaacagcgtgtccatggccgaacggttcagcacgccccacacgatgacggtgatcagtcccatgaccaggtacacgcccatcatgatgacacccaccatcaggccggtcctgatcgtgcggcgcacgccgtcggacacatgatgacggataagttcacgcagctgcccggagagtgggcccttcgacagcgcggcgccggcgaatccaagcgagaacaccacggacgatttgacgcataccagagccggccagtcaagcaatccgacgggaagcgactgcgtgcccatgacgttgataaaaatccagaccaccacgccgctgacgtatgcgcggatatccgtgcatatcttccggctgaacgaccagaccaggcctatcagcagcacggtgagcagcagcggcatgatggacagggaaagcgagtcggtctcgaatccgatgccctggctgagcaggactacgatgcgggtcatgtccaacgtcgaggacgacaggttttccccaccttcctccatcgagatgaccagcagcatgagcgcaagaaagcagcccagggcgatggcgtacaacgccatcgagccgatggcgatgatcggccccctgagccaggcctggatacgcttcctcataccagcgagcgttcggcgagcaccttgcgcatgaggtccgcggtctgaccgggagtgcgtccgacgggaataccggcggcctccagcgcgattttcttgtcctgcgcggttcccttgcctccggagacgatggcgccggcatggcccatctgcttgccttccggcgcggtgaatccggcgatgtatgcgacgacgggcttggtcatgtgctctgcggcccatgccgcggcgtcctgctccgcgctgcctccgatttcgccgatcatgactactgccttcgtgtcggcatcctgctcgaattcctgcaaggcctccagcagcgtggtgccgacgatggggtcgccgccgatgcccaggcaggcggtgaagccgatgtcgctcagctcgcccatcagctggtaggtcagtgtgccggacttggagaccagtccgatgggaccacggcccacgatgccatcggggatgatgccgaggttgacgccatgctcgttctcctgcgacggcagggtgagcaggccggggcagttcggtccgatgatgcgcacgccacgctgaagggcgagttcgacgaagtaggcgctgtccgcaacgggaatgccttcggtgatgaccacgatgagcccgattccggcttcgacggactcgaccacggcgcctttggcgaaccgtggcggcacgaagaccacactggcctgggcgcccgtcgcctccttggcttcggcgcacgtggcgtacaccggaacggagacgtccctgccctcacgcgcggcctcgaacgtcacttggctgcccgccttgcgcgggttgacgccaccgacaatgttcgtaccggcacggagcatgcgagcggtgtgtgtcatgccctgatgcccggtcatgccttggacgatgacgggagcaccctcctggatgaatgcggtcattgcttggcctccttcgatgccttggcgttcgccgccagacgagcggcctcggctgcggcctgctccatggtgccttccacatgtaggttggggttgttcgccgcggcgaggatctgcaggccctcggctgcggcattgccgtcgaagcggaccacgagcggcttcgacgtgtgcagctcctcgaacgcctgcaggatgcccttggcgacctgctcgcatgaggtgatgccgccgtagacgttgatgaacacggattccacctgcgggtcggacagcacgatagacaggctgtcactcatcaccgcggcggacgcgccacctccgatgtcgaggaaattcgcaggcgtgacattcgtgccctgctccttgccggcgtcccagacggcgtcgagcgagctcatgaccaatccagcgccgttgccgatcacgccgacctgaccgtcgaggtgcacgtagtgcagcccgtgttcggccgccgccgcctcgaacggatcggcctgcatcggatcgtcgaagcgggtccacccgtcgtgccggaacgccgcattgccgtccaacgatatcttggcgtcgagggcgcacagtgatttggacgcctcatcgtcgggatcgccgatcttggcgagcgggttgatctccaccagcgtcgcgtcgttgtccttgaagcactgccacatgcgcagcaggatgttggcggcctgatccaggtcggcgtggtagaagccgatctggccagccatgcgcttggcggcctccatgtcgaaatcgccgagggcgttgatgtgcagacgcttgaccgattccggatgttccttggcgatctcctcgacttcggtgccgccgttcgcggtggcgaggacatcgaagtcccgcgatgtgcggtccacggatatcgacacgtagtactcgtgcaggatgttcttcgcctcggcgacgagcacaccgttgaccttatggccgtggatggtcatcgggaggatggattcggacagcagtatcgcttcgtcccggttgtgggcgatcttgacgccgcccgcctggccgcgatggccgatcttgacctgggccttgatcacgcacgggtatccgatggcatcggccgcttcggcgacctcgtgggagttctgggcgaaaacggcccgcggcgtgggaatatgctgttcctccagcaattctcgtgcctggtattcataaagatccatgttcgacgcctcacgttcctatgatgtgttcttcgaatgatgattggtgccgtgcggcgcgtcccgacgcacggcaccgccgggtcacgccggcatcgacaccagtgtgctgctgggtttgtcgcccagtttgtccagtccgtcgagtcctcgcagccccatgacgaagctgaatccgacgaccgtgcccccggccgcctcgaccagatccatggccgccttcgccgttccgccggtcgcgatgagatcgtcgacgatcagcacccgatcgcccggacggatggccgacgtctcgatctccactttttcggtgccgtattcgagatcgtattcctcggcgatggtctccggcggcagcttgcccgccttgcggatcgcgatgaaccccttgccgagcatggccgcgagggcggggccgaacaggaaccctctggcctccagccctgccaccgcgtcgaacgagtcttcggtgacgggaaggctggcctggagcgccttcatgagaatgcgcagccccttgccatccgccagcaccggcatgaaatcacggaatttgatgccctctttggggaatcccggtatggtgcgaatcttcgagacgaggtatgccgcgtcaccggcaccgacatcggccagtctctcaatggtgatgtcagactgcgtcatggtctcgcgctcccccgtcacttctcggcgtctgcggtctgcgcggaatcgtcggactgcgttgcgttctcggcggattccagcgccttgtccaccggtacctgggcctggtcgtcggcttcgtcggtctgctccgcgtcctccacttcgtcatcatggatgaaggcgggacgcgtgtactccttgttgatggcgcggaaggtgaagcgcagcagggagccctcggagtcgatgacgatctcctcgtattcctcgtccacggacactaccttgccgatgatgccgccaatggtgattacctcggttccgggctcaagggaggagcggaagtccttcatcttttgctgctgctgcttggccttgcgggactgccaccacatcatgatgccgatcagcacgatgaaaacgatcatgatgagataggatgatgaaccttgcggcatgatttctccttgcagtagggaacgaatgctctatggacgtcggtcaacaaacaaccaatgttagaagagcttgctgacatcctctgcgttcgtttcaccttgtggctccagacccagatgagaccaggccttggtcgtggcgacccggcctttgggagtgcggatcagaaatccttcacggaccagatacggctcgcatacggtttcgacggtctccgattcctcgccgaccatcgcggccaggttgttcaggccgacgggccctccgttgaagttgcgcacgatcgcgttgagcacggcgatgtccagccggtcaaggccctcggagtctatctgatagagcgcaagcgcggcgcgcacgtcatcaacgtccacgacttgcaggtcatgcacgatcgcccagtcacgcacacggcgcaacagcctgttcgcgattcgtggcgtgcctcgagaacgcagggcgagttccgcggcagccccctctcccaatgagactcccagaacgccggaggatcgctcgatcagcttttcgagctcatcgtgggggtagaagtcgagatgggccgtgaagccgaaacgcgcacgcagcggagaaggcagcatgccctcccgggtggttgcgcccaccacggtgaatctgggcagcgtcaacgggatggacgaggcgccgggccccttgcccaccatgacgtcgacgcggaaatcctccatggcgatgtacagcagttcctccgcggcgcgcggaagacggtggatctcgtcgatgaacagcacttcccctgcgtccagcgagctgagtatcgaagccaggtcgcccgcgtgctggattgccggaccggacgtgatgcgaatcggcacctccagctcgttggctacgatcatcgccaacgtggtcttgcccaatccgggagggccggcgagcaggatgtggtcgggggcggtgtcacgtttgcgggcggcgtccaggaacagctgcagctgggccttgagccgcggctgcccgacgaatccgtcaagggcatgaggccgcagttcctcgtcgctgatcggctcgtcgttgattgcggtggcggagaccatgcgtagggagtcctccgagacgccggtgttggtccgcccatcctgcatgtcgatgttggatgtcatggaatatcaccttcctctgtccagcgacgacaatgccagtttgagcacccgcggcacgtcctccgcactgatgggggtggctatgggcgcggcatcgcatgcctgacgtacggcctcctccgcggtctggggacgccatcccagagagacgagtccttcgatcacctgcctggctccggggtcgcgactttccgacggcccatcggcttcgggccgtatctggtcgaggtcgatgcggcctgccagttcaaggatgatcttctgtgcgccttttttgcccaggcccggagccttggacaatgccgccgtgtcgccgtccgcgacggccttggccagacggtccggaggcagcgtcgacaacagggaaagcgcgaccttcggcccgatgccactgaccttctgcaattgcaggaacatgcgtttggacgcgggtgacaggaacccgaacagggtgacggcatcctgcgatatggtcagcgaggtgaagacgtgcgtttcctgaccggcatgcaacgccgcaagatcggccgccgccatgcggacctcgtacccgacgccatgaacctcgatcacggcgctggatgcctccaccgactcgacgcgcccggttaacgtactgatcatcacgtcgtcctttcctcgccgaaccgcacgcggaatgggccgccacgagctcgttcgcctcgcatcgcataacgaaagcacatgccgaacgcgcccgccccgaactggcacgtcgtgcgggatatggtgtcgagacggcccatccacataatgcagaacatctgttcgatacacattacatgccgctgcggacgccggcgcgtcgggcggccttctgcgccgcctgcgcccactgccgttgagccgcagtcagatgctgttcccgttcgcctccctgcaaggcgccttgcgggcgcagggcatggcatatcgccagcgacagcgcgtcggcggcatcggcgggctgcggcaacgtgttcagccccagcaccttggccaccatgcgttcgatctgtatcttctcggccttgccgttgcccgtgatcgcgagcttcgcctcggtcggcgtgtgcagcgccacgggaatcccccgttgcgcggcggcgagcatggccattcctgcggcctgggcggtgcccagcacggtgttgcggttcgactgggcgaacacgcgctcgatcgacaccgcatcgggaatgaatcggtccattttggagcacagcccgttgtagatcgtcagcagtcggaggtcctgcgacgtatggggatccgaacgcaccacatcgacgtggataaacgaaagccggcggttagcgccggcttcgatcacgccgaccccgcagcgtgtcagcccgggatcgacgccaaggatgatcacaggggattactcctcgtccgcgagctgggccatcacctcgtcggatgcggtccagttggcgtagatgttctgcacatcgtccaggtcatcgaggttgtcgatgagcttggagaccttctgggcgtcctcaaggctgagcgacacctcgttcttcgggcgcatgaccatatcggcggagtcgtagtcgaaaccagagtcctgcagagccttgcggattgtatgcagatcggagggatcggtgatcacggtgaacacgtcgccgtcgtcgatcacgtcttccgcaccggcgtcgccggccttctcgaacaggtcgtcgaagtcgacgccctcgctcggaacctcgatctggcccttacgctcgaagttgaagctgacggaaccgctggtggccagcgagccgttgcccttggtcagggtggaacggacttcggcggcggcgcggttgcggttgtcggtcaggcactcgatgatcaggccgacgccggcaggcgcgtagccctcgtacacgatgtcctcgtagttggcgccaccggcttcttcaccagagccgcgcttgacggcgcgcttgatgttgtcggccggcatggacgctttcttggccttgtagatggcgtcgtacagcgacgggttgccatccgggtcgccgccgcccatacgggccgcgatctcgatgttcttgatgagcttggcgaagagcttgccgcgcttggcgtcaatggcggccttcttgtgcttggtagtcgcccacttggaatgccctgacataatgctcctacaggtatacggatactgacaaacgtcactatgataaagcggcaagacgacaacggcagtcctgggttctgccgctgccggtcattacgccgcaagaggaaccgcaggcaccgccgaaagtcccatctgatgacacagaaatgggactttcgcgggatgacggacgatgatggagctgcgcacgcctgccgggccggcaatacggcgaggcctccgccgtgaaatgtacggcggaggcctcgttcattggtcagaggttccgattcgaatcagcgacgctgacggcgaaccgcaagcatcacgatggcacctgccgcgcagatcatcgcggccagtgcggcgccagagacactggcaccggtctcggcgacgacatcaccgggctttccgccttcgggcttgatctggggcttgttgtcgccggacggcttctgcgggtccggattcggcttgggggtcggatcgggatcaggatcgaccgtgcccttgtcagtgacggtcatcgtgaacgaatccttgatcgaaccgtcatccttcagtgccacggtcacggtcaaatccccggcggcctcgaacggcttggtcacatcgattgcgttgccgtccttgtcggtcaccgcgatcgtgtaatccgcggctgcgagcacggcggtcgtcttgtcgctcttggtggcgaccaccttcaccttcgacggatcgaacgtatcaccgaccttcacgtcggactgcgaggtcgaagcctttatggagacgaccgtcacctccggttcgggatccggatcaggcgtcggacgctcgtcgccggtccaagtctgagtcaccttaccgtccttgatagcgatgctcatcgaggaatccgaagggatcgggtaggtggaggaggacacggagacgtcgagacggcctacggcctcgctgtcggccgcgagcacgtcggacggcaaggtgacgtacacgtcgacgatggagttcatgtgcgccccgttgacgacgagacgaccgttcttcagctgctgttggctgtaggtctgcttcatgtccggtgtcaccggcagattgaccgcggtaccgccctcggccgtgtacgtggcagtgaagctcaggccatcggtgccggtcaggccgggttcggcgtaccgtccgacaagcaccttgccgtcggtcaccttctgctcggccgcgtcgacagccgcgtacgaacccttccagctggtcacctcagtggccttgtggaagttggcgccacggttcatcaggtcgatggcgatgtcgccgacgcgcttgttccagttgtcgtaatccttgcggttctgctgggtccagccgacctcggcggtcgccatcatgcgggtgtacatcaggaattcggcgtcgttgagagaacgcaggtgctcgctccacagcgcatcctcgacgcccagaaccttgtcctcggtggtgccggcggatgaggtcgggttccactggtagaagttgctggtcgtgcaggcgccgcacgcccaggtcacgccagtggtctcggtgccgggacgctgcgggaagtaggtgttgccggccggcgacatgatgatcttgccgttgcgctggttgagcagcttctggatgctggcattgttggctgcgttgccggtccaatgctgcaccacggatccttcggggatctggtcaaccgcgtcgaggccgtcgttccacacgatggtggtcttgtcacgttccttgaccagcgctccggaccgtccgagatactcctgtagacgttccgtcttgttgccggcgccgccgctgaggaacagctcatcgccgcccaggtggaagtacatgcgtttgagctcggacgcaggcatggtggacgccttgatgcccttgtcgatcatgccgtcgagctggtccatgatatgccccagcacggtgtaggtgatgtcggcgtcagtcgcgaggctgctcctgccctgcgcagactggatgaaggcgggggtgtcctcgccggccgcaggcttcgggttggagttgccggtgttgagctcggcaaggccgtgcagcaggctgaaggaatgtccgggaccgtcgatctcgggcacgatggcgatgccgtgatcggcggcgtaggcgaccagttcgatgaactcgctctgcgtccagtagccggtgcgcccgtcctgtgccggggaccagttgctggtccacgcggactggtagctgatggcgccggacttgatcgcgagctgcgtgtagtcggtcgtatcgccgtccgcacgcccgtcattggtgatctcgacgcggaagccctcgtcctcgctcaggtgcaggtgcagcgtgttcatcttgtaggccgacatcacgtcgatcatctgcttcatctcatcgagcgggtagaaggaacgcgccgggtcgaccagcacgccgcgccactggtaacgcggggcgtcggcgatgttgacggccgggatgaaagcgacatcggcaagcttcaccgtggagttcgtccacggaccgatcagctgcagcaacgtctgcgccgcccatatgcccgcggtggcgctgcgggccttgacggtgaccgagtcggcgtcggagacgatcgtgtaggcctcatcggcggtgatcgactgggcggaaccgacgtgaccggtgacgtctaggttctcgtcaagggtgaaggtgatcgggcagttcgtgccttcggcgagtttcaggccgtacgaggtgccgagctcgtcacgcatgacgtcaaccgcaggcaggaggctgccgtcgctcacggacacgcaggtgttcttcttaagttcaaacgcctctccgtcagcggattgcgcatatagcggcctcggggtgagccggctcaacgggtcggtggcgactgccgagatggtccccatcgtgcgcatctcccacacggaaagcgaccaggattggctcttcgtggtcgcgatcatgcggatgtgccgggttttgatcggcgtgtcgaatgtggttttgacccattgcgcctgtgccgtcgccttgagtcccgtcttcacatcggtccagttggagccgtcatcggaagtctggatggagtaattcgtcgcataggtgttgccccaggcgatgttcacactggaaatcgtcgcttcgccggggaattcgtaggccagccaccaggggccgctccccctgtcggcgctccagcgcgaggcgccggatgcgttgtgcacgcttttgtcggtggggttgtccggcagatcctggttgtcggcggccagttccggcccgaatccggaactgacttcgcgaccggacgcggtgaccgtcgccatggtcgcgaggttggacactgtggaagtggatgattccgccgctgccgccgcctctgcgttgtgctgcgccaaggccgatgaggccggcaccagcagcatcgccgatgcgcagatcagtgacatgaatcttgcgaggccacgtcgtttgatattcatgggatgatggctctttctctgtatctcctggcaggctcgctattgaaccacaccattatccggcctattgaatggaccgcgactttacattccagcgtcaatatatcacgtcatcccatttttgtaaatatagtgcacaaaatgagcgagtcttgacatcacttatggaaagacccccgtcggcagcgaaacggttgctgacgggggtcttcaacgggcgcgaggggcccgtgcgtcaccttatgccaatgcggcggcgaagtcgtccgcggagttgacctgcgcacgcttcttgatgacggcgagaatcttctcgcgcgcctcgtccaccggcacgccgttgagctggctgccatcgcggaagcggaagctcaccgcgttgttgttcatatcctcttcgccgacgatgaggatgaacggcaccttggacttggaggcgttgcggatcttcttcccgaagcggtcatcggagtagtcgatctcgcagcggaccatctcgtcctccagcgacttgacgaaaccggccagatgcggcgcgaactcgtcggccaccggcacgccgagcacctgcacgggggcgagccatgccgggaacgcaccggcatagtgctccagcagcacggcgaagaagcgttcgatggagccgaacagggcacgatgaatcatcaccggacgctggtgggtgccgtccttcgcgatgtattcgagctggaaacgctcgggcaggttgaaatcgagctggatggtcgagacctgccaggtacggccgatcgcgtcgcgggcctgcacggagatcttcgggccgtagaacgcggcgccgcccgggtcggccacgaggtcgaggtgggatgcctcggcgacctcgcgcagcgtgcgggtggcctcttcccagatctcgtcggaaccgacgtacttgtccggatccttggtggacagctcaaggtagaagtcagacaggccgaagtccttgagcaggttcagcacgaaggtcagcaggctggtcagctcgtccttcatctgctcgcgggtgcagtagatgtgggagtcgtcctgagtcagaccgcgcacgcgggtcaggccgtggacctcgccggacttctcgtaacggtacacggtgccgaactcgaacagacgcagcggcagctcgcggtaggagcgctggcgcgacttgaagatcagattgtgcatcgggcagttcatgggcttcaggtagtagtcggcgcccggcttggtgatgttgccgtcggcgtcgtactcctcgtccaggtgcatcggcgggtacatgccgtccttgtaccagtgcaggtggccggaggtctcgtacaggccgcccttggtgatgtgcggggtctgcacgaagctgtagtggtgcttacggtgcatctcacgcgagtagtcctccatcgcgttgatcaccgcggcgcccttggggtggaacacggccagaccgggtccgatctcctccgggaaggagaacaggtccatctcggcgccgagcttgcggtggtcgcgcttggcagcctcctccaggcgggtctggtaggccttgaggtcttccttggtggcccacgcggtgccgtagatgcgctgcatggtggggttcttctcggatccgcgccagtaggcggcggcggaacgctcgatcttgaacgccttgatgaagcgggtgttcggcaggtgcggtccgcggcacaggtccttccagacggtgttgccgtcacggtcgacgttgtcgtagaagctcagctccttgccggagacctcggtggcggtggacgggtcgaggtgcgcttccttgtcctcgatcagctcgatcttgaatggctggtcggtctcctccttgagggcctcctcctcggtgaccacacggcggcggaaggactgggcggacttgacgatgcgctgcatgtgcttttcgatcgccttcaggtcgtccggggtgaagggttcgtcgacctggaagtcgtagtagaagccgtccttgatgatcgggccgacgcccagcttcacgttcgggaacagctcctggaccgcctgggccatgacatgcgtggcggagtggcgcatgatgccgaggccgtcttcggaatcgatcgcgacgggttcgaccgcgtcgccgtcgctgagcggcgtgcacaggtcgcgcagttcgccgttgaggcggacggcaatgatgtccttgtcgtccgcgaagagctcgacgccggtggtggttgcttccacctccttcgcttcgccgttgactgtgatggagatggagcttagcgccatgatgtgtcctttgctatcggggcccgcgttaccaatgtgcaggcctggactggtaatcaacagtggcaacgataggaacccgcgcagacaatgcctcgttcatgctccgcggccggggccgccgggcatgcgaacggggccgtcgccgcggttcccgatcatggggagaaccatggcgacggccccggcaacgtaccttggaggcggagtatcagtccttctttctggaaggcttgatgccgcattgttcctcaccggtgccctccagcgcggaggctggagagaagttcagcaggttggcggaggaggcgcccttcacggcaccgagaccggagggcttgcctgccgccggcgcttcgacgggtgccttggcttccggttgcgcggccgcgacggcgtcctcgtcctcgctggcgtcctcatcctcgaactccttgcgtccatagtagaggtccttgtcgaggtccttctcggtggcggccacgatcaccgccgtgttggcggcaccggccacgttgagagcggtgcggcccatatcgacgatctgcgagatcggctggctgatcgcgatgaacgggatcggcagaccggccgccgcgaacagcgaggtcgcggtgatcgtcgcggtgccgggcacgcccactgtgccgatggacacaagcagggcgagcaccaccaggaacaggaactgggcgggcgagtacgaaattccctgggcgttcactgcgaacacagcgagcagcacgggccacacgccggcgcatccaggcatgccgaggttcgcgccaagactggcaacgaaggacgcgatatcgccgggcacgccgttggagcgcaggttgcgcacggtcacgggaatcgtgccgatgctgctttcggaggtgaacgccaccacgccggtgggccagtatgccttgaagaacggaatcgggctcaggcgcgtcgtgacggacaggatgagcggctgcacgatgaacagctgcaggatcatcgcgacgtacgcgaccacgagcacggtgaccagcggtagcagtgccgccacatcactgttgctcacagcggcggcgatcagcgcgagcaccgcgtacggagtgaatccgacaacgatctgcgtggccttggacagcactacgttgccggcatccacgaacgccttgaacggtttgacggccgcggcgcccttggcggtcttggcggcggagttgtaggcgacggccacgaggatcgcgaagatcaccacgggcacgacctgattggaataccagttctggacgaggttcgtcgggaacagcgccacaatcgtgtcgagcacagcggacacctcgcgctgctggtagtcggtgggcagcgtgaacttgaagccctcgcccacgcggaacagcagggccaatcccagcgtgatcagcgcggcggtaaacgtattgatgagcaggaacaccacggtcttgataccgatgttcctcagcttgagcgattctcccagattggtgatcgccgcgatcacgctgaacagcagcaacggcaccacaatagccgcgatcgcgttcgaccatacgctgccgaacgccgccacatagtcggtatgtcccttgaacgcgataccgaccacaatgcccagtacggtcgcgatcagcacgcggacgctgaatcccgctttcttcctgatactcagataagccaaacccgcaaacagcacaacagtggcacccagcgccacccaattccatgccgtatcggacatgtcatctcctttcgtgtcatgacgacgcgacgcctgatacaggtgcggcaccgctcttgattccatcgattcaccgtacagtagcggacgaaacaacatttcggaagtgctatcggttttttcgataagggcttaacagtaccgcttcaaagttgggagcagaggactgcggcaattacctaaatgactgaagctcttacgccggtaggtgaaacgcgaagcgagcagcggggtattgtacgggcgctgaaaacaccgtatccgaagccccatagaccagagcggattgatggagcggacaacgggactcgaacccgcggtctcaaccttggcaaggttgcgctttaccaactaagctatgtccgcagtataccgatacaagaccggcatcgtgggtgatgtaggaatcgaacctacgaccccttccgtgtgaaggaagtgcgctagccgctgcgccaatcacccgcaaacaacaaatgttcattttacgtgacatcatcggcgagcgcaaccattacggcgagtcgccatgcagtccgcggctacgacgaaagcacatgacttgaacaacgcagaccgacacgcgataatcgacgcaacgggggcaaaggagacgtcatgaccgaacagcagccgcaggaaccctatggcgatccgcaatacgagtcatacagggaaggcacgccgaccgagtcagtgccgaccatatcaatgccgaccgagtcgatacccatcacaggcgcgtcgggcccgacaggagcatcacggcagcgccaggcaccacaaccgcacaccccatacggattctcttcagccacgcggcctcccacatccgggccgtatgcgcccggccctttcccgactcctgaagcccgtgcgacacagggctcatacgaagcgcccgccccatggtccaggacgctcaacggcgcatcatcgtcggcatcatccccgttcaccacgggccaaacaaatcgtcaggcccatcccccatacccgccgtacccgatgccgccataccagcagtaccgcccgatgcagcccccgaggaaaacaggcatcggggcgggcggcatcacggcgatagtcgccgccgtaatcgtcatacccgcgctgctgttcatcgccgtgaccgccgggctcatgacggtggcgaagaaccatatcagccaaggtgccaacgagccgaccaacagctacggcaacgcgtctccctccgacccgaatcaggccgaccccgagccgaccgccaccgtctaccgcatggacgagtggcccggatacgagagcatggtgacctacgtgaccgacaaactcgatcattacaaggacgagatactcaacaacaacaccatgttcatgagcgaataccggatacccgacacgcaggacggcaccgactacatgacgggatacatggcggcgttgctgggcaccgtgaacgaggccaaggcggcagcggacgagaccagcgaggaccccgatgcgctggatgcgaagatcgactcgtaccgaaccaccgtcgacacccttgaagcacggtttaagaaagggcaggcgctcggcgtttcgatgaccgttaccggcaacgatggcaagaagtacacggtcgacggcagcaaatcaatcacgctcaggcctacctgggacgagctggaacagcgcgtcgccaaagcctcgaactcgctggggagtggcaacgccgccagcgcgcagaaactggtggagctcgcggacatgaagctcagctgggacatcgacgagggattcagacagtgcccggcgtttgcgggcaccgatgacggcgacaacaaggcgctgacgaagtccgagacgttcggcttctactgccctgccacgccgaacgtgatctacggcaaccgcagcatgcccgactggaacatgacctacgcgccggccgcgggcgtgaggcacgagttgtcccaccacgccatccacatgcgctgcggcaccatcgagcccgaggccatcatgcagaacggcgtgaaccgcaccgaaggcgtgacgaacagctacgcggtcaagtacatgggcgcgaaccgcgccctgatccagcagagcatcgattacgcggccagcaccgggcacaagcagtatcgcatggatgcgttcaccgaccgggccgcggaacgcatccactccgggcaatgcaacgcgggatgagcaatcgggcggggttctggagtctaattgcgtttcgagggggtgcttcaggctcgttcggacatctatctgcgtttcgaggggttggtgcccgagtagagccgggccggaaaccgcatgattccaatgcgggatgtccccgcatactccggatatcgcgtttgggcaaccccttgaaacgcagatagatgttccgagagcgcgagatcaacccctcgaagcggagataccgggtatcagcctgccagcggaggcaatgaggcacggtaaaaacgggttataggcagaaacacccgaaggcgctacatataagaggaatatggtgggcgatacaagattcgaacttgtgaccccttccgtgtcagggaagtgcgctacctctgcgccaaccgcccgggtctgtaccatttgacggaaaccatcatgttacggattccatgcaaacgagaggtgggtacgagagtcgaactcgtctatacggctttgcaggccgctgcctaaccgcttggctaacccaccgcaaaggtcgtcaactcttcggaccttagagcggacaacgggactcgaacccgcggtctcaaccttggcaaggttgcgctttaccaactaagctatgtccgcgtttccttgaccagcgtcatgccgtcaagcaacagatagcaactatagtgacaaccatgggatttgccaaatccggcgtgtcgcgcgatgtcacggcctgcgaccgatcacccacaggccttgctataccgcgattctctgatggcataagccgcctgcaccaactgcgaggaaccgttacattggttgatatgagtgaagaagcgaaagcgcatgaaccggtgatgatcgccgcattcgaaggctggaacgacgcatgccaggcagccaccaacgtcatccggcatctcgtgtcgcgctacgattcacgcgagatccgccacatccgctgcgatgggtactacgactaccaggtcgcgcgcccgatgctgtgcaaggtgacgggccgacgccggatcctatggccgcagacgacgttctacgccatcgacgtggcgccctcgacgaccctgtatgcgcagatcgcgcccgagcccaactaccgttggaacgactactgccgtcaaagcatgcgcatcgccgaggagcttgacgtccgccatatcgtgaccatgggcgccatgttcgccgactgcccgcacacgcgcgcgctgccgctcgacatcagcgaccagcagtgtcagtgcgacatggaccgggaatacagcggccctgtcggcatcccgaccgtgctggattgcatggcatgcgaggagggattctcgaccacgtcgatgtgggtgtccgtcccgcaatacctcggcagcgacgaatgcgcgcaggccaccatgcagatgctcgcggcattgtccgaccgcatcggcgtcgagctggatccgggcgacctcgccggcaaggccgaacagtggaaggcgcaggcttcggtgctgacgcgctgcaacgacgacctcgcccaatacgtgaaacaccttgagcatgattacgacatgcaggagaaagccgatcaggtggcgcgcttcggcgctccggccgcggaacagctggtgcgcgaggcggaggccttcctgcgcagtcgcggcaagtgacgcgggccgcataatctcacggcaacgcaaatggcgtccgttccgcgaagccgcgaaccggacgccatccaagcgtgtttcgtgacgttacagcgatgactgcaacgtcaccctgccgccgtcatctgaccgcggctgcggattgctccacggtgacgatgctgaccggattgacgacgctggccgcgctggcggccttcaccggctcatacggcttcagggcgccgaacagcagcagcagcgcgacgatcaccgacaggccgatgcgatagatggagaacgccttgtacgagaacgtggagacgaacttcaggaacccgatgatgacgatgtagccgagcaggaagctgatgatcatcgcgatgatggtcggaatccagccggggaacatgcgatcggtcccggcgttcttcacggccttgaccgcttcgagcaggccggagccgaacaccgcggggatggccatgaggaagctcaggcgcacggccgattcgcgcgtgtatcccagcgcacggccgacggtgatggtgccgccggagcgggacacgccggggatgagcgccatcgactggccgaggccgaacaggaaggcgtcgcgatagttcatgtcgtccatggtcttgatctgccgggagcgggcgtccacgatccacagcagcagaccgaacaggaacagcacggtaacggtgatccacaggttgcgcagcgacgtctcgatgatgttctgcagcgtgaagccgaggatgatgatcggaatcgagccgacgatgacgttccatccgagcgtcgcgtacttgtcgccgcgacccatgcgcgcacgccagtccgggccgttcttgccgaacaggcatccgaaccagtgcgacaggatgttgatgatgtcacgacggaaatacaggatcaccgcgagctcggtgccgatctggatgatggcggtgaatgccgcgccgggatccgcgcccagcatcagatctccgatgatgcggatatgcgcgctggacgacaccggaaaatactcggtgagcgcctgcacgattcccagaataatcgcttggaagaaattcatgatccctcttgaatgattgtccgtcctttaccgtggacaagggtactcagcgtcccctaagaatgtgtcaaacatcgtattgtcgtacagaaaacccacaatgaggggtggatagtcgggacgtcacggggaggaattatggcacgataccgcaagtcaaggatgtgggcgccgcagggctttttcgagtgcgagggccgcggcctgcaatggctcggcgaggcgcaggcgcagggcggaccccgcgtggtggacgtctacgaatggggcaaggattttctcgacatcgaacgcgtatccccctgctcccccacggccaaggcggcccacgatttcggcgcggccctggcgcggatgcatgacgcggggacggaccacttcggctcggctccggccggatatgacggcacctgctatttcgggccgctgcaggatccggtgccgatggcgaccggcgcgtgggatgacccgatcacctatttcgcgcaggggcggctggtcccgatggtcgaactgggcatgcgtcgcggagagctgacccaggccgacatggacctgacgaaccgcgtcatcgacgcgatgcccgaccttctggggcgtgcggcgcaggacaagccggcacgagtgcacggtgacctgtggagcggcaacgtgatgtgggccgacgaccgaggctcgtgcgaggccgtgctgatcgacccggccgcacacggcggtcatcgcgaggaggatctcgcgatgctgcacctgttcggcatgagctatctgaccgagatcatggacggttaccagagcgtgcatccgctgaaggccggatggcaggagcgcacgacgctgtggcaactgtatccgatcgccgggcactgcgtgttcttcggcggcgggtacatcagcgaataccgttccatgtgccgctcgctgctcaagtagcaggagcccgcaacaagaggcatatgtacgggaaagggctttcagaccagagtgtctgaaagcccttttcaatgccgaagccgctgatcggcgcgaatgacgagcgctgccgagcatggacgagcatagccgaattcagctcagcgcgtccttcaacttactgaaaaaccccttgcgctggctgccggtggcggggcgcgagctctgcgcgacgtgcgacgccgaggcgtcgtggctggccgcgaactgctcgatgagcgaacgctccgagtcggtcagcttggtcgggatgtgcacgttgacatgggcgacgagatcgccgcgctcgccggattggcgcagcttggtgacgcccaggttcttcaggacaatcgtctcctcgggctggcatccggccggcacggtcaccttctgcttgccgtcgaaggtgtcgatctccatgtcgtgacccaatgcggcccagctcatcggcacctgaatccagcaatgcaggtcgtcgccgctgcgggtgaagcgcttgtcggccttgatgcgcacgtcgacgtacaagtcgccggccgcgccgccgccttcaccgacctcgccctgatgggcgaggcgtatgcgcgattcgtccgcgatgccagcgggaaccgagatccccacctcgcgcgatgtccggacgcggccgtgccccatgcaggacgggcaggggtcggagatcaccgttccgtgcccctcgcaccgctcgcagggcgcggaggtcatcatctggccgagcatcgtgcgcacgaccttctgccggaacccctggccgtggcagtccgggcaggtggtgggctgagaaccgttggcggtgcccgagcccccgcactgctggcacagaccgaaagtattgatcttgatgtgcgtggtgccgccgaagaccgccgtcttaagatcgatggtggcgctcgccagcgcgtcgcgacccggctgggtgcggggaacggggccctgcgagccgccgctgaacgctcctccgaagaactggccgaagatgtcggacatgtcacccatgccgaatcccgatgcgccgccgaatccgcccgcattggggtcgttggggtccacgccggaatcgtacatgcggcgcttgtcggggtcggagagcaccgcgtaggcgttgttcacttccttgaacttgtcttcgtattcggggccggcgatatcgggatgatacttgcggctcatcttgcgatacgcttttttgatctcatcgtcgctggccgacttgtcgacgcccagcacctcgtagtaatctgccactgctcgttctttcttgttggtgttcggggagctattgtgccataaggctcagtcagttgccgtcgccgtcatcgtacgacgatatcgcacgggtcaggtaccgggccacggcacgtacggcggctatggtcgcggcatagtccatgtgcgtcggtccgatggagccgacgaaggccaccggcccgctggattcgcccgacccgcccgacccgccgtcgagagatggcatcgcgacgctatcgccatcgtccattttgccgggctccgcgtcggcgtcatccgttatgcggagctccctcgccatgccggtctgagccgtattggcatgcgccgcgccgccaagcgcggatccaccgccgtcttcatgtcccgcgtccgattccgccggttccgtccgggatgccggcgagtttccgtagccgctggtgaccaccgaagcatgcagcaattccggcgtgtgcgtctccgaaccaatggctacaccgaccccataggcgtcggtgtcctccgaaagcgcgctcatgagtttcatcagcacgatctgctcctccagcgcgtcgaacagcggcgccatgtcggcgatgtcacgccgatgggccaggtgcgacgcgccggccatatacagttcactggacctttcgttgtctcccatcgcctcgaacacctgcgccagcccttcaagcagcgcaacggattcccgccgcgacgacttgagggaacggacccgttcggcagcctgcgcgaaggtgagcccgaggcaggctccgttcacgacggatcccacgtcggcgagcgtgatatccgtcggctggggcgacagggcgagcgtatgctgtgcgacgttgccggcgtcggtgatgaccacgatcagcagcaacgtggatgagacggggacgatctgcacgcgcagcaccttcgccttggccggggacggggaggcgaccacggccacctgaccggttatgtgggaaagcagtctggccgcgcgctgcaacgtgtcctgcaggctgacggatccggacaggaacgccgcgattcccttgcgctgcgcgtcggagagggggacgacggtggacaggcggtccacgaagtaccggtagcccttctccgtcgggatgcggcccgaggacgtgtggggctggatgagatacccctcttcctcgagggacgccatgtcgttgcggatggtcgccgagctgacgccgaggtcgtgcttcttcgtcagagcggccgatcctatcggctcctgggatcgaatgtaatcctccacgatggcgcgaagcaccaccatgcgtcgtggttgcgccatgtctcctcctgttcttccccggcattcacgccttcacggctttcccgtattcacgacacgcccgacactcccggagtgggtcggtcgaacgatgacgtacccagtattagcactctttgcccttgagtgctaacgcgttcgttatcagatgatttcatgacgcagccgccggcatgagtcagtcacaagttgtgagcgctaacataacataatctaccaaaacacgccaaaagcgaaccactaagtctgttcacaacgttagtatgggattgcaatgtgagggcatgcatggcgcggcataagccgaaatgcgtggtgcccgaagtattggaaggaaagtacatccatgaccgaattcaaggagaccgagctggacgagcgcgccatcaacatggccaaggtcctgtcggccgacgcggttgagaaggctggaagcggccaccccggttcccccgtctccctggcgcccgtcgcctacaccctctaccagcatttcatcaagcatgatccgaacgaccccaactgggaaggccgcgatcgcttcatcctttctggtggccacgcttcgctcacccagtacgtccagctgtacttctccggctacggcgtcactctggacgacctcaagcacttccgcggcggcgcggacacccgcaccccgggccaccccgagtacggtctgaccccaggcatcgaaatgaccaccggcccgctgggtcagggctttgcctccgccatcggcttcgcctacggcgaacgcttccagcgcggcctgctcgacccggagaccccgaaggaagagtccccgttctaccacaagatctgggccatctgcggtgaaggcgacatcgaggaaggcatctccggcgaagccgccgctcttgccgccaaccagaagctcggcaacatcaccgtaatcttcgatgccaaccgcatccagatcgaaggcgacaccaacctggtgctggccgaggacgtgctcaagcgcttccaggcctacggctggtacaccgacgaattcagcttcatccagcccgacggctcctacaaggaggacatcgagggtctggccgaggtcatcgccaaggccgagaaggccgcgcctgaccagccgaagctcatcaaggtccactccctgatcgcatggccgaccccgggcaagaccaacgacccgtcctcccatggctccaagctgggcgccgaagccgtcgccggcctcaagaagctgctcggttacgaccccgaagagtccttccacgttgacgaggaagccctcgcccacgcccgcaaggtcgcagagcgcggtctggaagcccacaaggaatgggacgagaagttcgacgcctggcgcaaggccaacccggacaaggccgccctgtacgaccgtctgaaggccggcgagctgccggaaggcttcgacaaggccctcgacgatcttgaggccaccttcgaggtcggcaagaaggtcgccacccgtggcgcctccggctccgtcctcaacgccatcgcggccgtcatgccggaactgtggggtggctccgccgacctcggcggctccaacaagaccgacctcaagggcgctgccaccttcgctcctgcggagtgcgccaccaagcagtggccggtctgcaacgagttcggacgtcagctgcacttcggcgtgcgcgagttcacgatgggctgcatcaccaacggcatcctgctgggctcccacacccgtccgttcggcggcaccttcttcatgttctccgactacgagcgctccgccgtccgtctggccgccctcatggagatcccgaacctgtacgtgtggacgcacgactccgtcgccgtcggtgaggacggcccgacccaccagccggtcgagcaccttgcctccttccgcgccatcccgcagcttgaggtcatccgcccggctgacgccttcgagaccgccgaggcctaccgctacttcttcgagaagaagaacacgctgcccggcgccatggtgctgacccgtcagggcgtcccggtgctcgccgagaccgccgccaaggccaaggacggcgtgcgcaagggcgcttacgtcctggtcgacaccgagggcaccccggacgtcatcctcatggcttccggctccgaggtccagtgggccgtcgacgccgcgaagaccctggccggtgagggcgtcaaggctcgcgtcgtgtccatgccgtccatggaatggttcgaggagcaggacgccgagtacaaggaagctgtgcttcccgcttccgtcaaggcccgcgtgtccgtcgaggccggcgtggcgatgccgtggtacaagtacctcggctcctacggcaagcccgtctccatcgaacagttcggtctgcagggcgatggcgcgcagaacatgatcgacctcggcatcaccgccgagcacgtggtcgaggccgccaaggcgtccatcgcggaagccgaagccgccaagtgatccatcgggagccgcccgccgaggcgaatacgcgtcgggcggctccctcccggtcggcacggccgacaagcccctcgcgggaggggcgccattgaagatttgttccattacggaatcaaaggagaaaacaatatgactgaagcaactcagcgcacgtccgacaacggcgtctcgatctggctggacgacctgtcccgcacccgtatcgagtccggctccctgcaggagctcatcaaggacaagaacgtcgtcggtgtgaccaccaacccgtccatcttccagaaggctctgagccaggtcggcccgtacgacgcccagctcaaggaactcggcaaggtcgacgtcgagaccgccgtgcgcgagctcaccaccaccgatgtgcgcaacgccaccgacatcttccgcgagatcgccgaggccaccgacttcgtcgacggccgtgtctccatcgaggtcgacccgcgtctggcccacgacaccgagaacaccgagaagcaggctgtcgagctgtgggagaaggtcaaccgcccgaacgcgatgatcaagatcccggcgaccctggaaggcctgccggccatcaccgccaccctcgccaagggcatctccgtcaacgtcaccctgatcttctcgctggagcgctacgagcaggtcatcgacgcctacatcgagggcatcgcccaggctgccgccaacggccacgacctgaagcacatcggctccgtcgcctccttcttcgtctcccgcgtggacaccgcggtcgacaagctgcttgaagccaacggctccgatgaggccaaggcccttgagggcaaggccgctgtcgccaacgcccgcctcgcctacgagctctttgagaagaagttcgccgccgatcctcgctgggctgacctggccgccaagggcgccaaggtccagcgtccgctgtgggcctccaccggcaccaagaacgccgcctactccgactgcaagtacgtcgacgagctcgttgccaagcacatcgtcaacacgatgcccgagaagaccctgaacgctctggccgatcacggcaacggcgctccgtccatcgagggcacctacgaggagtcccacgccgtcatcgacaagctggccgagctgggcatcaacctcaaggacgtcaccgacaagctggaggccgacggtgtcgccgccttcatcaagtcctgggattccgtgctggccgacgtgcagtccggcatcgaccgcgtgaacgcctgagaccgaccggtcaagcgtgacatacgcctgaccacataatcgtgagaagcccccgacccgataacggccgggggcttctcacgtgatacactgctagaccgcacacgaacgccatgtcgaaaccgggaaaggccgtgaatgacgccccttcgtgtatcatgccgaagggtatttctctcgccgcgaacatgcgccagcgcatcactcaagcagaaactacaaacagaaggaccgtcaaccacatgaacttgcatctggcagaggcaggacgcacgctgattccccgcaaggatgacgaatacgggctgctctcccccgccatggtgctgatgacgttcatcgccggtctggtcgatgcactgagctacttggccttgggacatgtgttcgtggcgaacgtcaccggcaacatcgtcttccttggcttcgcgctcgcccacgcacaggggttcgtctggtggacatcggcgctgacattggtgtgcttcgccttcggcgcgttcatcggaggccgcatcatacgccggttcggagaacaccgggcccgccatctgctgatctcgtcgatcgtgcaggccgcgttcatcctcgccgcgctgatcgggctgtacctgctgaaccactattccgcggaaccggctctgggcatgggcagtatgcgggcgtcatcgcagccgagcctcaacttccccaccgcccgccacatcgacgtccatcatctgatgctgatcgtgctgatcgcccccgcgatgggcatccagaactccactgcccggcggctcgcggtgcccgacctgccgacgaccgtgctgacgatgaccgtgaccggcatcgtcgccgacacatccgcccacggccatgagatgtcaaaactcggccggcgcgccgtcgccgtattggccatgtttctcggagcgctgacgggcgcggcgctacagtcgaaaggacatgaggacatcatcctcatggtcgctctggcttgtctgctggccgtgatcggcatgatgctcgcgcacgcgcattccacggcggcatgggcgaccgcccgccactgacctattccccaacgcacagcaatgtgttaaactgcgctgccatgggcttatcacgggtcgggccacccgacgcgggtggattcatgccgaccgccgggaaccgagtccgaaacaggtgccgagaagacaggtgccgagaagacaggcgccgagaagacaggcgccgagaagacaggcgccgagccgccgcaacagaaagcagtaccgttatggcaacgactcccataccaacagacatcaacaccgccgaatccggcggtcggcgccgtctcccgttctccggacgcctcgtcatggcgttcacgttcttctcgatgttcttcggtgcgggcaacctcatctttcccccgttcgttggggcgcaggcgggcgctgccaccgttcccgccatcatcgggttcatcgtctcggcggtcggccttccgattctcggcgtgctcgccgtcacgttcgcgggtggcttcgacgagctcgcccgccgtgtgtccccggcgttcgcctcgctgcttggcgtggcgatcatgctcaccatcggcccgtgcttcgccatcccacgcacggcgaccacgtcatacgagatgatggtggcgccattcctgccctcccgcactggatggggcggctggacgacgcagctggcgtactcactggtgttcttcgccgtggctttcctgctggcccagcatcccgagaaactgtcggccgtgttgggacggttcatggggccgctgctgttggcgttcatcgcagtgctgttcatagcctgcctggcgcatggtgcggtaacaccgacgcaaccgacaggcgattatgcggtgcatcaggcgtcccggggcttcctggacggctatcaaaccatggatctgctagctgctttgtacttcggcatcgtgatttcggcgaacgtccgcgccatgcatgtcaccgacaacacgcttattcgtcgggagaccgcgtacgccggtctcggcaccgggatcctgctgatcgtgatctatgcggtgctcggctatgtgggtgtcgtgtccgggagcattgcctcggtcaatccagcgaccgatacaggcgcgaccgtactcaccaatctcacggcctcgttgttcggcacgttcggcatggtatttttgggcatcgtgttcgtcatcgcctgtctgaatgtctgcacgggtctgatctgcacgtgcgccacatacttccacacgcgattcgccaccgtcgccggtcgccgcgtgagctatcgcgcatggcaggcactgttcaccgtgttcagtttcgtggtgtccaacgccggactcagcatgatcatcaaggtgtccgtgcccgtgctcgccgcattgtatccgattgccatcgtgttggtgacgctcgcattgacccatcgaatcctcgccgttcatttcccgcgcgtgtacttctggatggtactgctggtggccatcgtgtcattcgccacatgtctggcgagcatcgtcacggtattcggcggctccctgccatggctagaggccatattgaacatgctgccgctgcagcaatttcaactgggatggatcattccggcgctggcaggcttgctcatcggcgtgcttgacagtgctgcacattcgtcgttcaaacgatgaccgactgattcgagggctatcttcgtttcgaggggttgattgaggctcgctcagacatctaactgcgtttcgaggggttggtgcccgagtataaacaccatgggaaccgcatgattccaatgctgaacaccccgatatactccgggtaccgcattcaggcaaccccttgaaacgcagatagatgttccgggacgccggaatcaacccctcgaaatcgagataggagatggaacgggctaatgaggcgcgtaggacgactggggtggtcatcacaaactacgctacggcgtccgacactccttgaaggccgtgtcatcgtatcgccggataccttgggtcagattagagagctggtaggttccatcgtccgttttggcgagcaggacaatgatcttggtctccgcaccatatttcgcgatgaaatcgtccttggcgcccgctccttcgcatccaagattgacggtgaccgtgatatcactaccttccacagaccccttgagacgcgtccagatttcagcgtcatgtcatacagatcctgttggtcgccatcggcttgcttcatcctgtcaatcgtggcaacggtgactacatccgatgcagcgacggcatcgctgagattgccgtactgcacgccggcgtcacaggccacggaaacgacccgaccgccgcatccggcaaaaaccagtatcatggctaagaccgccagtattgccggaacccgcatcctcgtctgatgatatgaacgcatcgtcatcatgtctccttcgacatcaagccggtgctcgcccggtccgggcgctcccgcctccttcccatgacaccattgtacgaacatgccccccaatgagcattggcagccggcaatacggcggtcgccgccttcaccggttcttggcatcatccgcgatcctgccccgtgtcagcgaccggtaggtgacgtagaacaggatgcccgcgacgatgccggaagtcgcgtcggagataggctcggcgaggaagatgccggtcactccgatccagtgaggcagtgtcagggcgagcggcaccagcatgatgatcttgcggaagatcgccaggaacacggactgcttggcctgccccatgccgacaagggcgcactgcgcgcccatctggatgccgaacacgccccatccggcgacgaagaccggcatcatgcgggtcacgatgccgatgacttccggcgacgacgtgaaccatgcggcgaacacgcttgggaatgcggcaagaagcgacaccagcaccgtggccgaagtgatctgcgcgatgaatgccacgcggatggcctgccgcacgcgatccatgcgccgggcaccgaagttgaacccgatgatcggctggatgccctgctggaaaccgttggtcagcacactgaccacctgcatgagcgaggtgatgatggtcatcgacatgacatagtcgtcaccgccgtatcgttgcagcccgacgttgaacaccacgttgatgaggcattcggtgatctgcatgatgaacggcgccaacccgagggtcaggatcggcacgatgactcgattgaagcggatgttggacggcctcaaccggatggcgctgcgcccggaggcgaggaacaggatgatccacaccgatgagatcaactgggcgatcacgttcgcgacggccgcgccctttacgccccagccgagcacgaagatgaacaccgggtcaaggatgatgctggtgccggtgccgatcagcaccgaggtcatcgcgatggtggtcttgccctgcgcggagatgaagttgttgagtccgagcgtgagctgcacgaacaccgtgccgaccaggtagatggtgatgaagtcgaccgcatatccgatgttggcgtcgctggctccgaaagcgcgcagcaccggctccttcgtcgcctgcaggatgacggtgagcgtcagggcgatggccacgaggaacgccgcgctggtgcctaggatgcgttcggccttcttgaaattgccgcgacccagttcgatggacgccctcggcgcgccgcccgcgccgatcagcgacgcgaacgcggtgacggccagcaggatcgggaagcagatgccgacgccggtcatcgcggcgtcgccgacctcggggatatgcccgatgaatagtcggtcgatgatggtgtatgaggcgttcgccgcctgcgcgacgatggtcggaaccgacatcgtcagggcgagccgcgcgaccggtttcgtgccgagcccggagctgtccgccgtcatgccagcagatgccgttcgatccattgcgcgacgccgtcatcgttgttgggcgggcagatctcgtcggcgatcttgatgacctcggggttcgcgttggcgaccgccacgcccgtttccgatgtcgtcatcatgccgatgtcgataaggtcatcgccgaaactgacggtaccgtcgagccgcacgtccatgcgttcgcacagcgtcttcaacgcctgccgcttgttcgccagcggactcatcagcatccacatcgagccttcggagatcgccacgtcgaaatcgggcggaaccagcgtcttcagatgtgcccattgctccgacttggggaagataatgatcttgtcggcgataccgtcggggacgtcggtgaaatcggtgaattgccaagtctgtgtcttccagtacacgctcacgtcgaagttcgtgtagcgcacgtcatccatgacgacgccgaggctgaggccgggtatctcgtcgagcagataccggcacacctcgcaggcccgtgcggaggagaagccgaccttcagcagatgcccgtcggaggggagccgccccgagatgagcagatcgtaatcggaacgttcgggcgcgaaatcaatcagggcaccgttgagataaatgtacgcgtcgaccggcaacttacccgcgtactcgaagccggtgctcaccggccgggcggtcgccaccgcgaaccggtaaccggcatcgtgcatgcgtttgactgtgtcaatgctgcgctgcgtgataaaccgctcctcgaaggtgggggcgtcatgcagcagtgtgccgtcgaggtcggtgacgatgagtcgctgttcagggttggtcatggcgtttctccgtaaagcctgtcagggggaaaaagaatcgtgccggtctgcggctacagcagcccttcgcagtaggagcggaccagctccgcggaatgatgcagcttggcgagctcgtcgtcggcaagttccagctcgacaatctcgttggcgccgttggcacgcagctcggtcggcacgccgaggaacacgtcgcgttcgccgtattcgccgtcgagcagggtcgataccggcacgatgcggcgttcgtcccaaaggatggtctgcacgatgccggccaccgtcgaggcgatgccgaagttcgtgccgcccttcgccgcgacaatctcgttgcctcgcgtacgggtcttctcttcgatctcatgcgtggagacggatgagaatcggtcggcgttgtcgctcaggaatcgcgcgaacggcttgccgccgagcgagacggtcgaccatgcggtgaactgcgaatcgccgtgctcgcccatcacgaaaccgccgacgttgcgcgggtccagcccggtctcctcaccgatgatggtcttgagacgcgaggtgtccagcgcggttcccgtgcccagcacctgggtgcgcggcaggccggagcgtttccacgcgtaccatgccatgacgtcgaccgggttggagaccatgacgatgacgccgttgaacccggatgccatgacccggtcgaccacgtcgccgacgagtccgatggtgaagccgagttcgtcgagtcgggttgagttggccggtggcttgcgtccgacggtgatgacgacgatgtcggcgtccttgcagtcaccgtagtcaccgttgcgcaccttgacgtgccggtcctggaattcgctgccgtcatcgagatcatggctttcgccgagcgccttgccggcggaatgatcgatgagtacgagctcgttgcacagaccatgggtgacgatggcgaacgccgcggtggatccaacctgcccggtgccgacgatgacgactttgttcctgttcatggtgaccatgtcagatgctcctcaaacgatatccgataaacgttgcccaatgaaatgagccatgatcaagtgaccatggctcaacgtgctgcatacagtgcttcagcgaatcgcgctcacaccaagttgaattttgtcatcagaccgagggcgatgatgatggcgacccagaccagtgcgatgaagatggtccagcggttcaggttcttctccgcgacaccagacgtgccggcgttctgggtcaggccaccgccgaacatatcggacagaccgccgcccttgcccttgtgcatgaggatgagcagcgtcagcaggatggacgcgatgacgacgatgatctcaagaacgatcttcagaatatgcacggggaaacctccattaaatgtactgtgtcatagcatagcgcagggcattgaaaaacgtgcggatatgcgcatgtttccctatcgacgtgtcgccttgagtgtcaaccgggcgatcttcgccaattcgtcggggtcgagcgacgcgccgccgatcaggaatccgtcgacatccggctcgccgatcagatgcgtcgcgttcttggacgacaccgatccgccgtataggatgcgcacagtatcggcgacggcggggccgaacatctcgccgaggtcgtcgcggatggctttggcggcctgctgggcggtgtccggagtggcgaccatgccggtgccgatcgcccagaccggctcgtacgcgatgatgagcttcgcggcctccttgtcggaaaggtcacgggtcacgtcatgcacctgtccgacggcaaagtcgagctcgatgccctgacggcgttcctcgaagctttctccgacgcacagtatcggctgcatgccggccgccaatacggcacgcacctgatcgacgatgttgacgtcgtcttcgggatggtacttgcggcgttcggaatgcccgacgatgacgtacgagcaaccgagatgcgcgatcatgtcagcggagacatcgccggtgaacgcaccctgtgtggtcaccgacacggcctgcgcaccgtagcggatcttgagcttgtcggcttcgaccagcacctggacgctgcgcagcgacgtgaacgacggcatcagggctatttcgcagcgggagtagtcgaagcgtgcgtcacgaagcagccatacgagtttctgcacgaaatacgtggcctcaagatggtcgaggttcatcttccaattgcccgcgagcagcgggatgcgtgacgccattgatgtcctttccgtatggagcggctccccggcgtcaagcgcccggggagccgaattgcgggtgaagatcagtcgaggaccttcagccccggcagctccttgccctcaaggaactcaagggaggcgccgccaccggtggagatgtgcgagaagccgtcctccgggaagccgaggttgcgcacggcggaggcggagtcgccaccaccgacgatggtgaatgcgccggccgcggtcgcgtcgacgaggccctgcgccacggccttggtgccggcggcgaactcgggaacctcaaacacgcccatcgggccgttccacacgacggtcttggagtcgacgatcttgtcgtggaagagcttctgggaatccgggccgatgtccaggcccatcttgtcggccgggatggcatcggcggcaacgacctccggggcgaccggggtgtcaccggccgggaagccggcgttgacgaccacgtcggtcggcagcacgagctcaacgccgttcttctcggcggtagcgatgtagcccttgaccttgtcgagctggtcctcttcgagcagggaggtgccgacctcgtagcccttggccttgaggaaggtgaacaccatgccgccgccgatgaccaggcggttggccttgtcgagcaggttctcgatcacgccgagcttgtcggagaccttggagccgccgagcacgacggtgaacgggcgctccgggttctcggtggccttggacagggccttgacttccttctcaaccagcttgcccgcggcggccggcagatcggcggccacatcgtagtcggagccctgggcgcgatggaccacgccgaagccgtcggagacgaagacctcgccgagggcggcgatcttcttggcgtacggggcgcgcacggtgggatccttgctggtctcctccgggttgaagcgaacgttctccagcagcaccacgtcgccgtcgttcatcgcggcgaccttggcctgggcatcctcgccgtaggtgtccttggccagcgggacctcgacgccgagcagctcgcccagacgcttggcgaccggggccagagacagctcagggacgaccttgcccttcggacggccgaggtgggccatcaggatgaccttggcgccttcttcgcgaagcgccgtgatagtcggcagcgcggccttgatacggccatcatcggtaatcgtggtgccgtccagcgggacgttgaaatcggcgcgcatcagaacgcgcttgcccttgagatctccgagatccttgagtgtcttcatgtgtatcctttcctatccgcatatgcgaggaatggccggttttagccaattcgaatattacaagcggcacggaacaaaacaccgcgtccatagcgaacatggacgcggtgcatgacgggatttgattccggcgcttttcaggagcagagggacgccgtcagcgtccgacggacgcgccggactgttcccggtcgcgggtcttcgcggtcttgtcggcgagctgcagcagacggcggatgcggcctgcgatggcatccttggtgatgggcgggtcggcgagacgtccgagttcctcaaggctcgcatccccgtgctcaaggcgcagctggcccgcggcacgaaggttttcggggatgtcgtcgccgagaatctcgaatgcgcggcgcactttctcgctggcttcggcagcggccttcgcgctgcggcgcatgttggcatcgtcgaagttcgccagacggttcgccttgccccgcgcctcgccgtcggtgcgcttgcctgtccactcccttgcggagtgcggggcgcccatgaggatgagcatgcgctcgatggcgtcggggtccttgagcgtgatacgctccgaactgcgcagctgtcggggcttcgccgtgatgccgagcctgcgtgcggcgcccgaaagcgcgagggcggcctcgttcgacgggcagatgatttcaaggaagccggctttgcccgggtcggaaagagcgccatgagccaggaaggctccacgccatgcggccttcacctgagcgatgttgccgctgatgatatccgcgggaagtccacgcaccagacgcttgcgccgatcgaggaggccggtctgcaatgccaacgctgcaccgccgcgctccacgtggatcatgtatcgctgcaccgtggcgccgttgggcgtcgagcgagaaacctgggtcatgaccgcctcatgcccatacagatccctgatggtgtcctgaagccactgggcggccttgagcgagtcaaactgcgcttgaacgatgatctggcgctgtaccagccgcagcccgccgccgaaacgaatcatagcggtcgcctgcgcctttttcgccgtaggcaattcgttatcgattgcggccagctcgcttttgacatcatccagaagagccaagagccaacctcctatgtcctgtttcttctcaatgtttccccggcctgctgggttctgctccctgcactgccaccggcttactgtgatacctaatcacttggacaagaatacgcgatgctgccggattatggaaacgaaatgtttgcatagtggctgcacggtctcgctatgcgcgcgcccggtgcagctcgcgggccgatacggtgacggatatgccgtgcgcgcgcagccgcctcgcaagttcctcgctcatggcgacggaacgatgctgcccgcccgtgcatccgatggcgatggtcacgaaatgcttgtcctcgtgagcgtagccttccaacgccacgaggatggcccgctcgtatgcgtccaggaaatcgcccgcacccggacttgacagcacgtaatcgctgacgggcttgtcttgcccgttgagctctcgcagcgtcggcacccagaatgggttcggcaggaaccgcacgtccgccacgaaatcggcgtccatcggcagcccgtatttgaatccgaagctgaagatgtgcacggccaccgtggacgggccggagccgagcatcgcctcgtatagtttggtcgacagctggtggatgctcagcgaggacgtgtcgatgaccatgtcggcccgttccttgaggttgtccagcaggctgcgctcctcaaggatgccgtcgatcagacggtttccacgctgcaggggatggggcctgcgcaccgactcgtaccgcttgatgagcacttcgtcgctggcgtcaaggaacaggatgcgggtgcgcacccccaggtcgtcgagatggctgagcacggctgacaggtcgtcgaaatactcgcgcgaacgcacgtcgatgacggccgcgagcttgtgcacgccgtccttgccggcattggtcatcatgtcgaccagcgggaccagtagtttcggtggcagattgtcgacgacgtaccatcccatgtcctccacgcagtcggcggcatgggagcgaccggcgccggacatgcccgtgatgagcaggacctcgaagtcgtccgcgggctccggcctgttcccgcccgccggcggcacaggcgcgccggccgggctcatggttgcgtgatcgttcattacagtgcctcctcaagggcatgtcgcatcgcgggttccagcacatccatcagggagctgtcggccgtgtccgcgccggtcatgaggatgacctgcaggatggcctgccacagcagcatctcctcgccgccgatcgccagccctcccttggccctccatgcgcggatcaatgcgctggggcgggggtcgtagaccacgtcgagcaggatgccacgcggccggaaggagtcgtcgttcccgatggcttcggcgaccgcgtcggcggcgtggccgggaatcgtgctgatgacgatgtccgcgtcccgcagggtgtcggccgacgcgtcgatcgtcttctcctcgtatgcgatggcgtcgccctcgccgatgatgtccggcagctgccggttcttgcccgggtggcgcgccgccacagtgatgcgtttgttcgtctgcccgttcttcagcatgaccgtgcatgcggcgacggccgaggccgcggtgttgccgttgccgatgacggcggcggaggttgcgctcttccaacggtcaggctccccgagggccttgagctcatggtcgaaggcgagcacgatgcccatgacgtcggtgttgtagaggcggatcgccggcagcgagcccgttgcggaggcgccgtcgggggtggcaccgggggtgatgccaggttcggcgggccagtcgaaaatcgcggtattggcgactttgagacgctgcgcccacatattggacggagtgccatagggctgaatggttttcttgagcggcatggtcaggctcagaccgcgccaggtcggatcaagccctttgagaaatccgtcgagatcgctttcgccgacctcgtgccgctcgtacgcccagtcatccagcccgagcgccttgtatgcggcattgtgcagcaccggcgacaacgaatgggctatcggcttgccgagcacggcgcaacgatgtgcaatcacggtcatacccctccttgctcactgcctatatcattcactgccaccatcgtaccgtaaatgttcttaacaaaatcgtcatagaccaatgaattccgctggcgggatatggacttcacgccccagcggggacggagtccatggcaccccgctgacggggcggagtccatagaccgccagcgggggcgaacgaggtgtgcggttattcggtgtgaagggcggtgtggatggcttcggctttggcatggcctatacccttgaccgcttcgagttcctcgacgctggcgtcacgcatcgcacgcactgaaccgaagtggctcagcaggcgcttctggtaggtctcacccacgccgggaatgccatccagcgcggagcgcaacgcgcctttgcgtcgcgtctgacgatgataggtgatggcgaagcggtgcgactcgtcacgcacccgctgcagcaggtacatgccttcggactggcgtttgaggatgatcgggtattcgtcgtccggcacccagacctcttcgagtcgcttcgccagaccgcagacggccacatcgttcacgccgcaatcggccagagccttcgccgcggccatgacctgcggatggccgccgtcgacgacgaccagattcgggatgtaggcgaaatgatgccggttcgtgttctgctggacgactcccgcgtcccgtatgccgtcaggagacgatgccgtcgtcgtggatgcggatgtatcggacgattcggcacggcgctcgttgtccatgctgtcgccggagtcgccggcgatgttgccgtgtctgaaccgtcgcgtcagcgtctcgtaaagggcgctcagatcgtcgagcgcacccttgccgtcatcaccgcgaatggcgaatctgcggtattcggatttcttggcgatggcgtcctcgaacacgaccatcgaggcgacctggaacgccccgcccacggtgttcgaaatgtcgtagcattctatgcgcagcggtgcctgagcgagcccgagtgccttcgcgacgtcgttcatggccgcggtgcgcgtgcccatgtcgctgatgcggctcatcttgctgcgttgcagcgcctgcccggcgttctcgttcgcccggttcatcagcgccttcttctcgccgcggcttgccacgcggatggtgaccacggcgccacgcagcccgctcaaccatgattcgagttctgcacggcgtgccggctcgaccggcacgatgacctcgcgcggcactggggcgattggcgccagcaggtccgcgcgaccggtctgttcctgccgttcgcgtctcgtgcgtgtcgcctgcgcgcgctcgacgctgctcttggccgtcaccgtctgcgtgctgccgatggcgtcgcgtctctccacgatggaggctcccccttcggccgtcggcacgccctcgttcccggaggacgaggccatggaaggggccgttccatcatgaggatcgacgttcaatccgttgtcggcggccacgtctgaatacacctgcatgatcaggtcgtcgatgagttcgccgtcggatacgtcctcgacgcgttcgacgctccagttgcgttctccgcgaatcgagccgtcacgcacgatgaaggcgtgcacggacgcctcaagctcgtcggatgccatgccgaacacgtcggcgtccacgtcctgatcgaatacgaccgcgttctgctgcatgacggtctgcagcatctggatttcgtcgcgcagccgcgcggccttctcgaattcgagttcggcgctggcgtccttcatgtcccgcgtcagctgggcgatgtagctcttgccgagccgaccggtcatcacgccgaccagctgctcgcacatgcgccggtgctccttgggcgcgattctcccgatgcatggcgccgagcatttgccaatcgacgcgagcaggcatggtcgcccggtgagttcggccttgtggaacacgttggtcgtgcaggtacgcaccgggaatgtgcgcagcagtttgtccaacgattgtctcagctcccacaccttcgcgtaggggccgaagtagcgggcgtcccttctcttgcggctgcgggtgacccatacgcggggcacggcctcccccgacgatatcgccagatacgggtaggtcttgtcgtcgcggaactgcacgttgaaacggggatcgaactccttgatccacgtgtattcgagagtgagcgcctccagttcggtgccgacgaccgtccattcgaggctacgtgcggtgagcaccatcgtctgcgtgcgcggatgcagcagatacagcggctggaagtagttggccaaccggttgcgcaggcttttcgccttgccgacgtagatcacgcgtccttcgccgtcccgccatttgtagactccgggctgggcggggatatctccggtcttcggccggaacaggtcgcgcgtgtcccccagcagcggagccccgttcctgttcactttggcgaccgcatccgaagcgtccgcctccccgcgcagcgaatcggccgcttttctccacacttcgggtgaatgccgctcgatatcgttcgtcacagcatgtccttgaggaacttgcccgtccaggacgcttcgcattgcgccacctgttcgggtgtgccctgcgtgacaatcgtgccgccgccgtcgcctccttccggacccaaatcgatgatccagtcggcggacttgaccacgtcgagattgtgctcgatgacgatcacggtattgcctttgtctaccagcccctgcagcacgagcagcagtttgcgcacgtcctcgaagtgcaggcccgtggtcggttcgtcgaggatatacactgtcttgccggtggacctgcgctgcagctcggtggcgagcttgacgcgctgcgactctccgccggacagcgtgggcgcgggctgcccgaggcgaatataccccagtccgacctgcacgagcgtgtcgaggtagcgggagatcgacgggtaagccttgaagaacgtggcggcctcctcgatcggcatatcaagcacgtcggcgacggtcttgccgttgtatttgacctccagggtttcgcggttgtaccgcttgccgtggcattcctcgcattcgacgtacacgtcgggcaggaagttcatctcgatcttgagcgtgccgtcgccgtggcacgcctcgcagcggccgcccttgacgttgaacgagaaccgccccggaccgtaaccgcgcacctgcgcctccggcgtcttagcgaacagcgtgcggatcttgtcccacacgccggtgtatgtggccgggttcgagcgcggagtgcgcccgatcgggttctggtcgacgtggatgaccttgtcgcactggtcaaggccctcgacgcgcgtgtgcttgcccggcacgatgcgcgcgccgttgagcttgtcggcgagcaccgggtagaggatcgtgttcaccagggtcgatttgccggagccggagacgccggtgaccacagtcatcacgccaagggggaaatcgacggtgatgttcttcagattgttctcccttgcccccaccacgcgaaggcgcttcgtggcatgcggcttgcgccgcacggccggcacttcgatgctccgtcggccggcgatgtaatcgccggtgacggaccggggcgcctcgatgagacgcttcgccggaccggagtaaatcacctcgccgccgtgctcgccggcaccgggtccgatgtcgaccacccaatccgccctctcgatggtttcctggtcgtgttcgacgacaatcagcgtgttgccgaggtcgcgcagatggtgcagcgtctcgatgagacgcgcgttgtcacgctggtgcagtccgatcgatggctcgtcgagcacgtacatgacgccgaccagtccggagccgatctgcgtggcaagcctgatgcgctgggcctcgccgccggacagcgtcttggccgcgcgcgacagcgtcaggtagttcaggccgacatcgttgaggaatcccagccgggcccggatctccttgaccacttcgccggcgatcgtcgccgccgctccctccagtttcagcccattgatccacgctagcccgcgttcgacgggcatgtcgcatacatcggcgatggattcgccgtctacggtgaccgccaacacttcggggcgcagcctcctgccattgcacgcctggcagggaacctcgcgcatgtacgactcgtagtactgcttcatctggtccgagtcggtctcgtgataccggcgcatcagcgtgcgcacgacaccctcgaatccggtcgaatactcgcgcagccgcccccaccggttgcggtatgagacgttgaccttgaaatcatgcccgtacaggatcgaatgccgcacgtcctcaggcaaatcacgccatggggtgtccatggagaacccgagttcgtcggccaggccctgcagcacatgcccgtagtattcggtcgtggtcttgccgcctccccacggctcgatcacgccgtcggacagcgacttggaatcatcggcgatgaccagatcggggtcgatctccagcttgtagccgatgccatcgcacacagggcaggccccgtatggcgcattgaacgagaacgtgcggggctcgatctcgtccaactgcagctgatgcccgttcggacaggccctgtgctccgagaacggctgacgccgattcgggtccttctcgtccaagtccacgaaatcggcgacgatgacacctttggacaaccgcagcgcggtctcgatcgaatcagtaagccgctgtcggatgccgtcgcggatcatcagacgatccaccacgacctcgatggtgtgctttttctgcttggtgagcttgatgtcgtcggacagctggcgcccctcaccgtcgatcagcgcgcgggcatagccgtcgccgcgcagcagctccagaagatcggcgaactcccccttgcggccgcgtacaacgggcgcgagaatctggaatctcgtgcgttccgggttcttcagcagcgtgtccaccatctgctgaggggtctgcgcgctgaccagctcgccgcattcggggcaatgcggtacgcctgtgcgggcgaacagcagtcgcagatagtcataaatctcggtgatcgtgcccacggtcgaacgcggattgcggtttgtggtcttctggtcgatcgacaccgcagggctcaatccctcgatgaaatccacatccggcttgtccatttgcccgaggaactgacgcgcatacgcggacaacgactccacataccggcgctgcccctccgcgaacagcgtatcgaacgcgagcgatgacttgccggagccggacagtccggtgaacacgaccatcctgttgcgcggcacggcgagatctacgttcttcagattgtgttcacgcgcaccctggatggtgatcttcagatcgttcgggatatgtgagatgtccgccaccaatgaggagtcggtcttgcgcatcggtgccttgcggatctcgcgcgacaggaacgtgtcgctgctcatcacacgttcgatcacgacgtccccgccgcccgatttcgacgtcttgcgtccagtcacaaccccgcctttcctcgcacatcccatcatcaacggtagatcatgctcaacaatacccgacttcaagacaaatgtcgaacatcagttcgatagcgtgtcccatattcaaacacatggaccatacaccgtccgatccgcgacgcccccgaatacgcaaaagccggacggccatcagaccatccggctttgcacggcgaaaccgcatcacggccgttccgcgaccgtcacacgatcatgcacacgccctcacacccgctgctgcagccagccgacgagcagaacaatcacctgagcaagcaggccgagcagcgcgaagaagccaatccacgcaatcgcggtggcggcaccgtccgagtaaccgtagccgtaatatccggaattgccggagaacaggtagatgagccacgcgagcaccctcaggccggcggccgcgaccatggcgacgaacgcggccatcttgaaccactgcggtccgtgctgcacgacgttgagacctatgacccacaccgccaggattgcggtgagcatgagccacggagtcgagccgaagaggaacttgtagccgaatccgctcatgttgttgccggcatcgacaagtctgaggaacgacaggaacgtctcgatgccgatgaacacgaccatgagaatggcggagatcttggtgaccgcgcgcacgttcatcgtgtcgaggaagctcggcccctgcggctggggagcgtagccgggctgctgcgggtagccgggctgctgcgggtacccctgcggatactggtatccggcgggctgctgcggagcctgaggagcctgaggagcaccataaggcgcctgatacgcgggctgctgcggggcttgcggctgctgcgggccgggctgctgcggatatgtcatggctaacttctttctgtgtcagtccaatatgatggtttcaatataccgccatttcatgtccggctgacgaaatactccacatatttgacgggtactcgttgtgcgatgccacaatattcgctgcaagacgacgcacgaatccggcacgcgccgtcatctattcgctgcgcagcgcccagtgcccgtcgcaagccgatttcgtctcgtcgttccatgaccgtgacgatcatcatgttggcgatgctcataccgcccacgatcagcgctatcacgccgatcatcaggcccagcgtcgtcagcgagtcgtccgcggtgtttctcgcctgtgacaggtcagccgacgcggtgacgtacacgccggagccgccgatgttcgccgcgtgggcgaggatacggcgaatcctttcgtcgttgcctgatttcgtgcgcacgcagatcgcactaatccggcgtatcatctcctcctagtccgagtattgcgagaacgcccattcgtcgccgacgatgacagagcctttgccaggcttgtcactccttccggtacgtgcgggatccttgaccaaggtgaatcccttggcgcgacattccctcacatagcacaacgccgcatgtcagcccccccatcaaccgtttaccactcataagcgttttctttccagtaagagatccgttgaacaagccggatgggcgaccatgcccatcttcatactccgatggcggaatacgataccattcattgcatgccgaccatggttcctatacaactttcatcgtatcctcttaataacgtttgagtgttccatgaccagccgccggatgctcactcagctctgaaaaccgcgacaataatggaaacggattggttctcacgcaacctacgtatccgaggaggttcccatgcgcatactgatcgtcgaagatgaccgtgacctcgccgccgcgctggacgacgcgctgcggttcgaagggtatgcgacccgcgtcgcatacaacgggctggaagcggtgcgcatgctcgccgagcaatccatcgacatcgtgctgctcgaccgcgacctgccgatcatgtccggcgacgcggtgatggagacgatcgcctcgaacgacatccccgtgtccgtgctgatgctcaccgcggcagcgcaggtcagggaccgcatcaacggtctcgaactcggcgccgacgactacctgatcaagccgttcgcccatcccgagctactcgcgcgcatacgggcgctgcaacgccgtgccggcaagggcgacttctccggcaccgaattctcacacaacggcatcgtcctcgacacggtccgccacaccgtgacccgtgacggcaagcccgtcaacctgtcgccgaaggaatacggcgtgctgctggagatcatgaaggcggacggcagctacgtcaacgccgaggaactgttcgacaccgtgtgggcgggcgcatcagccaccgacctcacggacgccatcaaaaccaccgtatactcgctgcgacgcaaactcggcgagggcaacggcatcacctccaccagaggaaaggggtaccgtctgtcatgaccgcatcacacgcagcagacgccgcaacagactcagacgcaacctcggaggcggccccggtcaccgacacggccgcggccattgccgccgccaaagacaccgccggcggcaatggccatacacgccgtcgccgccgattcccctggccgtcgacgttccgaggccggctcatcgccaccatatccatcgccgccctggcgatgctggccaccgtcatcatcacgcagaacatcatcgtctcacaggcggcacggcagcagaagaacaacatcgtcatgtgcaccgacaaggacaccggcgaactgatcacggtgtacttcgacaagaaccagaccagctacgacctcgatctggaggatgcgccggacgccgtcggcagctccgccaccgccgtctgctccccgatgctctcggtacaggaggataccgtcgagacctccgacccggagtccaccgtcaccaagatcgaggtgacgcatatcggcaagacggcgagcgccatgaccgactccttcatcacgatgatgcagttcatctccatcggcacgttcatcattttcgccgtgctctcgctcatcgtgtcctggctcgtcggctctcgcctgtccaaacgcgtggccaagatcagcaagcaggtggaggcgttgaagcccggcgatctcgacgctcgcatcgcccccgacggcagcgatgacgagatcggcaagctcatcgaatccatcaacggcatgctcggccgactgcagaacgccacggaagcggagcgtcggttcgtgtcgaacgcctcccacgagctgcgaacacccatcgccgccgtcgcgaccaatctggacgccccactgtcccaaggccgtttcccggccgacgtggagcctgccatcaggcgggcgctcgccgcgaaccgtcgcggcagcgacctcgtgcaggcactgctcacgctctcgcgcatccagagcggcgtcatcgatgccgaggacgtcaccgccctgcagctcgccgatttcatcgacgacgagctggccgaggtggaggagcaggccgataagcgcaacatcctcgtcaccacgcgcgatgtcgcaggcgacgtgcaggtccaggccagcaaatcgctgatggacttggccatcggcaacctgctgcgtaacgccatcatgcacaacatcagctcgggcacactcgacatcgccgcgaggcaggagcactgcgccatcatcgtgaccatcaccaacagcaccgacgaaacgctgccggacgatctgatgaatctgaagcagccgttccaccgcggcgaacactcacgcatcagcgccgagcccggcgtcggcctaggcctgtcgatcgccgacgccgcatgcgaggccatgggcgcgacgctggaattggacaggccggacgagcaatcgttccgcgccaccatcaccatcgcgtcggcatagattgatactgcggcaacggcccgtccagctacttcgcgtactcctcaagcgtctggccggactcatgcatcgccttcgccgcctcggctcccacataccggtaatgccatgattcatacgcgttgccggtcacgtcggtcttccctcgcggatagcgcaggatgaatccgtaccgccacgcgttgtctgcaagccactggtgctcgttgacgctgtccttggtgccggtggccccgctcgcgttgatgtccaccgccaggcccagctcgtgctcgctggtccccggctcggccacccattgcgacgcctgtcttctcgcctcctccttcgacgcgccctcgttctgatacaggaatatcttctcgtccagcagctgccgctgcacggcctccgtacggtacgccgacgtgacctccgggtgaagccccgcggcacgcatgtcatcgaacatgcgctgcagatcgggatagatgcgcgaatccacgctctcgccgttgctgagcctggtcagtttcggtgccggatagtcgtcgggaatcctgttccaccggttgacgacaatcagactccagctcgacggagagtatttcgcctgtgcggcgccgggcgcaaacggtccccggcccgcgaaacgccccaggcagaacagcagcgccagtatggcggcaagcaggacgcccagcacgaccgacacgcgcagcagcgtcctgcggttccttctgttccggcactcggcgaacgtccgaacgcgcccgtctcccgtcatcatccgttccatgcctgtcgctccttcactggtctgccgtcatcgcaacatcaccataaacattaggattcgtaaggtttcccggccatcgaccacggggacgaaacggcttatgatccgcggggatgacaaccccgagacacccctgagtcagtaccctgaccgccagtcggcacgtgttcgctatgatggacggttggacttcaacgaatacggacaacaacagaaagacgagcgggacacatggctattgaggcgcagggacttgagattcagatcggcgcgcgcaccttgctccatcccaccgatttccacgtcgccaaaggcgacaagatcggtctggtcggtcgcaacggtgccggcaaaaccacactcacccgcgtcatcaccggcgacatgctccccaccagcggcaaggtgcgcgtatccggcaagctcggctacctcccccaggacacgcatgccgccgaccaggagcagaccgcgctcgaccgcatgatgagcgcccgcgacatcgcctccatcatcagccgcatccgcaaagccgaaaaagacatgaccaacccggacccggacatcatgaccaaagccatgaaccggtacgacaaagccatgcaggacttcgacaaggccggcggctatgccgcacaatccgaggccatcgccatggccgacagcctcggcctcccccaggacgtcatgcagcgtcccctcggcaccctctccggtggccaacgccgccgcatcgaactcgcccgcatccttttctccgatgccgacaccctcattctcgacgagcccaccaaccacttggacgccgactccatcgaatggctgcgcggattcctcaagaaatacgaaggcggattcctcgtcatctcccactccaccgagctgctcgacgaagtcgtcaacaaggtctggcatctcgacgcgcagaccggccagatcgacatgtactccctcggctggaaagcctacctccaccagcgcgtcgtcgacgaggagcgtcgtcgccgcgaacgcgaggtcgccgagaaaaaagccgaccggctcatgaagcagggcatccgcctgcacgccaaagccaccaaggccgtcgccgcccagaacatgatgcgccgcgccgaacggctcctgtccgagacctccgacgcccagaagcaggacaaggtcgccgacatccgcttccccgaaccggcaccctgcggccgcacccccatcatggccaaggacatctccaaggcatacggctccaacatcgtcttcgccggcgtcaacctcgccgtcgacaaaggctcccgcgtcgtcatcctcggctacaacggcgccggaaaaaccaccaccctgcgcctgctcgcccacatcgaagaccccgacaccggcgtcgtcgaatacggccacggctgcaagatcggctacttcgcccaagagcacgacaccctcgatctcaacgccaccgtgcttgagaacctcacccacgtcgcccctgagctcaacgacactcaggctcgttccatcctcggctccttcctcttctccggcgacgacgccttcaaacccgcccgggtcctctccggcggcgaaaagacccgtctcgccctcgccacgctcgtcacctcccgcgccaacgtcctcctcctcgacgagcccaccaacaacctcgaccccgcctcccgcgacgaaatcctcaaggccatcgccaaatacgaaggcgccatcgtcctcgtcacccacgacgagggcgcagtccaggccctgaaccccgaacgcgtcctgctgatgcccgacggggacgaggatctgtggaacgattcatatctcgacctcgttgccgaggagtgatggagtgtcggctgcgttgttcctcagtcgcggtaccctcgtaccgcttccttcggtacgccttgccgacacacgcatcacttcacggcaatccactgaacgaacaccacacatatcgggcctgtccgtacccttttgcgtgcttaagtgcgcgccggaacgacgaccgtgcgcacttaagcacgcaaaccaccggttttgcgttcctatgttcgcgcactcgtcgttccgacgcgcacttaagcacgcaaacgcgacttgacccatgaccttgccaacgttccggcgaatatcaacggcaaaaaacgaatgatgcccggtggttcctgaatctcaggagccaccgggcatcattcgtaagacggccagacgatcaaatcacgccgatcggccgatcgcacgggccgatgtcactcggcgtcgcggtaaccgctcgggttcttggtctgccaattcatcgacgacgcagccatgtcgtcgatgccgagctcggccttccagccgagttcacgctcggccttggaggagtcggcgtagcaggcggcgatgtcgccggggcgacgcggcttgatcgcgaacggaatcgcgtggccggcagccttctcgtacgccttgatgacctcaagtaccgagtatccgtgaccggtacccaggttgtaggtgaacacgccggggccctcgaccttgtcgatgacggcgacgtggcccttggccagatcgacaacgtggatgtagtcgcgcacgccggttccgtcgggcgtgtcgtagtcgtcaccgaacacctgaacctccttgagctcgccgagtgcaaccttggcgatgtagggggtcaggtttgccgggatgcccttcggatcctcgccgatcaggccggactcgtgggcgccgaccgggttgaagtagcgcaggatgacgacggtccaggagtcgtcggcgacgtgcacgtcgcgcaggatctgctcctcgaagaatttggtcgtgccgtacgggttcgtggtgccgccgatctggctctcctcagtcagcggcagctccttgggcgtgccatagacggtggcggacgacgagaagatgaccttcttgacgtcgtgggcgcgcatggccttgagcagcacgatggtgctgttgaggttgttgtcgtagtattcgatcggcttggcgaccgactcgccgacggacttgagcgaggcgaaatgaatcacccagtcgatgtcgttctcggtgaagatgcggtccatcagcgcctcatcgcggacatcgccctcgtagcgcttgacggtcttgccggtgatctcctcgacgcgatcgagcgccttgggcgacgagttgctgtagttgtccacgcagacaacgtcgtaccccttgttcagcagctcgacatcggtgtgcgtaccgatgtagcccgcgccgcccgttaccagaatggtagtcatgtgttcctccttgaaaaacagctgtggatgactccaacagtcattctaatgctgagtatggaatccgaggccttccatgaagtcccgggtgagttccttgtgcttgaacacggccgtgttgcccaggatgcgctcgcatacgctgccgagttcgtcctgcaccgcggcgtggatggcgtcgcggtcgcgctcgccgttcagtgtcgcggtgagttcgtcccattcgagcgtgaactcgccgacctcttccggcagcggcttgccctcggcgagggcgtcctcgatcaggccaagctggttgatgagacggccgggcaggatgaacagcccctgcgcctcgatcaggccgatgggctcctgcttgaccggccagaactcgggatgcgcgtggaagatgccttccggcagctcctcgctgaccgagttgttgcggaagatcaggctcatttcgtagccgcgctcggtgatgatcgcgctgggcgacaccgcggagcgcttgccgtcctcgccttcgcagatgatgtccagctcggggttggagtagttgatccagccttcgcggatcttgtcgcacacctcgatgatcgtgtcgcgcgatttggcgaccacgcgcacggcggtgccgggccagtcgaggatctcgatggtcgcgtccgggtattccggcagcgtcatcgtcgcccaggcggacgccttgtgcatcggcagcagttcgccgccgccctggtaatggtcgtgggcgagcacggagccgccgatgcgcggcagcgcggcgttgcacccgaggaagtatccggggaaccggtcgacgaagtcaagcaggtgcccgaacgtggagcggctcacgtgcatgggcgtgtgctcgtcgttcacgcagatgccgtgctggtagaagtacccgtacggggagaactgccagaaccacggttcgtcgccgagtgtggcggggatggtgcgcagcgtgcgcttgttgcgccccgcgaagccctcgttctcatggcagatcgtgcatgcggggtatccgccggccaccgagttgcccgcggcggccttcttcatgttcttgaattcgggcttggcgaggttgatggtgatgaccaggccgtgggaatcgaagcgcgggttcttgtcgagcacgcccttcttgacatagttgttggcgacgcagtagtcgtagaaccagcgcatggcctccatgccgccatgttcgcgttccactgcctcgaaccggtcctgcacggcggacggcgtgccggagagcatgcccatcacgatgtccgcgtacacggatccttcgtcggcgtcgaacagccccgccgcgacggccgcggcgcggaaccgcgtcagcaggtcgtctggcagcgtgtcgtcgctggtcgcgccggtaggacggtacgagtcgagcgagaacagctcgaagatgcggttgcgcgtccagtcggcatcgcgcgggtcgagttcaagccgcttgcgcgcgaagtcgacgagcgcgtcgatgctcgcgtagacggcgtcgagtccgccgcaggcgcagtcgtccttcttctcttccgtggtcatcagcgggcggtcctttccatgacgtcgtcgacgatggcgcgaatctcgtcggccttctgctccatctcctgcacgagcttgatctgggtgcgagcgcgcacgaggttgtgatcggggtacttggtggcgaagtacgtgtcaccggcgaggtagtcggcgaggaagcgcatgccgcattccatcgtcatcatgttgccggcgaatgcgagcagctcggcctccttgtcggtgatgctgtcgcgcaccttgccgacgaagccctccgcgtaggcgcggaacagttcggtgctgaagtggaccttgtcgagatccttctcgtcttcaagcgcggtggacgcgccgaagcggatggaatcgccgaagtcgaacagcatggaacccggcatgatggtgtcgaggtcgatgatggcacgggccttgccggtcttcgcgtccatcaggatgttgttgagtttggtgtcgttgtgggtgacgcgcagcggaacggagccgtcggccagcccgtccatgatgcgggagtactggtcttcgtgggcgaggaagaagtcgacctccggcttgcaggtttcggcgcggcccatcttgtcggcttccagcgcagccttgaagtcgcggaagcggctcggcgtgtcgtggaagtgggcgatggtctcggtcagctgggaggcgtcgaagccggccaggaagttctggaactcgccgaacgcggcgccggactcgcggaacacgtcggcgttggggacgaggttgtaggagatggtgccttcgatgaacttgtatatcctccaggcgccgtccacctcctcgttttcgatgtagctcgcaccgtccttggtggggacgatgtcgagcgtctcctggttcttggagcgcaggtaggcggtgacgagttcgatgttgcgcatcaggtgcacggtgtccgggaagatgtccgtgttcatcttctgcaggatgtaccggtgctgatccgtgttgatcaggaaggtgacgttgatgtggccgtcaccgtatgcggtgatgcccttgacgtcgccgtcgatggcgaactgatcgacgatggccgccagtttcggatcaatgtcagtcatgtggaaccctcttttccttgttgtgccgcaggttgccgccggtcttcaccgccacaacgaccccctatctgaagctgctgtgccactgcgacgcagcagctgttggcgcatacgcaccgttatttgttaattatagttacataaatgacaaaccgccattcttcggcgtttatagttcctgaatccccttttctattgctataatataaagactgtggatttgaacatgaccacaccgcagctcgcatgatccgaatcatgagcgctctgacaagaaacgactgaaccaatgacctcgtacgccaacaccatctcgttccccctgcacacgcccggcaggacgacgaaggcaagtcccgccgacgtgcgccgcaacaaccgttccctggtgttcgggctgctatttccgaacgggcagctatcccgcgccgacctcgggcggcagaccggactctcgcgcgtggcgatatcaggagtcgccaacagcatgctcgacgaagggctgatctgcgagagcggtttcgacgtcaacgcctccggcaagggcaagcgcggcacgctgctgagcatcgacacgtcgcgtctgcacatcatcagcgtcgacctgtcccaggagcatctggtgcagggagccgtgaccgacctgctgggcacgccacagcagcgcatggaaatggcgctcggaccggataacgacatcaacgcggacatgatcgtgcagctggtcgaccagctgcgcaccgacatcgacgccgacacgatcatcggcatcggcatagcggcgactggtgtcgtcgaggacggtgtcattcgcgaatcgacggtgttgggatggcgggaccttgatctgagaggcatgctggaacgtcgtttcggattccccgtcaccatcagcaacgacgtcgtctgctccatgctcgcggagcgattcttcgggcatggcgacaagagcatgctgttcatcaagatcgaccgtggcatcggtgccgcgacgctgatcgacgatgtgactgtgatcgggcagaaccatgccggaggcgagatcgggcatatctccctcgacccggagtcgggggtgttgtgtccgtgcggcaagcgcgggtgcctggagacgatggtcacatcgccggtaattcgcgagcggattcgccgcgcgtcgacgcccgaggagcagctggacatcatccgatcctgcggcgagcagctcgccgcggcgctcgccatgccaatcggcctgctcgacatcaacgacatatgcgtgtacggcccgccggacatcgtgaacgcggcattcctggaggcgacgcagcgccgtgtggacatggtgtcgtcgtcgaagttccacaagcatacctccgtgcgacggtgccaggtgggttcggatatcgcgctgcgcggatccgccatcgacgtggttcatcattacatcgagaacggtcactgagagaaccaccgaaaggtccttgcgatatgaatcgagggccgctcccccgttcagggagcggccctcgattcatgttctgctcacatccggccgtgcggcccggatggttttggaaactccgtcgccggtaccggtgtgcctatcaggcctccggcgcggcccacgcggcgcccagcgctccgaccggctggtcgagttgcgcaagcttgatgcgttcgccgagatgcaggcccgtcaggaacgggcaggtgcgctcgcgcacgcgcagttcgtccagggtgacgtcgatgagcggctggccggtcttcgccatgccaccgccgaagataatcatgcgcgggtcataggattgtgcgacgatctgcacggcgtcgacgatggcgtgggtgaccatgacgagtatgcgctgggcgtcaggctcgccgcgacgggcgcactcgatgagatccggcatcggaggcttgccttcgaccggccagtggcggccgaccgacgctccggagcacacggtctcaagacagccgctctgcccgcaggggcacgggaagcggttcgggtcgatcgggatatggccgatctcgccggcggccccgctgaaaccgtgctggacgacgccgtcgacgacgatgcccgcggcgagtccggtgccgaagttgaggaacacgatggttccttcggggtgggatccgccgaccatacgcgcggcgccgaccgcggccgcattgacgtcgttctcgacgtgcacgggaataccgaggcgcttgcccgcttcggcaccaagctccagcgtatcgatgtcgaggttgacgacgttgtcgacacgaccggtttctggattgacctgtccggggatgccgatgccgaccgtggcgacctgatcgaacagatcgccggccacctcatgggtgatcgatacgacgtcgtcgatgacctgcgcgttgccgcgtcgtgcgggaatgcgcacgtcgttgcgaacattatcctgcggatcgacgagaacggcctcgatcttggtgccgccgatgtcgatgccgacgcggaagcggtcggcaggtgtctgctgtgctgtatcctgcactgtcatgtgttgtgtccttacgtaacagcggatatgcgcggttcgcacatccttgacgaatatgtggggcaaggcatatcgtcatgccttgccccaccgatgggtctgagtgtcagggcctccggaggaaggagaaggaaagcacggaagccctgatcctcaagtcttgctgtccgatccatctgtccccgtccgtcccgcatcatgccgcgggacggacggggactgcacagatcagaggttgcgccaagcgatggcgctctggtcgaggtcgaaatgctcgatcgaaccgtcaggcagagccacatccgtggactgcggacggtcggtgttgttgatcacgcagtactggccggcatcggggaacaccgcgacctcgcactcggggttggtggagctgtatgccgtgtacttgtcctcgttgtgggaggcccagaacaggattcgctccagcagacgggcgttcgcggccgagtagggcagaccggagacgtatacgccgcggcccttgccgtactcgttgaccgcgagctgcacctgaccgccgtcggcacgcagcagcgtcacgtcctcgttgaccgggaacgtgttcgcgatcggctcgccgaagtcgatgccgccaagcggcttgatgccctggccaccgccgcagcccgacagcgggatgcggtatccggccttctcccacgcttcgcgggcggcgggatcgacatgcacgtcggcggtgatgaagtgctccggcgtgacggttgggaagtacttgtccaccgacagcgtctggtagcgttcctcgtccacgcccagcacgtcggccagctggaagaaacgaccagcctggaaacgggccagcgaactgggctctccgacgccgacgaatgctccgccgccgcgcacccaggcgcgcagggtctcggtcagcttcgggttcttccacacgtctccaccggtgaacgcggtgtcgaccgggccaccgttgatgatcacgtcgatgtcgtcggcgacgccatgctccagcacatcatcgaagctgatgaaccgcacgttcacgcgcatgcccgacagcgactccagaaaacatgcgaactccaatccggacaccaaagcgtccaacttttcatccgcacccccctctgcgcacttaggaacgcaaactatgcgatctgcgttcctatgttcgcgcactcggcgttccggcgcgcacttaggaacgcaaaccgagtctctcaggggattggggcgattcgcgcgccgcgaatggctgtttggcgtgggggtctgggacaatggcacgtatggcaatcaagaaaggtccgaccaaggggtcgggaggaaaacaccgcaatgcgctacgcggcaaggggccgacgcccaaagccgaggatcgcgtgtatcacaaggcatacaaggccaagcaggcgacgaaccgtcgcaagatggcagatccacgactggcagcccgccgtcgcgccgcgaagttcacgtccgattcggacgatctggtcatcggccgcaatgccgtgctggaggcgctgcgcgtcggcgtccccagcatgcagctgtatatcgcgacacgtatcgagcatgatgaccgtacacgcgagatcatcaagctcgccggcgcacaaagcctgcacctgctggaggccgaccgtctggaaatggatcgcatcgcccggtcgtcgaaccatcagggcgtcgtgctcaaagtgcaaccgtaccagtattcgtctctcgccgagctggcggatatcgccgagcgcaaggccaaggccatggacgtggtgaattcgccgagtgcgcgcatcaacgcacgcccgctgttcatcgcgctcgacggcgtgaccgacccgcagaacctgggtgcggtgattcgttcggccgccgccttcggtgccaacggcgtgattctgccggagcgtcgttccgcttcggtcaccgctgccgcgtggaaggtatcggccggtgccgcggcgcatatcccggtggctcgcgtggtgaacctcaccaaggccatcgaaagcatgcgcgaacgtggatattacacggtcggcctagacggcggcggcgataagctggtcggcgaaaccggtttcgagaccgatccgctgatcgtcgtgctcggttcggaaggcaagggactgagccgacttgtgcgcgagtcgtgcgacgcgatcgccggcattccgatcacgtccatggtggagtctctgaacgcctcggtcgcagccggtatcagcctgtacgcggtcgcccgcgcccgtcgcgaagcagcggcagccgccacgaagtaatacccatatctccccctgctgccggcggggtcatcgagcggaacgaaaatcggggtggccgccgcaatcggcgcaccaccccgtccggtttcgctcagcagctccacatatcagtggctccacaccgcggcatcaggatcgtcgtcgggattgtaatcatcatcgtcgatgggcttttcgtaattcgcctcatcgtcgaccacgccggaatccgcttcagcgttgagctcgttcacggctttgtcatccagcttgtagttcggtagcacggattggatgtagctttccacagcctcgcccatcggcacgtcgtggccggccttctcggcaaggaaccagcggtgatccagcacctcatggaagaactgtgccggctcgatctgcgaacgatattcacgtggaatcatacgcacggtcggctcatacacctcacgcatccaatcggtggcgacgatctccaactcctcgccttcacgccacgtggaggcacggtacgcatccagatcgttgagcaggcgccgcgcctgattctcctgcacatctaaaccggtcagtcgcagaagcttgcgcgacgcatagccggcatcgaccacgcgcgggcggaccagcacacgtttgccgtcctccgcggtcttcatctccagctcgtccacgtcgaagcccaggtcgttgagcttgttgacgcgctgctcgatcttccacatctcatccgggccgaacttgtcggtgtcggtcagcgtgctccacaacgagtggtagcggtcgaccagacggttgcccacctcgatctcgtccacgtcgctcggcagcagacggccagaagccaaatccatcaattcaccgatgatgttggtgcgagccaagtcgatatcgtattcacgctggccatcggtaagctgcacctgcaaatcaccggtttcggcgtccaccaggaaggcggaaaacgcgtcggcatcacgcaggaacaggacgttcgacagcgacacatcgccccagtagaagccggccaagtgcaggcgaaccagcagcacggcaagggcgtcgatcaaacgctcggcagtatccggctggagattgcgggcgaacagcgcgcggtacggcagtgagaacttcaggtgacgggtgaccagaatcgcttccagcggttcgccgttgcggtcatgacgaccggtgaccacggcaatcgggatgacggtcggcaactcgagcttctgcagtcggcgcagaatctcatactcgcgctcggccacctgacgggtgatctctttcatggcgtacacctcgtcgcccacatgcacaaaacgcaccacgtggcgggagatgcctcgcggcaggttggccagcaggtcctcgggccaggtggccaggggcttatgccagggcagcgtgaacatcttcgggttcgagctggcggcggtgatcttcaatgcttgcggctcagctgaactggcatgttcgtcttcggctttgacggacgtggccttcagcgcgcgcggatccatctgaggcaaatcgttcaactccatgtgttcgattctacgtggtgcttgggaagtgcagcgagtagcggcgacttcggcgcattattctcgcatacgaatagatcatctgtatgggatttgccggccgaattgacgtcccgtatgcgacgcctcatgcgcaatctgaacaaaatgaacgcaacaagtaacatgagccccgctgccgcggcaatgctgcctacggcggcacccgtacgaccgataaggccaggattgcccggctcctcgctcgggttatcttcgggcgggacaacaggagttccagtgctaaatttcggctctactgtgatgttgagatcagcggatgtgcctccactgccaggaatcgagatgaggaacggatcacagtcgtatgccttgttggctttcgccgagctcgtgcgggagaccagatataggccgagcggcagattctggaaagtgagctgaccagctacgttagtggtgccggaatgctggtacagcttgtttttcgccgcgtgcgcagcgagcttcttggccgcatcgtgatattcacttgatgtcaggcgttcccaatcggcagtgaggccggaaaaatcgccgacggttttatatgaggagacgctaccatcattgttcgttgtgacggtggcgacgcgcacgatggaataggtatcgccggcaagcaatttgggcgaagccgtgtctcggccccatacggcattgatggtgagagcgccgaaagaatcagcttgcgcatacggcaccatagagccgaaggctgcaagaacagtgaggacgatagtaacggcggcggcaatcatggcagcaatgcgcgccgcaccatactcgcttccgctatgcaggtctaacatgtctgcccggtcctttccgccatgatgaatgtgattggttatttgtactgtctggctgaggaggcaagtcaccgtccggctcaatatccgcagagtcagaatcaccagatgcgaccttggcgctcccactctgccggcgtcgccgctcatggcgctgccataaatgccatgcgatgagcaaggcaatcagtgcaagagacggcaacaagtactgcagcggaatgtccacgtggaacgtggatttggcgtcatcctgctgctgcggcgtgtatgggatgcgatggccacgcaccagcagccgatgcgtattgaccgcatacggcgtacaagtgatgagcgtgaccaaatccttgccgggctcaattgccagttgtttggtatcggtcggcagaacggtagtgatcttatcgacctgatacgcatacgtgtctttaagtattgtgatgtagaacttgtcgccttttttcataaggttcaagtccgtgaacagttttgccgtgggcaagccccggtggccagacagcgccgcatgagtggacgcgccaccaactggcagtgaggtctgttcgagatgtccgatgccggattgcaacactttctcggaagtgccgtgataaatcggcaaggtctcctcaagcttaggcacagtgatgtatcccatcatgccgtcaccgtcaatattgagcagactgttgtattcctcgtccgtggatgcggaattgacggcactggcaagagcgtcggtctctcccgcatcgttctgggcgagcttttcgttataggcgtgcgcagcatccagcaccttctggtactgttcctggctcaatgcttcaacgctggcgtcgtagttatttacggcgcggctggcgttgcacataatgaggaagttgctgatcgtcggatagaacagaatgagcattccaccgagaatgaccagtaagggcaggatgttgcgcagtcgtttcatcgagcgttcttttcgcgaggaaaccgtgttgtgggcgtagcgggtgtgtgcccttcacgcccaaaacacggccatgctcgtcaggcgttcttgcgcttgagagtccaggcaacgccgagcgcgatgaccagcacaccaatcaccgtgaaggcgatggtacccatgccaccagtgccaggcagggtaacaccggacttgttccggaccgggatgacaccgttcgatgcgtgctcgccgtagacgctgccattgtcgttgttgtaggtgatggtgacggtggcatccgtgttgtcagtgccgtcgttccggccatcaaccttcacgccgatggcgctggcgagcttgttgtagccggccggcgcttcggtctcggtgagcgtgtactcgccgttcttcagtccctggaagtcaaccttaccgttttcaggagtggtgatagtcgtcgtagtagtacttgccttctcatcatccgtagctacacggtatacagcgttcgcggtcgcactaccggcattgacttgcacgaagctcatagggtcgccgttcttaggtgcgagtgtgaacttagcaccagcaagtcgagtagcggcatcagtatattggtcaccagtgtacttatcgacggtgaagccataagtgaagacgcgaaccttgctgggttcggactcaccggtgccattggtgctcgggttgttggagtactgaatcgttgcggagttgacgttaccagcaccgcccacaacagcatccttgttcaacgtggccgtgtaggtgacggtgatcttcttgccggcattgacctgctgcttggtcttgaagtccttcatggcgacagtaagcgtattgttgttggaggccgtaggagtggtgacggtgtagtcagtgttcacggtcagtggactattcgcaccttcgaccttaacggaagtgacttgtccaaaggtgaggcccttagacaacgtatccttgaagttgaaggtgtaggtgctataggcggacatgtccggaatggtggaagtcagggtaaaggtcagggtatcaccgatcttcgcgtcggtggcgtccttaccagtgccgtttacctgtaccttcttgtcgacggtaggcaggttgcccttaatctcggcagtcacactggtgctatgaacggaaactagcgtggcgtattgactactggcgttggccaaggtcgcacccggcacagcgaccacgtagtagccgtagtcgagaccagtgaacgtcgcagtgtacttactgttcgaggcatcggcagataccgtagcggtcgcgccaaccgtgatgttgttggccttggtctgcgcccagttcgatgccttggtagcgaaagcaaccaaggcattaccagtcagcttggatacgtagtcgtttgctttatcgttgatgttcgcgtcggtaacatcagttagtccggaagcagtggagttcttgaagaacggcttccactcgtcagtcaacgtgtaggagacagcctggccgtcaccgctcacggtggcggagaacatcttgtaggcgttcacggtcttaccggcgaacttcgcgtcagtagtgctgaccgtcagcgtggcattaccacccgctgcgttggccgtggcgactgtcgtcgcagccaatccaaatacggtggcaatcgccgcggcggcagcgaaaacctttttcatcagtgacttcattactgttcctttctctagatggaaatcttttctgtttggcaggtacggtttgtctatgtggtcgtcacgaggcatgggcacctcgctttcgtatacggctggagcccgagcggactgtgccggattgaacgcgttgattacgcacgtaccagaccacgccagctcccataagcagcaagccgaacatcaggaaccacatcgtgcccgcgcctcccgtatccggaagcaacgccacattggtaacaatggccacgcgttccttggtgttgtaggagaccgatacttggtatccggcctccgcgggcttgatggtcttggtggtatcgccgtccttataggtcacggcggtctcttccacggtgtacgtgtagtaacgcacgatgtccttgccgttggcatcctgtccatccacgaatgcgaccggcagtccttgaatcaccttgcgccaggtgttgctccaggaagaggcatcggaggagtccaacgtcaccgtccatggattcttctgcgtcacggttgtgcaatccgcgccgaagcattgaatcgtctgcggcgtcaccgtattgccactgccatcggtatagtgcgcggcgatcttcagttcgaccgactgcggccgttcgaggttgccgtccttccataccttctggacggtcaggtcaatggttcggcaaccgtccttgccgcacgggtcctggccgtcgtccggttcgggggtgagtccgccgttgttgtcggtcacggtcgcgtcgagcatgagcacggccttggccggggactggtaggcatcgagcttcgtcttggtgctgccgtccgtggagttgaccacggcgtccttaatgccgacccaagtggtgccggcgtcgccggatgcggagctgtgcacagcgctgctgtcgtatgtgttgaccacgtcgaacagcttcacttcccaacgatcgagtccggtgttcagcgcatcgtccgccgtgttcttctgcgagaagatcttgttgccgtcctgtgcggaggtacgggcctcactagcgttcgcggccgccttgcggtaaatgcgataggtgttgtatgccttgccgcccttgccggcatcgaccggtccgaggatgtcgctcatggtgttgaagtcccatacggacttgagtttggtgttcgagaacgggtcgaccagtccgctggcaccgcggatcgtgtcggcgtagaccatgtggtcgtctgccagcacaccctcgtcgttcagtccggcgaagccgcccgtgtagcctgtggaaagatccttcacaccgtcggtatcctgagttgcccctccgccgaacacgtcatagccactggcgatgcccgttacagtggactgttccacgcgagtacggttgcccttgatgagctggacggtcaggttgctgcccgacccattcatatcaatgccgtctttactgcaaggcagtttgatgacactatcgccgatggtgacaatcgccacgtcggtctgctgctggttttcatcatcagccttggacagagcaacgctcaccttcagtccgaacaggttcacgtacagcacgttgccttccgaaagcaccttgagatcgaataccttgccgaagatggccgggaaccacttgcctaaatcgatgacgccgacctgttccgccttgtcgaggtacaggagcttgaccagcgcgttcaccacttgcagcagcagttccacaagtacagagttgaccttcgcgtcaaccaaataggcacggctggtttcaccgacgaatccgccggcaatctcaccgctagtgaccttcttgagattgtcagacgcgcagcccttcactcgggccaagtccgcgtagccgacgaatccgcccgcgacctcgcgtccggtagccttgtcggtggctttgccgtaggtgtcgccatggtgtgtggcggtgacggtataaccgtccgggatgccgatgacgcgcgaatcgccaacgtgcgagccccagatgtcaagtacgccggccgtggcaccaagcagattgagcgcatctgtgccgagttgtgcattgtcggcggcgaccgtgccggatttaccaagatgcccgatgaagccgcccacgtagttcacgccggtcacactgttgaggttggtgaccgcagactgcttgacggagccattgatcagtccaccgccgaagccaccggccgcaccggtgtaacgcttcgagtcaagcatgccctttgtggtggaatcatgggcgacaatctggatgccgtcgctcacaccgttgacctgaccgtcatagatgaaggtgcggaatgcttcgagcacgcccacgttgccgaccttgagcagtttgagcaacaggttggtattctgcttatcgccggcctcgccgccgccgacggaagcgacgctggatatatcagcaaggccaaagaagccaccggcgtattgcccgccttcaatagcgcgcagcccgttaacagtaagagaagccgggtcattgttcggatccgcttcactgccggtgcctttggcggaatccttgtcaccgaggatcgcggcctgcaacgaaccagcgaaaccgccggcgttcagggcatacttggttgtggtattacccttatcgtccctgctctcatatgcgccattgaccgtgtatccccatgccgggtcatccgagctcacatgtgcaccgcgaatcgtcgtaaccgtggcctgcaatacgctgaccagacttgccgggttcgataccagcgagtcgaggattccttgcaggaatccctcggacgcattggtgtccacatccgcaaccgcaccggcagtggccacgccgataaatccgccgacattgttgcgcccttccaccttgcgcaggttggaaacattggcaccggcagcggtgacacccttgacaagcttctggccgtcctggtcgagatcgccccagatctggccaccgaccgcgagaccgacatagcctccggcattaccggtaccgtgcgtgatgtcttcaccggtggccacgaccttcatacccttgcggtagccggccacgctcgaagatttgacgacgggcacaaatacctgtgccacgtcgagcatctgtcccaaatcaagtttgatgcctttgtcgccgaatagttggatagagccgaacgaggatgccgagccggattccatcgtgcccgcataaccgcctgccgcacgcatggcagagacggtcttgacatccatcgactggccatcggtgatcgtgccggtgcgcatcagaccgacgtgtccgccggcgacgccggaatcatgcaagttcgcgccagtcttatactccgcacgaccggcgacgacgttgaatccgaagatgtaggattcgaggaacttgtccagggaatcctgatcggtaacagagcccgcaccatcgcccgtagctacctcggtaaattccttgccatacgcaccgtacttgccgatgttgtcgacccacgtcttccattggtcgtagctcatattgcgcaaaggaccagtgaccttcgagtgctcctcggtcgggtagaccacagacagcacgccggcgagattgccggccttgatgagaccgccaagcaaggagagcgaaccgccttgagcggtatcggccgcctccatgaagccggtgtaaccgccggcgatttcggcaccgtatacgctgcggatgcgcgcggcgtaggctacgcgcttcggcccgttgtatttgccgccggtattctcctgcttccacgctgctgtgttgttgccccagatatgaccgccacgattacgacctgcatagccgccggccatgccgcggcgtgtggtcgtatccgatgccgcctgggcacgcaccgcgccgccgcacactgcggcatcggtcgagctgttgcgaatcgtcggtgtgaagtcctgcacgagcgagagcaggttgtcgaggttggcaagcttcttgagcacgctgccgtcaccaagcacgttcgccacggctcccggctgcatggtgcccacgtaaccgccggccgaaacctggccgatgatgtatacgaactcatgagagctcgagtcctgaatgtggccgccttcgatgtctccggcgaaaccaccagccatacccagtggatcgggctcattgttggcattcctatgatctgcggcgctggccagaacggagtatccgccgatgccgccagtcacatcggagtgttcaatcgtcgagacgacgacatccagcacactgagtacatcgttgagattgactttctggccgagcaggctcaggccaccgcccacggccgccgccgagccgatgtccattttgccgatgtagccgccggcataccgagcggcggtgactgcatacgagctgtctttgctcagataggtgtcgtcgatggatccggtggtttccagattcttcggtgccttgacgtcggtgtggcgcagttgggtcacgctggaatgggatacctgcacgccggaaccgtagccgatgtagccgccggcggaaccggattgcgtatcggattggtcaagtcgggtggcggagacggtgaagccgggatcgtccgggtcggaaatcccgttaccgctagttgcctccacggtggtggcatcggaatgcacacccgcgtaggagatgaatggcacatagccctgcaccacctgcagcaggttggcgagatccaccgtaccgaatttgccgagcaaactcaggccgccgttgccagccgaagcgagcgcaccggagacaaccttgccgccgaaaccacctgcgtatgcgccgccggtcacatggtcaaggttgacaacggccacggggttggtttgcacgcgggactgtacaccggccagcgttgagtcgttcttgagagcggtttcggagaactggttgaccttgccgctttggaagtttcccgcatagccgcccgcgatatcgccttcgacataaccgccgttgacgtatgtcacggtggtatccgtataacttggaatcagatacggtacggcaccgagcaggtcgttcacggacagcaggccgcctttgatcaggccatccaatacgctggaatcttctgcgttgctgagcgcgtcggcgaggccgccggtggtggagaagcccacgaaaccgcctgccacaccatcggacgtgctggtatcggctgtgaccgatttgaggtttgtcacatggctttcccgggttttggtgctgttggcctgaccatagaaaccgcctgcagcgtaatcggttgtttcgttgttcttgttcttgccggttgccgcaaccgtgaatccgccagagatgccgttcacgttcgatgcagtgactgcaaccgaagaatattgggcaaccgatagcagaccggaaagcttgataagcccgagcacattgagaccgccagcgccgatggcgtcgcctggtccagagaagccaataaaaccgccggcttctcccttggccgagaccgtggccagattggtaaggttcgtgtgggtcacgtcgccgccggtggcgcatccgatggcaccgcctgcatgatatgaaccagccgtcactgtcaggccggatgccggagcggtgacagacatgttctccacggtgaacgcggcaaactggtcgaacttcttgagcatggcaatatcgccaattttcaccacactgttgagcaacccagctaccgttgtcggttgcaaattgccggcgatgccacccgcgtaggagcccgcggccgtgaccgattcaaggccttctatggtggtggaacgctgctgtgggaagtcacgaggattgttgtacttccagaatgtgagtttttgaaggcggttctgcgaggaatcaccgatcaccgtacccgaaccttcacccacaaggccgcccgcgtaatcaccgccggcagcaactgtgaaggaacccttcatctgtgtaccgagaatcgcagaaggattcacaccgacgatggatagcagttctcctgcaccgttattgctgccgctcagcaatttagtcacagctttggtgagctgtttcaacagcgatgccttcgtggtatcgtccgtaccgagttccaggccccatcccacggaggcgaatccggtgaatcctccggcgtgggatctgtcggcagtcacggcgaccgaagccgtaatcgaattattgacagcataggcattggccatggcaccgttgaagccgccggcgtagtcttcggcctgcacggtgatcttatcgtcaccgtttaccgtcaggtcactgttttcgatgaggctctgcggacgcagcgcagacagcaagtcgacgccaagcgagttaatcagaccgcccacgttgccgttgcgacttactccggcaaaaccaccggcatattgcgttgcccgcacggtgaaaccattcgcgctcgtcaccgaagagttctcaatgattgcaccaatctgcgcaccgacaaagccgccggcctgcgggttgtccttgttgccgatcaccacgttctttttgaacccgttcaccgaactattcgagataaccgggttgtagtagccaaccggaatcaaggcattcagcccgagcgtgccggacagcaaccagtccaccaaatcgcccagcccgaggaacgggatgacgttcagaatcttcgagagtaacttggtgagcgctcctacgatgccggagactgcatcgtatcgggttgcgccctcaacatatcccacgaaaccaccggtcatacggcttacgctagataccgaaacatctgctacctcgcagtccgtaaccttggtgtccccgtagatacggccggcaaatgcacccgtggcgaggttggaaggatttttttcgtgcagggtgagcagaccttgaagattgaggtcaagatctacttgtccgaatgtcaatagttttaacgccttcaacagtgtgtcgagcagtaatcccactgccgaagtgagcataccgagcaaggtcggcggaatatacgattcactcgtatgattcgtcaccgacacatcctgcagcttgaggttcgacaccacggccgtaccggcgctgcccagactgttgctgttcatcacggtcttgttcgtgatcgaggcgaagaagccgatgccctgctgcttgctgacatccagctggtcgcctttgacattagagaccatatctttctgattgacgaccacatggctgatgaccggccgagctgcggtagcgtgaaccacgcttgcgccatcggcaccaacagccttccacaggctggctgcggtgtcgccgtcattggagacagcaccgagcatagtgccggagaacatgagcggagtccactcggtgttgttggtatctgccgcgttcttggacaggtcgatgtcacggaagatcaggtagttggcgtctgcggaataggtcaggccggtgttggcagcggagtagtccgtttgcgtgccatcagcacccacgccgtaatacttggtgcgggtctttccgacgtctaaccgcgtgctgcacagcagtggactgtcgtggtcggaggcatcagcatcgcgcaaagtatctgaattggagagatcggcgtcaccggcgtattcggaagacggcgtgccgtcgtccacccactgatacttgccgagtccttgtcgcgtgcaagtctgcttgaccttgttgatgcggccaataaccttcttgccagaaccaatcgcacgcagctgctgctcgttaccaatcaggatgtagggcttgccgttgatctccttggtgacctgaccctcaaagtcacggccgccaagcgccgtcgcggcgacctgcacattggccttcgccggcgattgatccgtcgcatttgaggaatcgttcttggcatcttgagaagatgcatcgtttggagaccgcgtttgggctccatcattagcggaattgccagcggtagcttctgctgagtcgtccgccttattgtctgtcgcaccatttgaggattcggaaggtgttggcgcaccgtttgatgtattggcctcttctgacgtcttatcgtcaacgttgacattgcgagcagaaggagcagctacgacagtattatcccccccccccagaaattacggcgttaggagagctactcacatcgtctatattctgagcatatgctgcaggcaccatgcacacgatggacaaggaaacagcaataaccgaagcaaggcaacgcttcaaggcatggcgctgccttccagattcctgttctgttcctccgttaaacccgcaacggacgaacttcgatttcgagcccattgtttcccctcatagattcgcaatccctttttcgggaggtcactgcatacaattatacaagaagttggcccgttgtctaattgaaagtgcaacacccgttattggagattgtccagataaccagtccgaagggatgttgcacctatggggaaagtatattcgcacctgtcggaagaggaacgccaggtcatccagatcgaggtcggcaacggcacgagcgtcaggaagatagcccgtttgctgggacgcggcccgtccggcatcagcagggagatcaggcgcaacacgtggttcccgtccaacgagagcgagtcctaccggccgtaccggccgaagcgtctgaagacgggcccgtggacgggccgctactacatcgccggccccgcgcagcgcaaggccgaccggcgcagggcgaagccgcgcaagccataccgcctgtcattcggccgcctgtgggcgcgggtggacgaatggccgggtagaggctggtcgccgccgccggtcagcggcatcatccgccgttgcctgcccaaacgcacgatcatcgaacccggtatggcaagagggctccaggagatcgtcgacgagaccgacaaccggcccatgcgcatgctcggccacctcacgcccgccgaggcattcgccgacgagctgctaaacttgcaagacaaacaaggatgtcgcacttctaaatagacagtggggacaaaagaacaaaaaacgctcatttgcgggggccggttagcgtatgtctttctgggcaaaaagaaaagccccgcaactacgcggggcttttccaacgaggccataagagaggaagagaatcgcctcgtttaatggttggcatgaccggagtcataccaagtatctgctagttcctctactagttcagacgcaactcggtcgacggagcgaacaggtgcatcttggaggggtcgatcttgatcttgacggtctggccgatcttcggcagcgcacgcgggttcacacgaatcgtggtgagcttgttctggtcggacatcatcgtggacgcctcggcagcggagccatcggtgatgatggtgccgtagatgtagccgtcggagcccagatcctcgatgttctgaaccttcagcgagaaggcgttcggatcgtccggggtggccagggtggcatcctcgggacggaagccgacgacaatcttgccgccatcctcagcggtcagcttgttgacggcctcggcgggcaggtcgacggtgtcctcaccgatcttcgccttgccgttgacgaccgggtgagtgttgatgttcatcgacggggagccgatgaagccagcgacgaagacgttggccgggcgatcgtacagctcggtcggagcgccgacctgctgcaggacgccgagcttgatgacggcgatgcggtcgcccatcgtcagagcctcggtctgatcgtgggtcacgtacagggtggtgacgccgagctgacgctgcagggcagcgatctgcgtacgggtctgcacacggagcttggcgtcgaggttcgacagcggctcatccatgaggaagaccttcggctcacgaacgattgcacggcccatggccacgcgctgacgctgaccaccggacagagccttcggcttgcggtcgaggtactcggtcagatccaggatctcagcggccttctcgacgcgcttgcgaatctcttccttcggggtgccggcgatcttcagggcgaagcccatgttgtcggcgacggtcatgtgcgggtacagagcgtagttctggaagaccattgcgatgtcgcggtccttcggctgcatcgtggtgacatcattgccaccgatgaggatgcggcccttgttgacctcttccaggccggccagcatgcgcagagtcgtggacttaccgcagccagacgggccaacgagcaccaggaactcgccgtccttaatgtcaaggttcaaatcatccacagagggcttatcgttgcccgggtagatacgagtgacgtggtcgaatacgacttctgccatgatattcatcctttcagaggcaggtacgtgcctcacgatccgttgtaaagggattactgtgccttgatcatcagtccctacactggcaacatcaaaccgcagcgttcttttttccttcggttcattgaagactctcttcgttgagccacgtactactatacacgtccgctggaacacgtcaacacgcgcgtctgaaacgcggacgtaacatcgacgggccttcaaccggcatcccgcagccggcattatccttactccgacctcatctcagtccccctcctcccatccatctcccgcctctcccctccccaagtcctctcctctttttgcaagtcctctcctctttttgcgttcctaagtgcgcgccgaaacgacgaccgtgcgcacataggtacgcaaacagggccatttgcgtccgtatgttcgcgcacttgtcgttccggcgcgaacttaggaacgcaacggcgcttcggctcaatcggcatgctcgaatatcgggtgcgccccggcacgcggcacaccggcctgcatcagcttcatgacgaacggcgcgcgctggaccacttcgttataattcgtccgtatcacaacgctcactccggcctctttcagatcctgttcgcgctgcctttcgtcacggaccacctgccgaacatcccggttcgacgtcatctctggatcgatgtatttctgcataccgtcaaactccagcacgatgatgcggccatcttccgtatgccagatgaaatcgacccggcccgcctccttgccggtcacgcggctgtaaaacgtatgctgcaattgcggaggaacaaacccttcttcgatggatacagcccggcagaacgactctcctccgttctcgctgcgagcatccgcataatgcagcagacgaaataccggcccacaatccactcgcagaccatcacagacggcgacgatctcctcgcgggtcacgagcccccggcgcaacgcggaatcgaacatcgacagcacgtgctcgaacggatacaagagcgcgcagtccaccaaggttcttgccggactggtcacacgtacctcgccgatacatacattgtcacgcaatgcccgttcgtgggcgatccggtcagccaacttgctcacctgactccaggtattcgacccgtcctgtgctgctccatcaccgcgaggccggtacaaacggaccacatggcagtcctcccgtatatcggatctacgcaccgagatgcgccgcagccggtggtacgaccgacgtgacttggtgaatccgtcagtcgcgatgtacacgtatggctcgtcatgcagcgtccatgagtgctcgaacccgtagatgaccgccgcgctcagtccggcgaatacgcgctcgggatgccgtctcgccatttcgcgaatgacatgtgacgcttgctcaatgggattcagaccatcccagtattcacgacgcgcgtacacgctgcgaaatggccgcacgacatcgccgcaacgagttcgccgcagcatcgcctgtcgttccgccgggctggacgcggaacagcatcgcccgtccatttccgcccggttcatcagatcgtctagatgcttgtgctgtctcatatgttgatgatgacaatatggaccgccgctgcgcaagcgaatccggggtatgtggtcgaaggctaggcgattgtggataactcggcgcgtcgcggcggcatcaacggctgtgacgacacatttgcgttcttaagtgcgcgccgaaacgacaagtgcgcgaacttaagaacgcaaaccggcccatttgcgtttctaagtgcgcacaatcgacgtttcggcgcgaacttaggaacgcaaacgatatcaggggggggtagagagtatcggagaggacagcaggggaaggaggaatatcaggggtagagagaacgggcacagggcggtgagtaggataggagggtatgagcgatgcgttgaatttggagcccggagcgttggtcggcggctacacgctgatgtcgcggctgggatccggagccatgggatcggtctggcgcgtgcatgatgacggtggcgaggaatacgcgatgaagatattgcgtgattcgctcgccgatgaccgttcgacggcgtccgcgcgcgatcagatcacggcacgtgagcggttgcgccgagaggcgatggcgttgaagaaagtcaatcatcccggcgtgtgcggcatcgtggacatggagttggatgattcgctggcgttcatcgtcaccgagctgatcgagggcaaaaacctgcgcgacgacgtcgccgcgaatgggccatacgtcgccgatgacctggaacgactggcatccaagctgatggacgcagtcaaggcggttcatgcggcgggaatcgtgcatcgagacatcaagccgaccaatgtgatggtttcagcgaccggcccggttctggtggatttcggcatcgccatgggcgaaggcgaaagccatgtgacgcgcaccggcctggtgatgggaacgccggggttcatcgcgccggagattatcgagggaaccgaatccgatgagatcacggactggtggtccgtgtcgtcggtgctggcattcgcagcaaccggggagcccgttttcggcaccaagccgatgatggcggtgctggaacgcgaggcgtccggcaacgcgaacctcacaggtcttcccgccaccaccatgacggcgttccgtgcggcgctgaacccggatcgcagcaagcgctgcactccggagcaactgctgcaggcgatcaccgtggacgcgttcaaccccggcgcctggcagcagtacgacgatgacgccgcgcaatccggtcagacggatgtgatgcgcccttttgaccataccggtctgcgcaacccgcgtctgttatggcgcccgcatgagccggccgaatcaggtgagaagccgactgcagccgtcaccaaggcagaaatgccaaggcaaaccgcgatgcccggcgttcggcccgctttgcagcggatcatcggacaatcggcgccctcaccgtatgcgacggttccgccgattccgaggctcccaaacgccggccaagccgctgacgctgcatccgccagccttcgacggataccatcaatcgggacaggagcagatgccggaacctcggacggaaccgtaccgctccggggagcaccgctaccgggaaatatcgcgtcttctcaggcacccggcaacgaccagacggcgccgatgtcccgcctcaccccacctatgccgccgaccatgccggtcggcaccgaagcgaccgaatcgttgcgcccacagccgacatcggttctgcccgcctccaccatgccattcgattccacggtcagcgtcggacgaaccatgcccatgcaaccgcagccgacgacggccctacccacggacgatgcggacatgaccggagcaacggccgtaatcgagccgtcatcatccgccgacaccgcggcaaccctggcgatggatgatccagtgtggtcggggcgccagcaaatccccaccatgaccatgccgccgctgagcccccagcagatcttcgccgaccctgatgaagccgcaacgccgacgaccgcaatgcaacccggccagcccgcacagctccagccagccgcgcaattccagccgtccatgcaagccatgccgacagcgcaggccatgccgccgatggccatgaacccggcagacatcaagcgccagacctatctgcgtcaaggcacgccgctgcttgccgcatgggcagcgcccatagccgcaatggccgcgagcatgccgttggcggcaatggtcgcagccacgttgctgtgctggctgctgctgacgataggctattcgacagacgcccagctgcaacgcgaatacagacgcggcggcacacacagcgccggcgacaccgcgatgcgcatcatcacgctgccatggcacgccctcagggggttgcctgcggcaatagggcgcgggctgctcgccgtcgcgacgctggcgctgggatccaccctcgcgacgctgatcttcagtctgccggtcgtaaacacgcggttcgccataggcggcatcaccattgtggtacccatcatcgccgcctcccccgtgtccccgtcgggtctggctctggccatctgcgcggcgatcagctggatcatcggtatgctggcgcccgcaccgaccatgctgcgacttggcaccggcaccctgctcggtctcaaccggcccgcgggctccagcggcgcaggcatgctccccgaatcgtccgacaacgaaaccactcccgcgatatccgcccaacattccgggcgtgaattcgccgtatggatcgcatgggcggtgattacactctcagcgtgcacgctgctcggtctcggacagggcatcaactggtggccgctgccctccaacgtcgcataacatccccatcccagctgcatgccgagcaacggcaatgcccggtttgtagccattgtcacgttccatcatgcggcaaacggcgcaacccgccgccggaaaagcgaacccttctactactatgggcaacaaaccggcaggaaagggataactgtggcacaaaagaatcagaacgcgaagcgcaacaccagggcaagccgtcgcgccgccgaagagaaggcggcgcaggagaaggcggagcaagcggccaaggagcgcaagcagcaaaccatcatcggcgcggtggtcgtcgccatcatcgtcgtgctggtggcaatcgccggcttcgccatctatggagccattcacaagaacgacgtggcgaagagcaccaccgaggagcaggcataccagcagctgcaaaaggtcgagaccaagccatcggcggccgacgacaagggcggcatcctcatctccagcgaaggctatggcaagaaggtgtccggcgcccccaccgtcgccgtgtacatggatccgctgtgccccggctgcggcgagttcaaccgccagaccgatcccacgctgatctcgctggtggacgcgggccagatcaacctggaaatccacccgatgtcgtttatggacgaatactcgaccgacgaatattccagccgcgccaccggcgccatcctgtacatcgccagcaatgacgacaaccccgatcacctgctcaagttcatctcgaacatctacgccgaggacttccagcccggtgaggccagcgaatacaagtcggtcaagaacaaggcactcaagcagcaggcgattgacgccggcgtaccgcagtccgtggccgacaaggcgttcaacggcgaatacaagaaatggatggatgccatcaacctgtacaccccgaagcgccccgaactgtggcaggtgtccggttcgaacaagggtgtcatgagcacgccgaccatcaccatcaacggcaattactgggatcgcaaccagctgtcactcgccggcatgaacaacaagaccggcatcatcgcgtcgctgggcctgaaggaagacgaagtcggccagaagggcacgatgccgtcgatcggcgaatcgggcaagccgatctcgctgacgaccggcgaatgacgaatgacccgtcatgccccgcaaatgaacgatgacacccacgtagacccgtgtcgcgctgcgatcttcgaccccggccgaaggaaccgcaacacgggtttgcgacattctgaattgaccagcgcggtgaaactggtaagctggtcaatcgttcgatgacacctgtccgcattgtgcgaatggggtccgcctccttagctcagatggccagagcggccgccttgtaagcggcaggtcgtcggttcgatcccgacaggaggctcgcggcacagcataccgcgtgtcatgtgcgatgcacggtcgacatgtagtaagctgtgtttacatatagtcttaccttgtgtaagtgccagaagccttcccccaacttatggcttctggaaggcagagcgtcccccaattagctctgcccacaggggggcgggacaatccccttctctcccgcccccttcttctttatcttgatatatgtgaccaccccagtagctccgcgacagcccttcgggcagggcaaaaaagtaccaaatgtgggagtatgggtgacggtcgtgcgatgcccagcgaagcatcatcgtgattggttacaatgctagccgtagctcatggaaggatgacatatggccaggcggtggacaccacgacgttttgttcgattgcgtcgcattcgggtggcgatctgcgccgtcgccgtggctcttgcctcaacggtcgcattcggcgtcgccgcacgcaagaccatcgcactcagcatcaacggcgacacccagaccgtcaccacgtatgccatgagcgtgacgcgcctgcttgaagagcggggcgtcgacgtcaaatcccatgatctggtgcaatccaccagcggcgacatcctcagcaatcatgacgtggtcacggtccgcagcgcatatcagacgaccatcagcatcgacggacagcgcgtgccgttctggaccgtggcgaccagcgcctcccagctgctcgggtttttccagcagaacgagaacgaggccgcgaaagtcaccgtggacatcgacaacatctacagccagctcaccggcggcctcgtcatcaacgagtccggcccggtgacggtcatcgccgacggcaaaacgtcggtcgcgccgaatggcaagcttcccgccgcgtcgattctcgattccaaaggcatcagcctcaacaaggaagaccgcgtcagtgtcgagaaggacggagacaagaccgtgctgcgcgttcagcgcgtcacccacgggcaggagacgacgaccgtcgccattccccatggttcgcagacgattgttgataagtcgttgaagccaggaacatccgtggtccgccaacagggggaagacggcgagaagaagcaggtctataacgtcacgtatgtcgatggcatcgcagagacgcgaacgctgatttcggagacgaccaccaaaatctccctcgacaccatcgtcgccgtaggcccggagaaggccgccgaaccttccgacaccagcaaggggcaagccgataaaggcagtgacaacgccggcaagtcaggcaacaagtcgaataccggcaagtcggatggcaactcctcgaatggcagcacgtccggcgcaaacaagtcggatgatacgtcgaacaatgacaaaaacaacgacaagaacaacgggaattcgggcaacaacggcaattccgggaactcagggaactcaggcaatagcggcaactcgggaaactccggcaactcgggaaactcgggaaactccggaaacaacggcggcaacggcggcaacggcggcaacggcaactccggcaactccggcagcagctcgcagggacgcctatggcacccgaccgccgcgcaggccaaagcctacgcatccggcgcggccgcacagcgcggctggaccagctacgactggacatgcctcgacaagctgtggacccgcgaatccagatggctgtggtacgccgagaacgcgaagaccggcgcctacggaatcccgcagtcgctgcctgcgagcaaaatggccgagttcggcgcaaattaccgtgacgacggcgctgtgcagatcgactgggggctggcgtatatcgcccaacggtatggcagcccatccaaggcatgggaacgctccgaacaaatcggctggtactgatagcgagcgttatgactgacatgaatccatcccctgcaccttccggagcatccgcagccgccgggcgactgctcggcgcggccgacatccgtcacatagcagccgaagccggcatcagcccgaccaagaaattcggccaaaacttcgtcatcgatcccggaacagtgcgccgcatcgtgcgcgaggccgcggtcaccgccgatacgcgggtgctggaagtcggccctggattggggtcgctgacactggccatcctggaaaccggcgccacgatgaccgcggtcgagatcgacccgccggtcgcgcaacggctgccgcataccatcgacacatacatgccggatgcgaggaaccgcctcacggtcatcaacaaggacgcgctggccctcacgtcggcggacctccccgagttcagcggcgacgaaccgttcaccctggtggcgaaccttccgtacaatgtggccacgccgatcatcctgacgctgctggaacgcttcgacatgctgacgtccttcgtggtgatggtgcagaaagaagtcgcggaccgtctgaccgccactcccggctcgaagatttacggcgcgcccagcgtgaagctggcgtggtacggctcggcggaacgcgtgggcaacatcgggcgtcacgtattctggccagcgccgaacgtggattcggccctggccgggttcacccgtgtccagtcgcatgcgggcccgcgcgacccccagttgcgccagctgacgttccagttggtcgacgcggccttcagccagcgtcgcaaaacgctgcatgccgcactcaagcgcatggtgcccgatgaagtgttccacacggcgggcatcgacccgacacgccgcggcgagacgctgaccatcgacgaattcgccgctctggcgacggcgctgaggcaatcgcagcatgaacaggggcaggcatcatcatgagcgccacagcaatggacaatgtacggtcagcgacaccgggtcaggtgcggcgttcgccaagcgtccccgcgcattggcccatccgccgtcatgtagcagccgcggaaacgacaccggccgggccgctgcactcggtggaggtcacggttcccgcgaaaaccaatctgacgttgcacgtagggcccgcccatgaggaatggggcggccggcacgcgctggacacgatatattgcgccatcggcgtcaacgacgtggtgacggcgaccgccaagacccccggcagcgggttctcgctcgaactgagcggcgagcatctgggtgatctggcatcgagcggcagcgacatgcgccgcaaccatgcggtgcttgcgttgttcgcgatcgccagggccgcgaggcgggagccggacgtggcgctgcatgtggacaagcacattcccgtcggtgccggattgggcggcggatccgccgacgcggcggcgacattgctcgccgtgaacaccctgtggggactgcactggccgattgagcggctgcgtgacatcgccgccacgctcggcgccgatatgcccttctgcctggagggcggatatgcgcatggcaccggtttcggcgagcggatcatcccgctggaggatgattcatcatgcgttcagacgctgcgagaccgcggattcgccggccaattgctggtgggagcgtaccgtgcgcaactgagcacgccgaatgtctactcgaccttcgacaagttgggcgcgggagacggcgacgacaaccatctgcagcgcgccgcggtcgccttgcacccccgcagcggcgaagccatcgaagccgccctggccgccggggcatcccggtcattcgtttccggctccggcccatcggtcatcgcgttcgtaccggacgatcccgtcgcccgccgcgttcgcaccgcatgggagcaatccgccacggtggatcgcatcatcgctgcgcaggcgccggcgagaccggtcataaccgtcctgccatccctgtcttatcgcgtcagacagtgacgctaatctgtgtaccagtctcgtaagaaaaggacggacccatgactcagccttatgacgaacgcgcggaacgcaagcgttacattcgccgccgccagcagatcgtattctcctgtgtcggcgcggtgcttgccgtcgccctggtcgtgtcggcgctgttctatttccatgtcgggggtctgggcataacggccacgtccgcagtcaagccgaattacggcgtgcgcgtgccctgctcgaccaaggacgccaacggcaagaaccagacatattccaactatgcgaacgtcaaggtgcgcgtgctgaacggcaccaaattcgtcggcttcgcgaaggccgtcagcaccgcgctgtcgaaccgccagttcaaggtcaccggctgggacaattacaagggcaagaaggtcgagcgcaccacaatctatttcggcaagaacgccatcaacgaggcgtacacgctgaacacgaacttcacggacgcggtgatggtgatggatgaccgcgacgacaagctgattgacgtggtgctcggcgcctcgttcaacgatctggccaacaaggacagcctgccgagcggcgacaccgccatcgaaaacttcgagggatgcgtgcccgtccagtcaatgggcaccttgcccaaggccctcgatcatgaaaaggtggaatgacggccagcatcgtcatgacggcctgaaacccccgatattcggcggctgcctgccttacgcggacagccgccgaaccgtttcttgggcgcgtttacagcgacgcgtgccaccgcttgagctcggccaccgcggtgtcatggtcgaccggaccgttatcgagccggtattccagcatatgcttgtatgcgcggccgacctccgggccgggagcgatgccgaggatggtcatgatctcattgccgtcgatatccggccggatggcgtcgaagtcctccttctccttgagatcgcgcacgcgctgctccatctcgtccatggcggacgagaacaccatcgccttacgacggttctgagtggtcgcgtcggcgcgggtcagccggttcagccgctcatacagcggaccggcgtccttgacgtagcgtcgcacggcggaatcggtccatggttcttcgacatacccgtggaaccgcagatgcaggttcactaactcgctgacatcctcgacgagatgatggtcgaaccgcagcgccttgagccgtttgcgcgtcattttcgcgccgaccgcatcgtgatgatggaagctgaccttgccgccgggctcgaaccggcgtgttttcggcttgccgatgtcatgggtcagcgcggccaggcgaagcgtcaggtcgggagcgggcacggggccttccggcccggtctccagcgctatggcgcgatcgagcacaatcatcgtgtgctcgaacacgtccttgtggcggtggtgctcatcgatttccagctgcagggcgggaatctccgggaatacgatatcggcgagacctgattcgaccagcgcttcgacacccgccctcggacgatcggacagcaacagcttcgtgagctcgtcacgcacccgttcagcggatacgatgtcgatgcgatcggtcatgtcgctgatggcggcagccgtgtcgggggcgatgctgaacccgagctgtgcgacgaaacgcacggcacgcatcatgcgcagcgggtcgtcgtcgaaggactgatatggatccaccggcgtgcgcaatacgcctttagccaaatcgctggcgccgccgaacgggtccacaaactccagctgcggcacgcgcagcgccatggcgttcacggtgaaatcacggcgggacagatcgccttcgagcgaatcgccgtagctgacttcgggcttgcgggattcgggatcgtacgtgtcggaccggtacgtagtgatctccaccttgacttcggtgccgtcctcgcgccggcgcatcgcacccaaagtgccgaatttgcggcccatatcccagaaaccgtcacgtccccaatgacgcaggatcggctcgaactcgtcgggatgggccgacgtgcagaaatcgaggtcgtgggaacgccggtgcagcaacaggtcacgcacggggccgcccaccaacgccagctcgtacccgcgagccgcgaacaggtgtccaagttcaatggcttccggccaaacttcgaaattcacacgaggcctttccataaagtattaccgcttttatgcgtattcaagcataccgttaccccacctgcacacggtattgagtaaggtggaagtcatgattacgcccgcagacctcgcgcgcatgcttgcgcatgctgcgggcgaccatacccaaaatccgctcgaacccgatacgttgctctatacgtccgaggctccgcgcacgccgaaaaccgttgtcaggccaccggaaccacgcttccccacgcctgcgatgatgccgcagcgacgggcgggcgacgggccgaccacattcgcgtcgctggacgctcaggagctcccggtggtgcgcgaatactcggccggcggcctggtgttcgacgagcgcggccgtgtggccatcatcgcgcgacactcccgcaacggccatctcgaatggtgccttcccaagggccatatcgaaaagggcgagacgccgcagcagaccgccgtgcgcgaggtgcacgaggagaccggcattctgggtgaggtggtcgagtccattgccaccatcgactattggttcaccggtaccagccagcgcgtgcataagctcgtgcatcatttcgcgctgcgccagatcggcggcgacctgacggtggagggcgatccggatcatgaagccgaagacgccatctgggtggatttcgatgatttggatgacgttctcagctatcctaatgaacgcaagatcgcttggctctacgcaaggaaaatgaagcagggatgatcgcgaacagccccgagcacggtcaggccgtgccatcgttatctcaccgaacgacacgcctatggcgcttctttaccatcatgttgctgacatgcgcgatgctgttcgcaggccgcatggtaccggccggcccggcacatatggcgatggcggatgacgagacggacacggccacgcagacgaccgccttgtcgatcaccgaatcgacgcccgtggtcaccgacacatccggctaccacatcaccatcagcatctccaatcccacgtatgccgcgacgtcaccgggtctggtgaccgtggcctacaacccgtcatatacgttcgtatcgcgcactgacatccagcattgggcgaccggggacgtatcgattccggtgcgcaccgttctcggcacggccacggtgccgtccatcgcggcgaacaagaaggtttccgtgaagatcgacgcggcggccgacagcgatgcgttgaaggcgttgcagatgtgggggccgaaaccgctgctggtcacctatcaggcgacccaggcgaccgactctcaatccacaggctcctctgacgggtcatccgggtcggaccgtaccgtcgatccgaacaccaagccgattcgcctgcacagcttcctgaccagatcatcccagggattgcgcaacgcacagaccccgccgatggccatcaccatggtcatgccgttgatgaacaacggccagcaggccgacaagaacgccatcgaccagctggtggtgcatgacaacggcgatgaatccgacacaaaatctacacaatcaggtggcggcgtcacggatgacagcacagacgacggctccggcaacaataccgacgacaccgaaaacaccgcggcgacgcaatcatcagtgctcaccccgcacgacaatgatgcactcgccgccaaactctccctcatcggcaagcacagcgatctgcagaccatagccgatccgacggcattggcttccgacaccgggcaacgcatcgatgccgtcatgcagccggccggattcgacatcaccgcctatgccgcgatcaacaacgtccggtcgtacgaacaggccggcgtcggcaccggcgcatggaacgcacgatccgcactggccgcggcaccggcatcatccaattccctgcccatcgcctggcaaggcaagggcgattggacccggcaggcgctctccacggccaggaagcagggataccagtacgtcatcgccggtcacgacttcgactccagcaccacggccaccgtgcacacaggcacatacacaatccccacctcggccggcgacatcacggtgctgagcgagcagaaggaactcggcgacctcgtcaaaggcaagcccaccagcagtgatgcggacggcgagaccagtaacgcgggacgcatcgcgcggttcgtcgcgcagagcgccttctatcagatggagcagccgtatgcggcgatgaaccgcaacctgctggtctgcttcggcactaatatgtcggcggcgttcatcgacacgctgatgaccgcggtcgaacagtcctcatggctgcagctcaccgacctgaacgatctcattgacgcagacgcctatcggaccggcgacaaggcgctgcaaatcgtcccccaagacagtcatttaagcgagcggaacacccgatcggtcacgtccgcgctggaatcgctggccgaaagccgcaacgacatcaaccgcttcgccacgtcggtcctcaccgaccataaggcatccgcgtcctggatccgcaagatcaaggccgcacagagcacgctggcactgcatgcgctctcgtccgcgccgcgcgacatcgacagtctggtcgacggtgccaaacggctcggcggaggcatgttcggcggcgtatccatcacgccgaccgactccatcaccgtcgtcagcgaaacggccaaaatgcccgtcaccgtcaggaacaaccatccgtatccggtacgggtgaaggtctcatccctcaccgactccatggaaatcgtcacatcgcggttcactgaggtcaccataccggcgaacagcgaggcgcaggtcacgttcgccatccgcgtcgccacttccggccacgccacagcccacatcacattgctggaccgcaacggcgacacgttcggttccgcacagaacaccgacatcaccagcgtgctgcgcatcagcgacatgaccggattcatcatcatcggcttctcgctgctgctcggcctggtcggcctctggcgccaattccatcgaaagaaggaccccgacgaatgagcaccacggtaggacgcaattcgctgatcatggcgtgcggcacggccgcgtcacgtgtgaccggccagatccgcaccatcttcctcgtcggcgcgctcggtaccaccggtatcgcagccaacgcgtatcaggccggcgcgcagataccgcaggtgatcttcaacctgctgtccaccggcgtgttcaacgcggtgctcgtgccgcagatcgtgcgcacgctcaagcagaaggacgcggatgagcgactcagcaagctcatcaccttgtccatcgcgctgctgctggccatcacactgctgatggcgtccggcacgccgctgctgacgatgctgtatctcgactccagctggacgcccgcgcaaagggcgctggcgaacgccttcacgctgtggtgtatgccccagatcctgttttacggcctgtataccgtattggggcagatcctcgccgcaaaggggcgtttcgcgacgtatgcgtggagctccgtaggcgccaacgtcatcagctgcatcggtttcggcgcgttcatcatgctgttcggcaacgcgggacggcagccgatgtcgttctggacatccggcaagatagccctgaccgcgggcgcctggacggccggcgtggcgttccaggccctggtgctgttcattcctttgctgcgttgcggcatccactaccggcctcgctggggactgcatgggctggggttgcgttccatgggccaggtggcggtgtggagcatcgccatggtgctgctcaaccagctgatgggcatcgtcaattcgcgtgtcaataccggcgccccgaccgccggcggcgatttgtacggcatcgcgggcaacgcgagctatcagtacgcgtacacgatatacgttcttccctattcgatcatcgccgtgtccatcacgaccgcggtgttcccgcgcatgtcccgcgcgatcagcgagcatcgtatcggggatgcccgcgccgacctcagctcatccttgcgatccaccggtcttgcgatgttcttcttcaccgcggtcatgattgccatgccggtgccgctggtgaaggcgctgattccgtccacgaatgtgcatggggcgattctgatatccgggcctctgatcggtctgctggtgggattggtgcccaccagtgcgttcctgctggtgcagcgcgccttctacgcgtatgaggacggccgcagcccgttcctgttcgcggcggccgacaacgccgtgcagttgctgcttctgctgacctcgctgcgtttcgcaccgccgaaatattggacgctcatggtggctctgtcgctgagcctgtcatatatcatcacgttcccatgggtgttctggctgttgcgcagacgattcggtgggcggatcgacggcaagcgcatcatcatcatgcatgtcaaggccctgattgccggtgcggcggcatgcgcgtgcggactattcctcaacccgctggtcacgcgtttggtcggcgcgaaggtttccagcgtcaacggacatatgagctggtggcaatccatcgtcatatgcgcgattctgacgattgtggtgacggccgtgtatgccgggctgctatggctgatgcgcgtggaggagttctccagcctgatcgtcaccatgaaggcacggctgttgcgtaggacttccactgcgacatcggtatcgacaccggctgagtcggagaccgaggaagctcaggcacaaaacgcggaggtcgaagagggcaccacggcaattgcggagaatgataatcattacgataattattcgctgggtgacgatggaacctcggagaatgacggttccgcggaacgggccgctgaaactgtgaccgatctcgaacggccggttcagaaccagccggttcaggaccaacccagggggattccgtccgacaaccttccgcccagcttcgcgccgacggtcaaccgtaagggccaacgcccgtccatcaagtccgtcgtactgccgaacgtcgcggcaaacgcagccggtgcagcggcaggtatcgcggccggcaacaacgcccagccgcgaattcccaccatactgccaacgccgcatcattccactcgtcaagccgtgtccgtcgcggctgcacagccgaccatccccacggctagaatgtcagcatcaccactatctcagcgcatgacagcagagcacggagaaacaactactatgaagcctcaattgggagataccgtcatcggtcgctacactctcgtttcttcgctgcgcgaaagtgacggattgagcgcatggatagccaatgaccgcatgctggcgcagtcctgccagctgttcatcatcaccgacacatccgttctgccgcagatcaacgaggcggcttccacgctcgcgctggccaacagccggtactgcacgccggtgctgcagctgcagcacgtcggcgatgccgcggtggtgatcaccgagccggactccggtctggcgctggcggaatacatgcagcgttcgtcttcctcgttcctcagctacgacgcgattcgatcgatcgtgggacaatgcacccaggcggttcaggagctgttggacacggggctgacccataccgcgctgagcaccgataccattcgcgtgagcgtcaatggcgtgcagttcgccgacactcccgtcgccgccgcattggccgatatctgcagcggcatcgacggcgatgtgatgtcgtatgagcagatggcgacgcgacagctggccgcactgctgtacgcgctgctgaccaagacgccttcaggcgcgaacacgacgttcgacctgaatatgctgcccgccgacgttcccacggaattccgcgtgatctgcaagcgtggactggccctgcacaccgaagatggggaaatcatcgtgccgatggcaacgctggccgagctgagcgcgctgctgggcgcgtgggagccattcggcaacctgtcggatcgtgacatcatattgccgtcggtcagtggcagcgcctcgatcagcatggtggcgttgcgtgacacgagtgatgacaagatcgtggaactgccggatgggctggttacctcgacgaagctgccggaattgtcgatttccgaagcgggactggcagccggcgccgaggccaggttcgtcaacgagcagcgtctcgcacagcaggcgttcctggctcagctgcccggagatccaccctcggccgatcagccggtcatccccgaagcggaattgttcgaaccggataccgccgagccgtcgaagaccctggcctccctgcaatcgaaggtcggtcagcttatgggctccttgcgcaaggacggggagccggagtcgccggtgacgacatccactgcggaagagaccgcgattgagcagccgatgccggtgtatgcaccgctaccggcatcgttcccgcccgccgccaagccgcataggtccgctactggcgcgacgaaggcacaggcacagtccggcaacggcgtgaacgtaccggcaaacgctgctggtgcgtctggtgttgcgggcggtaccggcaaaccccggacgaccggtgcaaccggcgagatacagagcatcgtggccaatatgccgaatgttccgctgccggaagagaacgacaatgagcgcacccgcgccggcagcatcccgccgctgccgcagtccggtgaggcgcaggtgtctgaaggcgagcaaaccgtggctggaagccatcccacgacccgtgcggctcagcccattgccacgaacgccatgccgcagccgcgcgcgcatatgtcggaatcattggccgctcttgccgccagatccgccaaggccgcggcgtcgggcgacgccgtaatgcccccgtcattcgcagtgtcggcatcggcgcccggagccaatggagcagccatccccggatcatcgaagtcgcgtacgcggatgacggcaccaatcagccgcgatgccctgcggaacatgtctggcggccgtcctgcggcggctccgggtgcgaatgtgccgagtgtgcagacaccggcgcagcgtgcccaatccgacgcctttgatcccacggtcaccgttccgctgctaggcactgatggtacttcggtagatcagctgccgcctatggcccagatcatgccgccgagcttcgcgccccagcaggtgcacgatgtcaacgcagcgaatgtcggacgcaatatcgaggaggacctgcctgaccagccactctgggggcagctcaagatcaaggtcatcgccatcgtcgtcgcgttggttctgctggtggtgggattggtcgccgcatggttcatcctgaacggagacaaccacggtggcggatccgacaatcaggattggccgaacaagaccgacatcgataacgtcccgttcggcaactcgaccacacagaactccacgtcaaagaactctgcggcacaatccgacatcgtgtacatccgcgttctgtaggcgacgcagaagttctcataggcgccccttctactcacgggcaggaggggtgtttcatcgtacgcggtgactcacgctgtggacttatgctgtgggcccgtatcgtgctcgtattagctcctccggtttccataaacacggcatgcctgtttcggcaatctgaaagcgaccaatcggcattcgaggcgaatccatgtcgttgttcacccaccgctggacgaggtcaggtcaactcgctatcgtaaggggcatgactgaactttcaaccatcatcatcggttccggccctgccggatatacggccgcaatctacctcgcacgcgccgggtatcgcccgaccattcttgcgggtgagctcacgccgggcggtcagctggtcaacaccaccaccgtggagaattaccccggtttccctgacggcattctcggaccggaactgatggatcgtatgcgcgatcaggcggagtctttcggcgcatccatcgaatatctcgatgtgacgagcgtcgatttcagctcctcccccaagaccgtcacgtgcagcgatggaagccaatatcacgccgatgccgtcatcatcaccaccggttcacagtaccgcaagctcggcattcccggcgaggccgagtattccggtcacggcgtatcgtattgcgccacctgcgatggtttcttcttcaaggacaagcccatcgtcgtggtgggcggaggagacagcgcgctcgaagaggcactgttcctgactcgtttcggctcttcggtgaccgtgttgcaccgccgcgaccagttccgcgcctccaagatcatggtcgagcgcgtgctgaacaatcccaagatcaccgtgaaaatgaatacggtggcgacagccattcgcgggcagaaaaacgccgccggcgtgcagacaggtgctgatgcggtaaccgctgcagcacccgcagcgcagaacaccggaaatcttctctcgttgaagacgactccgatgctgaatgtctccggatcggcattgaatgctccctcttcgaccggcatttccctgtcggcaaaggctgaaaccgcagatgattccgccggctttgtggacattcgcgacaccgtgacaggcgagacgggcacgttgcccgccgagggcatcttcgtggcgatcggccatgaaccggccacgcgttttgcgaagggttccgtggatatggatgacgacgggtacattctggtctccggtgccggaacgcatacttccgtgcctggagtgttcgccgccggtgactgcgttgaccgggtgtaccgtcaggccatcagtgccgcaggcatgggatgccgcgccgcgctggacgcacaatcctacctggcctcactgcactgatccaacagcacagctcgacctgtcagcgaaatcaaacctcatcacagacgatgatattgcttcaccggcgggttgagctacacaaatattgcttgcattgtcagtaatcacaaacgaaacgacagactgaccgaaatagcgctgcggacgcttaccagcgccggagaatcgcatcagaacgacaatccgctcaaatctagcgcattgtactggaccgatttcaactcatattgctcaacagagttttcggtaatgaattttcaggtgcatgcaataggacagttatacgtgcggttcattgcattagtcctctgactgcaaatgccacgacagttgctttatacgcgttctgccggagaggcaatgaatacctctcggcagaccagatcatacagctcatgaacggcatgaccgttgtttcccgttgtgtgatgatggcggctcacaccgttgtgtggctcgcaacctcacacccattttgccgccgcgccctcgactgccgtgggaatcagcatgctgaggatgcgttccatatcctcaggggaggaaaacacgatttcgattcgaccgtgcttttgcgtacccttgatggacactttggtgtcaaaatgattttcaaggttgttgacaatcggagaaccggcccaaggattgttcttcgtcggccttaccttcttgggcacgttgctttctgcgttcttcagcgccacgatttcctcggtgctgcgaaccgaaagcccctcccctatgattcgagtggccagcttgtcgatttcactttcgtcattcaaaccaagaagagctcgcgcatgccctgcggacagtacgcctgcggcaactttcttctgcacggacgcaggaagatgcagcagccgcaatgtgttcgcgatttgcggtcgagatttcgagatcgacttggatagttcagcctgagtcaggccaaagtcatcaatcatctgctgatatgccgccgcctcttccagaggattcagtgcgacgcgatgaaggttctccagcagtgcatcacgcagcatctcgtcatctgatgtggttttgacaatcgccggaatcgtcttcagttgtgcaagttgtgatgcacgccagcgacgctcgcccataatgagctcgtatttctgcgatgtttcacgtgaaacatcactcttgctggactccccagcctgacgcttgcgaaccacgatcggctgcaatacgccgacttccttgatggacgcggccaactcattcagctcttcctcatcaaagacgctgcgcggctgctgcgcattcggaacgatggagctgacaggaatatccagcagatagccaccctcgacaggcttcaattttggagtttccttattatccttttccttgccggatgcctttgtgctctcggaacgctgagccggctgcgttttcttggaatcgctcgtcccctgtgctgttgctccgaaaaacatgtcactggggtgtgccatatcactgataccgggcatggcaacacgcttgccgctcttgggcttctccaccgttgtggacttgtgtacggcaggaatggaatccttcatggccggaatggtcttacgcttgatttcgccaagacgaaccggagcggtagactcactgtgttgttcagtaccgctcttatgggattcgaccttctctggcgcagccgcagctttctcttgaggggctttcttgttggctgtcgtctcctcggattcgagatcaacacccaattgctgctgttccgcatgagctgttctcgactcaccgggaagtgcggggaacagcgcacccaatcctttacccaaacgtgattttgaggtcatgggttactctcccctcttcgcgtcaattgcagccagcaccgaaggcgatcgacgggcgatttccaaggccgcttcgccataggcactcgctcccattccacgcgggtcatagctaatgactgtctttccgaaacttggagcctcagatatttttaccgtacggggaatcgtcgtatccagaacgatactcggatagtgactcttcacctctgagaacacttccctgctgagcaatgttcgtttatcaaacatagtgaccagcatagtcgacacagtcaaattagggttatagtgctcctgcaccaatcctatggtattgataagttgaccaagcccctccaaggcatagtattcagcttggatcggaatcaacatctcagacaccgcgcacatggagttgatgaccaacaggccaagactcggcgggcaatcgaccagaacatagtcataatgattgttcggatcctgcaggaatgattcgacggcttccttcagcagattgttgcgattcggcagatccgccacttccagttccgcacccgaaagttcaatggaagcgggaaccacatcgagccctgggatatcaggacaggttttcagtacctctccgattgtcattcgtccttcaagaacgtcatataccgaaggatcgctggtgccgtgaggaacaccgcatgccgtagaggcgttcccctggggatccatatcgatgaccagcacgtgagctccatgagaggcgagagctgcggcaatattcaccgttgttgttgtcttgccgacgccgcctttctggttggcgacggccaggcatcgggttctcgatggcagggggaacaatgcggcattcaggcgttcatagcgtgacgcctcatctgcaatctcggcacccaaagaggaaccatcattcccgaaaatccttctgaccgtttcagaagcagattccatggcaggaatcgcagaggattcctgtgaatcattggatgtcatagtccctcctaaaaaacgaacaacatctaatttttcctagtcgtatggacatctcaagttgtgcacagcaatgtggataactgtggataagtatagtgcattagtgtgtgaacacttcgatcaacactagataaaccgtttatttccgccattttcttaatgtggattacatgtcgcaaataatgtggataactttgtgcactgtttgaagttgtggataactccattcttgcgaaaccatcgctttcgtgtttgacattcattgtttcacgtgaaacaatcttcggacagtcagcgatgtcgatgagatataacagtattatttatgcgttcaaaggcaatggatatcgtccgtctcgccccgcaatccaacctccgacagcggaagcagaattacgattcccgtcagcgggagcatgggattatcgtgtgactctcacccatgggagccacacgataattagcgcttgtctacgagaacgacgtgcgtggattcgagaccgggagctactggagcttcaacgacacgagcacgcactcccctggcatgggaaatttgatgcttcgccttttcaatctcagcctgcgccgaacggcctttcaatgcgaccagtcgaccttgagggcgaagcagaggcaacgtccaaccggcaagcttggtcattggcgccactgctcgacaggtcactacagagaatggtttcaattcaccttcgtggtgcttgatacgatcgatgacttcgtcggaacgtgcgcgaataatcgtaacattctgcaggtccatgtcatccacgcactcttgcaaccattcgacacgacgttccatgggctcaatgagtgtaaactcacaatccggcatgcatgctgccgcaacgattccagggaaaccgccgccactgccgacatcggcaatggtctttgccttgcttcgatcggtgacttcccgaatgaacgggacgcatgcggcggagttgaggatatgacgttcccagatgatggatatgtcgcgtgggcctatcaatccacgcagctcaccctcgcgggatagtttcacgtgaaacacttcgagtttgtcgtatgcttcgcccaatgcctcacgaactattgcggaatcatccagctcatcaccagatgtttcacgtgaaacaatatcgctcactcttcgctaccttcatcgacgtcggattcatcggcgctgctcttcatgtagatggtgacatagcgacgcggctcttcaccgtgagaacgagacttcagcccctcctcgcgaaccacatcatgaatgaccttgcgctcgaacgaattcatcggtttcaaatcaacgggctcaccggtgtcatgcacttcatcaatggcatcaagcgcaatgtcacgaagacgctgacgcttgcgcttcaggaacccgtcaacatcaacaatcagatgcgagcgttcgccggtcttctgctgaacagcaagccgggtaagctgctgcaaagcatcgaccacttcaccattgcaaccaatgagatgcttgatatccgtatcgtcatcagcgacgatctgcaccatcggacgaccgttgcgaacacccatctcgatatcgccttcgtaatcggcgatgtccaataagccttccaagtagtcggcggcgatgtcagcttcttcattgagctgatcgatcgtcgtggtctcctcctgcgccatatcaccactcctttaagcgagtattacttccatagtgtaaaaaaaggaaacctcacggtcaaatgaggtttccaatcgtgtcacttcttcttgcgattcttccgctggggctgcttgcgctggtatccccgctccagacgagcagcggcttcctgacgtgccttctccagttcctcttcctcaatcgaaagctgtccggccttggcgcgacgagcattctcctgacgatgatctcgaatctccttttcctcagctgcacgggaacccggggtcgggaacttgtacacctggaacaaggaacgggcaaggttgcatgcgttgttggtcagccagtacaccagcacggcgaacgggaacatgatgccggagaagatgtacatgatcgggaagccccaggtcatggcctgctgcatcttgtacgtggatccctgcatcgaagccttggggaggttcttgcgcatgttgttgaactgcatgtaccacatgcatgcgcacatcaacaggatgaagaagccgatgacgacctttccggaattgttggccgtaccgaaggtatcggtgacgctgacaccgaagacgcgggtttgcgcgaactgctcggcggtcgcctgatcgaatgcgccaagcgctcccctcttgccggtcgcgatatacggaatggcggaaagcatgtagaacatgcacatgaacacaggaccctgaatgacggcggtccaacacgaccccatggggttggcgtcattgtcctggtagagcttcatcatctcacggctcatggcctctttgctggcctgatcctttttacccttgtacttgttctgaatatgctgcatcttgggctgcaaggcctgcatcttgcgcatcgacttcatctgcttgagataaatcggcaaaatacaggcgtgcaccacgagcacaaggaacacgatcgccagcacccaagaaatgccgatcggtgccatgcccagcagggtgaggaacttatggaacaggaccatgacctgagtcatgagccactcaagtggggtcagcagcttatacagccagccccaaatgcctctgtcaagaagaaattctccggaagtgttcatcaggccatctccttaatcatcggccattggtgtgagtcgaggcctctcatatgccttcgaccagcgaaatctgtagcacagtgaaaaatgttgcggaacatcatcgatgccgccacgactccaagggttgcagcgaagaaaacgccaaataaacagcacgattcctcttaccgcgccgaagcgccgaaccgcagtgatcgcgtaatgtgagcaactcggatagtacttgcagcatggcggcgttttcgccgaaatggccctctggtaccacttgatcatgccgataagcgccgatccgatggctgacatcagtgactcaccctgcgttcatgcgtagtcgtgactttggcgaagcaacgggaaaactgtcggtcaaggtcagcgaaatcgacacgcgatgcgctgggtttggctctcacgacgatatcgcactgcatcggaagcatatcttcatatcgtcttgcgagcacacgaaatcgacgcttcacacgattacgcgttacagcgttaccaacagccttgctgacggcaagtcccatacgtctcatgatatccgcagatgcctgaacatcacgggtatcgtcatgcaccacaaagtgcacgacgatatccgaatccgtcaccttgaagcgacgcttcagcactgcgatgaagtcacgatggcttttcagccgcttcactcgccttcgtcacctaccgcaatcaggcggacagagacttacgtcccttgttacggcggcggttgatcatcgcgcggccggaacgggtgcgcatgcgcacgcggaaaccatgcttcatcgagcgacggcggttgttgggctggaatgtcctcttcatagttatgctcccggtttttgccatgctgatgcacggctctcatgagtcaagctctataacggtactctgagccatgcccaaaaatcaaaatgaaaacaatttcttcacgatttatcagtgtgtcgtgccccttgcagagcagcggaaaacattggaaacacgccaaaacatgtagaaaagttatccacaaattacatgaatgttattcacaattgaggcgacacaacacgctaagctgtggataacttggctaaagtggagtacatatatcctgttgttgttgtacttattatagctaccgtagcgcatccgctgcggtgcgcaccggcacacatacctgaaggaggtcacaatgtcggatgaccttctcggtccagccgggcaagccacgcggatatggtcggacacgctgcgtctgctcaagcagaatcccacgctgtcgccgcgcgacaagagctggcttgaaggagtcgtaccggaagcggtatatggcacgaccatcgtattgtgcgtaagcaacatggccacgcagcaagcgttgcagaatgaactcaatgcgccgctgctcaacgctttgaaaatcatatccggaaacgacatgttcccggcgttcaaaatcgtggctcctcaggtgtcccaaccggaaccgcagccgccggaataccggcatcccgatactgcggcgaaaccgagcgaaccattccctgcgaatccgtcgccgaccgtcgccgatctggctcaggaatcctacatgcccaacagcatgcagtcaatctcctccatcgattcgatttccgcggaaatgacggaggcgaatcagcaaccaggcgccacggctcctcgaatacccggcgagccgagttttccggtacggcagcagaaggtgatgcgcgatccggaaacccatctgaacaaaaactcgacgttcgacacgttcgttcccggtgattccaaccgtttcgcacgcactgtcgcgcttgcggtcgccgagggaaccgggcaggaattcaacccgttgtgtatctacggcggatcgggactgggcaagacccacctgctcaacgccatcggcaactatgcattggtcaaggatcccacgctcaaggtccgatacgtcaacagcgaggaattcaccaacgaattcatcgaggcactgcagaccccggcccagagccagaaccgtatcgccgaattcaaccgccgataccgcgaggtcgacgtgttgctcatcgacgacatccagttcctcggcggcaaggaagcgaccctcgaacagttcttccacacgttcaacgcgctgcatcaggccaacaagcgtatcgtcatcgcgtccgatgtcgcgcccaagaacctcaagggcttcgaggcacgactcatctcgcgtttcgactccggactcaccgtcgatgtcaagccgcctgatcttgagacccgcatcgctattttgcgcatgatggcttcgatgaacggcacttcgacaccgaatgacgtgctgaatctgatcgcggagcgcttcaccgagaacatccgcgagctggaaggcgccctgattcgcgtgagcgcggtggcatcgttgagcagtcagccggtgacccgtgcgcttgccgagcagacgctgcaggacttcttcaccaccgacgtggaaatcaagccgaccgacatcatcgggcagacggcgaagtacttccatctgacattcgacgacatcgtcgggcgcgcgcgaacgaaaaacatcgcgctggcccgtcaggtcgccatgtatcttgcccgtgagatgaccagcatgagcctggtcgatatcggcgaagtgttcggcggccgcgatcacaccacggtcatgcacgcgtatacccgcgtcagcgatgatatgcaggaaaagcctgaaatttacaactacgtgaccgagctgaccgcgcgcctcaagcagcgcggcaatgagtgacgacagtcgttttctctcggctgtgcaatggtcccgtctggcacgatcgcgctgagacaccaaaaaacgccttttttcgtcgctgtgcgtgattctgctggatgaaggcctgattcgtcaccgtcgacaggacctatcagactcaaataatatagacatacatatttaatctgtacaataaaacaggcgcaacacgccgaacgatctgctgattgaaggaaaagttatccacatgcttattcacaaatgtgggtagagcctgcggataacttgtggactactgcacattttttgtggatgaacagtggattaatccacaggaaatgtggacaatcaaaatagttcgccgaaaatgtggataactcggtacttatgcacattttgtccggaaagttatccacataatctgtgggttactcagcccatataaacacaaggattcgcgcagttatccacactatccacagggcttattactacgactatcttatttctctttcgataaccgtcgtgatgataactcacttcgcgcatgagaaaaacaatccgaacatgacccgctagaatgttgccaagcacatcgtgaaatgagggaacccatgaaagtagaaatcgattccgcggctctcgccgacgccgtagcttggacgacccgcgtcatcgacgcccgaccggcgagccccatccttgcaggtatccagctcgaagccatcgacggcacccttcaactgtccgcgttcaattacgagatttccgcacgtcaccacatcgaagccggtatcgacgaacccggaaccgcactggtactcggcaaactcctcgccgacatcaccaagtcactgcctgccgaaaagacttacctgtcgaccgacggctccaccatgaccatcaactcgggcaagtccacgttcaccatgcagctcatgcccgatgccgaatacccggatctgccggtcgtaccggcaaagctcggccaggtcgacgcacccacgttcatccaggccgtaactcaggccagtgtcgcggtctcccgcgaggagaaccgcccggtgctgaccggcgtgcgcatgcagttcgacggcgacaaagtcaccatgacctcgacagaccgtttccgcctgtcccgcgccacgttcacctggacgccgcagaacatcgacacctctacgaccacactggtgcgcggatccctgctgcgcgacgtcgcccgcgcgcttgacgatcaccagaacgtcgtcatcgatttcgacgccgacaaccccacgctgctcggtttcgagaacgccggacgcgtctcgacatctcagctgatcgacggcgaattccctgcggtcgaccgcctgttcgccgacgaatacccgattcaggccgtcatcgacaagcagctgctgatcgccgccatcaagcgcgtcgcgctggtcgccgaacgcaacgccccgatccgcatggtgttctccggccaggaagtcaccctgtccgccggcgccgtggacgaagcccaggcgcaggaaatgctggacatcgacatggacggcgaggacatcaccgtcgcgttcaacccgtcctacctgatcgaaggcctgagcgccatcactgagccgttcgtgcgcatgaagatgaccacggccgtcaagcccgtcgaattcaacggccagcaggaggcggacagcgacgaatcgatggattaccgctatctgctcgtcccgatgcgtttcaacagctgagcccgacggctgaacactggaatccgaatcgaatcgccggcaccgccgaaacacacggtgccggcgatgacatgacaggagcccatcttgtacatttcgcgtcttgcgcttgaccattaccggtcatggaaccattgcgtgctcgacctcacgccgggcatcaacatcctgcagggggcgaacgggcttgggaaaaccaacatcgtcgaagcgatagaagtgctgtccacgggcctgagccatcgcacatccagctcggttccactggtgcagcgcggcgaacatgcagcgacgatccgggccaatatcgaatccgtgacggatccggagcccgctgatgagggcgtcaataccagcgctgatgccgtggatatctcggacatgaaaccggtccggcagacacagaccaccacccttgaggccacgattgcggcacgcggcgccaaccgcgcccgcatcaacggcgggcagtcgcggtatctgcgggagattctcggcacgctgccgaccgtgagcttcaccccggaggatcagcagcttgtggcgggcgaccccgccgtgcgccgctcgttcatcaaccaggtcgcctcgctgctgattcccggatatgcgaaccggttgcaatcattcacgcacgtcgccaagcaacgggcggcactgctcaaacagctcggtcaatggcagcgtgcaggatccccgattgacgccgcgctcagcgggctggagatctggaccggacagttcatcgaggcgggagtcgcgctcagccgcgacaggcagcgcatcatcgcggaactgaacaagtcgttcggcccgctgtatgccagattggccggtgtggcgggcgacttgccgtccaatgcggaaattcaggatgccgcgcaggatggtggtgagcaggcagcggtcgaatacgtgccgtcattcgacgagatccttggaacacaggcgcccgaaccgttgataagccagcatttccagcgcatctatcccggcgaggtgtctcgcggcgtcaatctgatcggcccgcaacgagatgacctgttggtgacgctcaatggcatgccggccagggaattcgcctccaacggcgagatgtggacgttggccctggcattgaagatggcacaataccgggccctctgcgagtatttcgacaccaggccggtggtgattctcgacgatgtgttcgctcagctcgacgaatcgcgccgcaccgagatcctgcgttttgccgcggctcaggatcaggtactgatcaccgcggccgcggaaagcgatattccgatactgccggcgaatgagtcgacagaatccggcgagataccggtgaaccgcatcgcagtggccgatctcaaacggcgcgacgaagcggatgccgagagggccggcgaacaatgaccgaaccccgcaagccgaatacgccgggcgggccgggggcaccgagcaggcccgacaagccgggcagcgcggtcaagccgggcaatgtacacgattcgcacgagccgatttgcgcgaccctgcatctcgaccagcgcaaactgcccgccacggtgttcgagcacatcgccaagatggcgggaggaaggcgtcagcggatgattgacgccgaggccgcatgggagaacttcggcaagccgggccgcgacccgagcaccttgggcagcgtaacggcgctgattgcgaataacggtcattggataccgtatctgaaaatcgcgcagctgcgcaatcactgggatcaggtggtcggaccggtcatcgcccagcattcgcaggtcatcgggctgcgcgacggagtcatgaccatccgtgccgattccgcggcttgggccacccagctcacctacctgattccgcagctggaacgtaccatcaaggagcgcctgcaggggttggacgtccacaagatccaggtaacaggcccccgtgccgcgacatttcgcggctcaaggatgaagaggcgctaaattcgctcagagagccaaagtccccgtagacgggtaggattggcggataataggttcagcgcttagaaaccccgttattcgcgttttagagcgtatcgcccgcagaacaacctttcatgacgaaagaatatgcaggaaggaaaccgttagtggcagttcttgaatcggattccgaacatgaatcccgtgacgagtccggcatgcctgagcaggctccgggcagcggtctgacggcgagcagcgccgagcagcatgaccgcgaggtcgatgaagccatcgcccaggacgagctcgatgacgcccagcttgacgacaccttatcgcccgaccattatgacgccagcgacctgaaggtgctggaaggccttgaggcggtgcgcatccgcccgggcatgtacatcggctccaccggcccgcgcggtctgcaccacctggtctacgagatcgtcgacaactccgtcgacgaggcactggccggctacgccacgcatatcgaagtgacgatcctgccggacaacggcatccgcgtcgttgacgacggtcgaggcatcccggtcgacgaagttcccggcgaaggcgtctccggcgtcgagaccgtgatgaccaagctgcacgccggcggtaaattcggcggcggcggatacgcggtgtccggcggccttcacggtgtcggcatctccgtggtcaatgcgctgtcgacgcgagtcgatatcgaagtgcggcgccagggattccactggacccagacatacgtcaatcagcatccgacggcccgcctcgccaagggcgccccgatggccgaggatgagtcgaccggcacttccgtgacgttctggcccgatgcggcgatcttcgaaagcacggtatacgacttcgagacgctgcgctcccgcttccagcagatggcgttcctgaacaagggactgaagatttcactcaccgacctgcgcgagccggatctggccggcgacgaagtggccggcgatgacgattccaccgagccgaagcaccagagcgtgacttaccagtacatgaacggcatcaaggattatgtctcgtacctggtcaagtcccgcaaggccactcccgtcgaggaggatgtcatcgatttcgaggccgaagacctcaagatcggcatctcggccgaggtcgcgatgcagtggaccaccgcgtattccgaggctgtgcacacgttcgcgaacacgatctccaccacagagggcggcacgcacgaagaaggcttccgtgcagcgctgacctcgctggtgaaccggtatgcgcgagacaagaacatcctcaaggagaaggatgacaacctctccggcgacgatgtgcgcgaaggcctgaccgccgtcgtgtccgtcaagctgaccactcctcagttcgaagggcagacgaagaccaagctcggcaactccgaggcgaagaccttcgtgcagcgcgtgatgaccgacaagctcggcgactggttcgacgcgcaccccgcagaggccaagaacatcatccagaaggccatcgaagcctcccgcgcccgcatcgcggcgaagaaagcccgcgagaacacccggcgcaagtcgattttcgagtcggccggcatgcccgacaagctcaaggactgccagtccagcaaccccgaagagtgcgagctgttcatcgtcgagggtgattcggcaggcggctccgccattcaagggcgaaacccggaaacgcaggctatcctgccgcttcgaggcaagattctcaacaccgaacgcgcctccatcgaccgcatgatgaagtccgacaccatcgagtcgctgatcaccgcggtcggtggcggctatggcgaggaattcgacgtgagcaaggtgcgctaccacaaggtcatcatcatggccgatgcagatgtggacggtgcccatatcgccacgctgaacctgacgctgttcttccgttacatgcgaccgatgatcaccgcaggatacgtgtatgtggccatgcctccgctgtaccgtctcaagtggacgcgcggcgatcatgattacgtgtacaccgaccgcgaacgcgacgagaaactcgcccaaggcaaggccgcaggccggcagctgcccaagggcgaaggcatccagcgctacaagggtctgggcgagatgacctaccaggagctgtgggagaccaccatggatcctgagcaccgcatcctgaagcagattcacatcgaggatgccgcggcagcggacgagaccttctcgatgctgatgggcgacgacgtggaaccgcgccgtcttttcatccaacgcaatgccaaggatgtgcgtttcatcgacgcttaaggttctaatccaagccccgccggcgggggggggctgtcagcgcagctgactgggggtggtcccgatccacccgatgacagcgacagaaacgacgtccaacatacggtcgaacagaatttaaccaaaggacaaccaagtggcagacgaaaacagcaacggcaccgacctgccggagcagaacgacgagcgtgccgaacactcgatggagcccatcagccctcaggccaacgaacagttggtcctcgacgacaatcgcgtggcccacaccgacatccagaaggagatgcgtcagtcgtacctcgactatgccatctccgtcatcgtcgaacgagcccttccggatgtgcgcgacggcatgaagccggtgcaccgccgcatcgtgtacgcgatgtatgacggcggctaccgtcctgatcgcggctattccaagtgcgcccgacccgtcgccgacgtgatgggcaactaccacccacacggcgacgctgcgatctacgattcgctggtgcgcatggcccagccgtggtcgatgcgatacacgctggtcgacgggcagggcaacttcggctcggccggtgacgacccgcccgcagccatgcgttacaccgagtgccgcatgatgccgcttgcgatggaaatggtgcgagacatcgacaaggacaccgtcgacttcgtgcccaactacgatggccgtacgcaggaacccaccgtgttgcccgcgcgcttcccgaacctgctggccaacggctcgtccggtatcgccgtcggcatggcgaccaacattccgccgcacaacatgcgcgagctggcggaaggcgtgcattggacgctcgatcatcccgaagcgagccgtgaagagctgctgaacgcactcatcggcatcatcaagggaccggacttcccgaccggtgccacgatcctcggccacaagggcatcgagcaggcgtaccgcaccggccgcggcctgattacgatgcgcgcggtggtcaacaccgaggagatcaagggccgtatgtgcctggtggtcaccgagctgccgtatcaggtgaatcccgaccgtctggccgcttccatccgagaaggcgtgcgcgacggcaagatccagggcatcgccgacatgcgcgacgagacgtcgggccgtaccggccagcgactcgtgctcgtgctcaagcgcgacgccgtgccgaaggtcgtgctcaacaacctgtacaagcactcccagctgcagcaaacgttcggtgcgaacatgctcgcgctggtcgacggcgtgccgcgcacgctgagcctcgacgccttcatccgccattgggtgaaccaccagctcgaagtcatcgaacgccgtacccgttacctcaagcgcgaggccgaggaacgcgaccacatcctgcagggcctgctcaaggccatggacgccatcgacgaggtcatccgcctcatccgctccagccagggccgcgaggacgcccggccgaagctgatggagttccttgacatcgatcaggtgcaggccgacgccatcctttccatgcagctggttcgactggccaacatggaacgccagaagatcatcgacgagcatgaggaactcatgcgcaagattgccgactacaacgacatcctcgccaagccggaacgccagcgtacgatcgtcggcgacgagctcgacgagatcgtcgcgaaatacggtgacgaacgtcgcacgaagatcctcccctactcgggcgagatgaacgtcgaagacctgatcgccgaggagaacgtggtggtcaccgtcacgcactccggcttcatcaagcgcaccaaggccaacgaataccgtgcacagcatcgcggcggcaagggcatcaagggcgccaagctgcgtgaggatgacgtggtggatcacttcttcctcacgtccacgcataactggctgctgttcttcaccaataagggccgcgtctaccgcatcaaggcgtacgagctgcccgaaggctcgcgcgattccaagggccagcacgtggcgaacctgctgcagttcggtcccgacgagacgattcagaccgtgctgtcgattccgaactacgaggtcgccaagtatctggtgcttgccacccgcaccggcaaggtcaagaagaccgcgctggccgagtacgattcgccgcgtcagggcggactcatcgcggttcgtctcgcggccgacgaggagaccggcgagcccacggacgagctgatcggcgccgcgctgtgcaacgccgcagacgacatcatcctcgtctccaagcagggcatgagtctcaagttcgcggcggacaacgaccagctgcgtccgatgggacgccagaccgccggcgtgcagggcatgaagttccgcggggatgacgaactgctcgccatggacgtggttccggaggactccaagcaggacctgctcgtggtcaccaatgagggcttcgccaagcgcaccgcgatcagcgaataccgactgcaggggcgtaacggcttcggcgtcaaggcggtacagctcgccgaaggtcgcggatcgctggtcggtgccctgatcgtaagcgaagacgatcaggtcatggcgatcatgaagtccggcaaagtgatccgttccaacgtcaccgaggtcaagcgcaccggccgcaccacgcagggcgtgacgctcgctaagcccgacaagggcgacgagattatctccatcgcccgcaacgaggaaaccggcgaagacgaagtcgagacgacggatgatacggctgcggccgcatccgcgaccacgtctcccgatacggccgaaaacactccggataccgcggatagcgtcgcatccggcagtgattcgggcgcggcatctgacgagaatgtgaacaacactgatgacgaggcataatcgtctcagaaaactggtagcctcggctaagagtcatcggggaacgacaaggagcaacgatgagtgacaacctcgaacccggacggaccgacatgttcgtgcccggtccgcatgacaatgcagaaccgcacgaaggtgtccgcgaaagcgcccctcgggtcgcgcgctctatttccaaccagccgcagtcggagagcgagccgcgcgccaacaaaacgcgtgcgtccctgcgttcaccgcgccgttcgacgccgcgcgcccgccgcatgaacctgtcgctgacccatgtgaacgcatggtccgtggcgaaggtgacgttcatgctgtcaatcgccggcgcgatcatcgaagtgcttgccgccgccctggtctggctgctgcttgacgcggtcggcgtgttcgaccagctgaacaatatcgtctcgtccaccggtctggccgccgacagcctgaacctgtccagcgtgttcagcctgtccacggtactgtcggtggtcaccattctggcgatcgtcggcgtcgtgctggtgacgctccttgccaccatcatcgcgctgctgtacaacgtgatcagcgcgcttgtcggcggcgtacatatcactctgggcgacgactgatccaatcgaatccctgatacatcccgttacgaaccccgcggaggcaacgcccgcggggtttgtatatctcatcatcgccggcgcaggaaaagactacaccgccgcttcgtggaagccgtccgctcaggccttcaggaggccaaggttcgtggcgttgccgctgattggcgacagcgccacatgaccgcgttgccggcgcgggttgtcagcacatgacgacgaataatgggagttcccgatgatcgggagcccccattatgttgttgataggaaaatcacgctctcaaaactcgcagatacagaccatttctgttgaattcggccctgtatctgcgagttttgagagcgtgagctcgcgataatcaggccgtgaacctcaccgaagcccatgtgaccggtggcaacgaaacagtcatccgaccctcatcaagcgcggcggatagcggctgcaaggtgacgccgtccggctcgtcggccgtattggtgcggtagatatcgtcgctgtgcagcatctgcgagctggtgacggacggccactcccccagcctaggcaacgatgtcaggccgattgtcacatcatgggcgttgtgctcgtcacggttgacgagcagaatcatgccttcgcgagtcttttaatcccaagtggccaccgcgaccgtgaagagccgtaaggccggcagcggcaccggttccgcatgggcacagtacacggacgagctcgccaccgcatcgaccaccgccgatatgaaggctggtgagccgcagtacgtgaccaccacgttcaccgtgcccgccgacgccgcgcctgaaggcgctctgtggctgagcttctccgacatgggtctcgccgatgacgccaacggctacatcgacgatgtggtgctcgtccgctccgactccaagccgacgctgaagaccaccgcgttcacgccgaccgtcgccgagggtgaaaccgcctccgcatacgtggagctcgacggtcagcccgccgccaaggaggtctccgccaacaagaacgcaaccgtcgacgaagtggccaccgcactgaaaacctcaccgccgcacagaacgccctggccgagaagccgaagccggcgaccgtcgaatcgatcaaggtggccgcgaagcccgccaagaccgagtacacggtcggcgacacgttctccgccgatggtctgaaggtcgtcaaggtcatgtccgacaagaccgaaccgggcaagaagcctggcgcgcagaagcctgccggtcagcagaacgtctgtccaagaccggtgcctcggtggctggcgtggccggtttgcgtgcctaagtgcgcgccgaaacgacgatcgtgcgcacttaagaacgcaaacagagccatttgcgttcttatgttcgcgcacttgtcgtttcgacgcgcacataggaacgcaaaccggccgtacctgctgctgttgcgttgctgtgccgtcacgccgttgtgccgtcacgatgtcgctgccgtccggggaacgtcgaaagacgcgaaacggtcctgcgcaaatcatgtcacagacccgtttctcaatgccggaccacgccggttaaatccgtgatccgcgaaaacccgcgaaaatcagcggtgggtggtgccctcgtaggtgtcgctccacgtcagcgacgccacgccatcggcgatagaaatcggcatctgtacgatcggcgagttgccgaggtcatgctcctgccagcggtcgccgatgaacaggaagtgctcgctgttgtacgggtcgtcgtccagcggcaccacgatatcgacctgcgaatcgtaggtcttcgcaccttccggcgcgaacagcttccactcgctccacgggccgtgcaggtcggtggcggtggagtacttgttgtcgttggtgtcccagctggtcagttgcgagccgaaccagtagtacaggccgtccttcttgatgatggtcggcgattccaggccgtatgggtagtcggtggcacgctcgcaggcgacgtcctcgacgatggtgaggtagtcgtcggcgagacggtaaatgtgcgtgccatggtcgcggtcctcgctcatgatgtagccgctgccgtcctcgtcctggaagacgccgatgtcacggctcaggtagccgcgccacgtgatggtggtctggaatgcgaacggaccggtcggggcgtcggccacggcgacgccgatgtgcgcgtatccgtagtcgggcgtttcggcatgaatatacatgacatatttgccggtggcggggcaatgcagcaccttcggccgctcgccgatacggtcggcggcgagggcggagccgtcttcttgcacatcaagtacgatgccgtggctgcgccatgcgatgaaatcggtggttgtataacagcacacgccctggaacaaattgccgtttaccttgttctcgccatatgcataccaggtgtcgccgaatttctgcagaccgatgccgtgcagctgggcaacgtcgcccgaggtgtcgtgaggcagaaaagctccgaatctatcagccatgatttcccctttcgtgatgatctgctgttgattatctgtcgtgtccgcaactgcttgtgaccggttacagactgaaccattgtatcgtgaaaactatgccgacatacggaagaatcggagtgcgcccggcggtggcgctccggcaacggccgcgtggggtcgtgcgttgcaatatgaggctctcaaaattcgcagatacaagggactatttgttattttcgccctgtatctgcgagttttgagagcgtggttcttccgggatcacgccgattggcgctccacgatggtcgtcggcagcagctgcacgtaatgcggctccacgatgtcgccttgcagcatggacagcaacagccgcgacatcgtctcgccgtgcagctgcgaatcctgccgcacggtggtcagcttcgggttcgccagcagggcgattggcgaatcgtcgaatcccgtgaccgcgatgtcgtccggcacccgatacccgaaccggttcaactggttgatgacgcccagcgcgatgctgtcgttggcgcacacgaatccgtccagctcgtcaagcatgggttggaactcgaccacggccatttcgccgctggtgccctcccagtcgtccgcgtagtagacgtggcgctcgttgaaccggtcacccatcgccgccttgaagccgtcgaagcggttgttcgacgatggtgagtatccggggccgcacacgtacaccagcttggtcctcccctggtcgagcaggtagcgcgtgatgtcgcgctgcccctcggtgttggtgaagtccacggccgggaacggcaggttctcgcgttctctgacttccgagaggaccaccggccgcttgaccgatgcgaacgtgttggcgagcatgccgtcctcgctcagtgagaacagcaggtacccgtccgaaaagtcgctttgcaccagctgcgcgatgcggcgcgtggagtcctcgctgttggcgatcagcgtgaccatctggtagcccgcgtcgccgaggacctggttggcgccggccatcgcccttgacatactggcctgcgcgatggtctcgttcgattcgacctggatgatcagcgcgacggtgagtgtgcggcgttgcgcgagtgagcgtgcggcgttgttcggcgtgtactgtgatttggtgatggctgctgcgatgcgttcggctgcgtcctgcgagacgtgggtgttgccgttcagataccgggagaccgttccgtacgatactcccgcgagacgggcgacgtcgcggatggtcggctttttctgtgcatcgtccatggaatccatggcatcggtgtttgcttcgtgttgctggatattcgccggttgcttatcgctgttctggtctaccggtgtttcgttggaacgtgcagacgacttcgtccgagtgcggttcgccagacgccgggtcggtttgccgctcgttgatgctaccttgttcggcgcgtgaatagttgttgacatcattgttcctttacgcgtgcggccgtcgtcggacgaccgcgtacaggttcgagtatacgcagatgatgtaaacggtcacaaggggtgtctgtcgttgtgccggccgtggcatgcggagcctttcctcagtcgcggtccgccgcccgaccgccgtgtggctcgccatccgtggctcgcctgtgtcgacgcattccgacatggctgcgcaatctgttgtatttcgcgttcgcgttcagataatgcggggcatagtcgtcctgtcggttcccgcgacgcgagtacattgaaatcatgaccgatccgctgcatatccaactcaccgcgcgccccaccgtggacgactggcagcccgactgcgtaatggacggctaccagcaggcgacgatccatctcggccatgatgacgaaggcgatatcgtcgccacattcgtgcgccgggacccctcgaagctgcccatgagagcgcgatggaggcgtcagcggttcgcgctgcgcgggcaccggctcgcggtgatgtacgtgcacgggtggaacgactatttctaccgccgtcacgaatccgagttctgggaatcgcttggcattcccttctacgccgtcgacctgcgcaagttcgggcggtcgttgcgggatggacagacccctggatatatcgaggatctgcacgattatgcggcggaattcaacgccctacgcgacctggtcgtcgccgagcagggcgagcaggtgcgcatcctgctggtcgcccattcgcagggcgggctgagctcggtgttgtggctgaattcgcagcggccgcatcacgtcgaggcggtcgcgctggactcgccttggctggaattgcaaggcaaccgcatgttccgcatactgtcgacgcccgtggttcaggcgttccagctgggcggcggcaaaacggtgatgccgatgcgcgatccggggttctacggccgctgcatcgattgcgagaccggcggcgactgggattatctgcgccatccgctggtggacccgcagcgtttctttccccgcgccgggtggatgcgggcgatctacaatgcgcaggccgaggtgtcgcgccggctcgacatccgcattcccgtgctggtgtgcacgtccgaccggaccatgctgcagcccacatgggatgaggcgatgcgcgaggcggattccgtgctggacatcacggcgattcgccaggcggcgctcaacctcggcgatgtggtgacgctggcgacgattcgcggcggcctgcatgatctgagcctgtcgcggccggccgcgcggcgtaggtatttcaggatcgtggccgactgggcctctctgatggcgtggcggagggtgattccgcctgcgcatctgcgcaccgcgttggacgcagtcgcggcggccggcagccatgtcggtggcgtgaatcccgatgtcggccccgacgcaaaatcctgaggtcccgcaacggctcgcggccggcgtccagctgcgagcctgcgcaggtcacgccgactgccgcaccaccagctcggtcggcaacatcaccgtacgcggcgagtcgatgccgtgaatctttttgatgacgatgtcggccatcaccttgccgcgcatctccatgtgctgatcgacagtggtgatctgcgggttcgactccctcagcatccgcgcgccgtggctggcggtaaaagccatctttgccattggatttccttatggcggtttgggttagatgacgggcaaccccttgctacaatgagagggcttataaatccgtttgttttaagcaaaaccccgagcttacttccaccgtaatcgccacgctcggcggcttcgccccaacggtcaaactcggcatcactaatcacagcacatctcctactttcatttcacaacgtcgataatatcggctgaacattgatacttcgtggactagccacgccataaagacgcgcctagccggtaagcctgttgatccagcgaagccgttcgctgcggccggcaaggtcacggtgacggtggcgctcaagggcacggacttcgcgaagtccttcgagatgactgtcaggtccgccgacaagacagctctgaacgaggtgatcgcggaggccggctcggacgagttcgaggccgccttcgacgctgcgaagaaggtcgccgccgacgaggacgcgactcccgcccaggtggctgacgcgcttgccgcgccgcagaagccggcggtcaagccgagcccgaacggcaaggtggatgccaccgagccgagcggcctgagcaagacgggtgcctcgacgatggcgttcgccgtggccgcggtcctgctgctggccgccggtgccggcgtggtgctgctgcgccgccgcgccgagtaaggggcgagccgccatcccaagattctggcatgtcgggatggccgccgctgagaaatcggtggcggccatcattccccgacggcatgtcgtgacgactgattgcatgggggggcgcttgatgcggacgggatgttcccgagagccgccttcccggccgcatttttcgttgttgcgggaatcgcgctctcaaaactcgcagatacgggccgtttttgttggatttagccttgtatctgcgagttttgagagcgcggggttggtggcagcccgtgcctcatcccgtaaaggtcccgtttctggcctgcgggatgtgactttctccggatgcgggggcaatcgacatgatggcgacccggtgatcgcgcgccgcccccgttggcggggagctgtcgcgaagcgactggggtggccaaacctgctgcaggacacgaaaggcccgacgaaaccaatgcgaatactggtttcgtcgggccttcgcgttatccgcgaatgcgcgccaaacgttacgcgcctacgcgatcacaggatgccctgcgcgaccatggcgttggcgaccttgacgaagccggcggcgttggcgccgagcatcaggtcaccctcgtggccgtactccttggcggcggccagggagtcggcgacgatggtctccatgatgttcttgagcttggcgtcgacctcttcgaaggaccacgacagacggtagctgttctggctcatctccaggccggaaacggcgacgccaccggcgttcgccgccttggctgggccgtacagcagaccgttcttctggtagacctcgatggcctccggggtggacggcatgttcgcgccttcgacgacgaccttgcagccgttcttcaccagagcttcggcggactcgccgttgacttcgttctgggtggcgcacggcaacgcgatgtcacacggcacggtccacacgccggagcaaccctcgtggtactcggcggacggcacgcgctcggcgtactccttgatgcggccgcgctcgacttccttgatctgtttgaccacggccacgtcgatgccgttcggatcgtagacatagccgttggagtcggagacggtgacgaccttggcgcccagctcctcggccttctgcacggcgtagatcgccacgttgccggagccggagaccacgacggtcttgccctcgaaggagtcgttcttcagcacgcgcagggcttcctgggtgtagtagcacacgccgtagccggtggcctcggtgcgggcgagcgagccgccgaactccagacccttgccggtcaggacgccggagtactcgtcgcggatgcgcttgtactggccgaacaggtagccgatctcgcggccacccacgttgatgtcgccggcgggaacgtcggtgaactggccgatgtggcggcacagctcggtcatgaacgcctggcagaaacgcatcacttcagcgtcggaacggcccttcgggttgaagtcggagccgcccttgccgccgcccatgggcagcgtggtcagagagttcttgaggatctgctcgaagccgaggaacttgatgacgccctcgttgacggtcgggtggaagcgcaggccgcccttgtatggtccgatggcggagttgaactgcacgcggtaaccacggttcacctgcaccttgccctcatcatcggtccaggccacgcgaaacttcaccacgcgctccggctcgacgatgcgctccagcacgcctgccttctcgtactccgggtgcttctcgaccaccggctggatggtctcgaacacctcgcgtacagcctgaaggaactccggctggtcgccgtcgcgctgttcgacctgagcgtagacgcgcttcacatactcgtcagtgagcataattctccccttaatggttgggttatcaataagacggttttattgtaggtgcggtgtcaaggggcgacaagaaattgctcaggatgtggcgcggatgtgtgcgtcagctgagctgcagcgtttcggcgacttcgtcgacgatgcggtgcatggcctggcgcgcgttgtccggactgctctgccagatcgcttgggcgacggcgtcgtgtgcgtcgagggcttccggcttgggcttttgcgggtacatgtgcagttcgacgcgtccggagagcacggtggcgatgatggtggatagggaagcgaacatttcgttgccgctgttgcgcaagatcagcgagtggaattcgatgtcgagcttgtggaattcgtcgagcctgccgttctcgccggtgtgccggagctccgctgcgagcagggggagccgcgatttcacgtcgatcggcgcgtatcgggcggccgaggtcgctgcggccggctcgatggcgaggcgcagttcggtgagggtgcgcagctgctcctcacggtgtgtggagtgcagcttccaatggatgacctgagtgctgagcgcgtcccactcctcgaccggttgggagacgagcccgatgcgtcgacggacggtgacgactttggctgtttcgaggcttttcgcgacttcgcgtgccacggttcgcgagacgtcgaaccggcgctggaactcggcgtccccacgacggccaccgcggcggcgctttactcccggcaggcttcgcgcggcggcgccgacgacatcctgcgtgtggtctccacgatgcgcgcccaattcggcggccacgtgacccgtgcctgaagcggggcggccgcggaatgccacgagaatgatgcgatagtctgggaggtgacgatgcgcgggttgcaatccgcgcatccgggcgcggacacgagcctgcgcctgcgaatcctctaaccataggaggcgtcatgattgatggtttcaagaagttcatttcccgcggcaatatgattgacatggcggtcggcgtcgtcatgggcggtgcggtcaccgccgtcgtcaatgcgatcgtcaaccatctcatcaatccgctgatcgccatgatcttcggcaagccgaacatggacggtctgcttgcgttcacgttcaacggggcgaccgtgtcggtcggtgcgattctgggcgcattgctcaatttcctcatcatcgccgtcgccgtctacttcttcatcctggtgccgatcaacaagttccgtgacatgtccgatgcgctgctggcgaaggcgaagctcaaggaaagtgaggccgaggacgccgacgaaggcaaggaacccgagcccaccgccgagcagcagacaatcgcgctgctcaccgaaatccgcgaccaactggccaaagcctaaccagaactcgcaccaccgctggcggggctatcggcgagccgactgggcgccggcaatcgcatgctcctattcggcgaactcgctgttttccggggataatgcgtcacgctgcgcgggtaccgtcaccgtgtgcgggggcgcacagcgtgacggcattccggaaccattgcaatcactgggttcttgaagaatgcgtcacgctgtgcgggcgcgcacggtgacggtacccgcacagcgtgacgctctgatgtcgcgaatcgcacctgattccgttctcataggtggcgcgcacttagggacgcaacaacgggttatgcgccccgcggccagggggtggccgaccatgcgaccttcgaccgcggggcacgcgctccgtcagctccgcttacgacggaatgtggcgatgagaccgcctccgatggcgagcattgcggtacaggtcagcgcgaccaggacgctggcaccagtatgcgacaactttgttttgccgttgtctgcctgttgcccatttgtcttgtcatccggcttctggtgggctgcttgatccgtctcctcgtctggtgccggcttgggtgcaggttccggcgtgggctcggggcccggcgagggatcaggctcaggctccggagtctccccaccttccttcgcctgcacgacgaccgtaaaggtcttggaggtagtggctccctgactgtcggtgacggtgatagtgacgtgataggttcccggagtatcgggatccacatcatcggcggtcacattcgccgcagcgagcggcatgtcgccatcctccgcgtcgtgcgcggtcacgccgtcaagcggatcaaaagcgtcaccgaccgtaatggtccggtcactggcggtgatgacgggtgccgcgttgatcgttccggcagcacgcggccgaatcttcagcgtcgtcaacgaatgcggcgtgacggtgaccgtcggcgtcgccgcatcgaacgtgacgctgctgtcaacgggagtcacattatcttggttttccaacgtgttctctgcgttgattgctgcgtccatggtctgcacatccgcgactcggccagacagatcctgcccgaaattcaacttcagcgtgcggccgagcgcgcgatccagattgacgatgatcacgcgcagattgccatcatcatccttggaaaccaaagcagacagagatgttgcgccattgcccaacgtgggcgtcgagccgagcgtcgaagtcagcacgctgtcgccgatgccattgccgagcatctgcagggcatacgcgctcggcgtcaggaagaacccaaaccgcccctcgcccgtcaccgtgcttgcgccgtcttccggcacggcctgaataaccgcctgctgggtcgggccgagcgagtcggcgccgctgctgtaccagtcgatcaggcagtgcttctgaatataggggctgccaagccgaacatattccagcgcgaccttggcgatgtacagcgcgtgcgattgcgaccggaccagcgcgctggtatcgcggaaaatgccgtattcgctgatgaccggcaccttgcctgccggcatgagtctcacatactccttgacgcggttgacgcccgccgtctcggccttcttcatcgcgtcgtcgtaccatgcgcccgcggtggctcccgtgggggttccggaataagggtggatggtcatgccgtcgtaccactggttcgcgttcaggttcgccatgcgggtgatgaaccctgtggactcgtaactggtgtacacgttcgccgtgtgccgtgtgccgtccgtgcgctgttcggccgtgttgatctggtcggtggtgttcttgatggccttcgatatcttgacgaacccgtcgcggtcaacggtgtagctgacataaacctgctgtcctttggccggaatcgcaccatgcacgccgtctccgaacctcagcgcgcccgtgctgtaatcgacctgcacgactttgtcgccggcaccggcggtctccaagtcgtccacgatgcgccactgttcgttcgactggtcgttgccgacccatacgctgacgctgcccttgttgacggccacgaacgacgggtcgtcgacgatcgcgccatcgtcgccgttcattttcgggttgatgttggcgtagcgcatgtaacgggtcagaccggccttgccgtcgctgaccgacgctgccttgttccaatcctccaggctcacggcgtactgcttggtgaagctcgctgtgccgccctccgtgtacgcctgctcgctgccgccgctcaccgcggtggtccagtagccctgcgaggcggtgccgtcggagttggcccacgcctggttcatttcgttgccgatttcgaaatagcgcacgttgtacggctgcgggtgtccgttgtctgcgcgcaccttcgcccagtcgatgccgccgttgggattggtgccgacctgcgcgttcagatattcgatcagatccgccgcgtcctgtgcgttgccgcggccgaggctgtacacatagacgatttctgaatcgacctcgtccgcgaacgtcgcgatttcaccgatgccgaaattcggttcgatgccgccctggccggggttgttgtagaagccgtgtatctgcttgagccgttgggcgcgcggaccgatggtggtcttccagttgaacaggttggaaatcgtgcctccggggtagcgaatcgagccgaatccgacctgcttgtacagtgcggtgaagtcgtctttcacgcgcatcgtatcggggtcgaaactgccgtacccgttgaaggcgtaccgatgattgacgccgaagatggaagcgctgtcgaccgtgcgctccacggtgctggggtcggccgtgagcgtgatcggtacatgcgcctgatacgcggtgatggccgtctggagcgccgtgcccgcggcattcatcgccgtcatccgcgcgacggcgctgccggaggtgttgttcatggcgttgaccgcgttgcgttttgccgtggcgagtgcttgcgcctgcgccgacgcggcgtcgacctctcccgcggccagcagcgcgtcggcctgcgagaccagtgtgccgagttgttttctgacaagggccgtgccttgctcggcgtaaatcgcagctgcctggtcgtcggtgagcgtggcatcatatacgcggatgtcgtccacgtcgcccttcatcgaatgcgggtccatggtgccgatgttcttgtgcgagccgaccagcagcgcggtgacggcgttgacggccgaggttcccatgttcttttcgctgtcgagcgcgccgttgacatagaacttgaccttgtggctcgtctggtcgaaggaaacggcgatatgctgccatccgccgcgtgccaccgtattgttgctgagaacgtcggtcgcgttgacatacgtgtggtactggttggacgggcgcagcgtaagcagggagcggccggcgccatcctgctgcaacagcaccgcaggcttgtcgcctgtcgggtcgagcgtcgtatcgtaccggtaccacatcgcgaatgacgcgttgccggctccggtgttgacgtactggttgattttcatgtagctggacgcgcccgcgccgaagtgcagtacgttgccgaatacgccggaggggtcggcgatgatggagatgtcgtcgccgatgagttgggccgttgcgctgctggagccgccgttgttggccgcttcgcggtcgccggccgcggtgttctcgaagttccatgcgcctcgaaggtttgcggacgcggtggttgctggtgcggtggcgtcggcatcggccgcataggctgcggctcccggcgacagcgccatcgctgctgtggcgatggccgccatgattgagcgccagagcttgccgctccgacggtgtgatgtgatatgcgtcattacatgctctctgcttctgtttcggggatcactgccatgtgatcgttggggtgagccttgcctctgtgtgaaggtctgctcaattctatcaatgcgattccgtgatgcaagtaatggcgtggcgctgaaccggtgagagccggctctgtgccatccgcgtgccattagccctgacgattttggctgattcgagatggaaacgagcagaaagtgcaaatagaaaaaccctcagaatcagcttgattccaagggttctgagagtggagctagccgggttcgaaccggcgaccctctgcttgcaaagcagatgcgctaccagctgcgctatagccccgtgattccgccgttgcggcgttgtcagtgagaaaaaaagagcggctgaagtagccgctgcaattttcctgtgggcccgggaggacttgaacctccgacctcatccttatcagggatgcgctctaaccacctgagctacgggcccgatccatacgcttcaaaagcgcacgatgaactagaataccagaattgccgtatgtgtcaaatccagtcggttttttgtggctttcggcgtgtcgttatcgtcgttgtgtgtcttcacatggcttcctgcgtcgacaatcgcgggtgcgccgataagggacatgggttactgtaggtgatggctatggtgatgtctggcgcatcggcggccagaccgacttcctgcgacgaaagggtgtacagtgcagtatcgatactgttgtggcgatgaagacatgtcattcgatctcattccggaaccgcaatccgtgacattgaacggggatgccgccgattcggatgatgccggagctccggtacccgtcgcgttgccgctcgtaggccgcatctcggaagatcgcgacatcgatgacatcgccggcgttttcccgacccagcttgccgatgatatcgaagcggcgacgggcctgcgctgggacatcgccagcgatgtcatggtggccggactgcccgcgccaaatgccgcgactgcgcacccggttccgccacacgcttcatgctggaagtcgttcatcacattgagactcgacccctcatccctggagccgcaggaataccgcctgaccatcgcacgctccggcatagacgtcgtcggcggcgatacggaaggcgtgcgcaacggcgtgcagacccttcgccagatcatccgtcagtgcgcgccggcgctgcctcgactcgtcatcgcggacaaaccggcgtacaaggtccgcggctactatctcgacgccacgcgcggccgcgtccccacgctcgactggctgaaaacatgggccgaccggctgtgcctgtacaagtacaaccagcttcagctatacatcgagcacacgttcatgttcgacgatctgagcgagacttggcgcggcaccagcccgctcaagcccgccgacatcatcgcgttcgacgaatactgcgcgcggctcggcatcgagctggtgccgtcggtctcgactttcggacaccagtacatggcgatgcgcacgcgcgagctgcgccatctcggcgagttccccgaggacgccgaccgtcggtacggtttcgtggagcggcagcgtcaccacacgctcaacatcaccgaaccggagtccctcgcgttctcgttcaagctgatcgatgcttacatgcagctgttccgcacacgcaagttcaacatctgcggcgatgagacgttcgatttgggtcgcggccgttccaagcccgaagccgaacgccgcggcgtggccgcgatgtacgccgacttcgtatcgcagctgtgccgtcacttgtctgagcgtggccgcgagccgatgttctggggtgacatcgctgtggagatgccgcagatcctcggcctgttgccggataacgtcacgctgctcaactggttgtacgcgccgggcatcggcgaagacaaggtacgcctcgtcgcgcaggccggggccccgcagtacgtgtgctcggcggtatggtgctggaatgcgctgctgccgcgcctcgacgactcgtggaacaacatctcccgactcgcgcgctacggcgtgaagtacggtgcggtcgggtacctggtgaccgactggggtgattacgggcatgtcaacgacccgcgcatggcggtttccggcatgatattcggcgcgcagtgcgcgtggaatccgatggctcatatccagggtgaggccgggtgcggcgacggcgaagaaggctctgctgccggttatgccgatgccgctgccgatgccgtccgcgagaacaaggccgccgcggacggggattccccggcgccgctcccgttgagctcggagagcgacgattacaccggtggcgcggccgacgcgattgcgggcgcgccggccggcggcgatgggtcgtgtgccgagatgtgccgtcgcgtggccgaggtcgaatacggcgaccgttcgggcggcatagtcgaggcactgcgagatgccgcctgtcgtgtggcgttcggctgggatgacatggtctggtactgtgagctggatgaaggcgacggacggatgaatcgcgatgccgcatcggcgatgcatctcggcgtgcatgggttcagcggggaatacgggcgggagtgggatgcccgactgctgggcagtaccgatcttgatgaggctcggcgcacgatgctgcaagggctgtcgccgcatatcgtccgcgcggccgaggcgaacgaggcgctgctgtgcgacgccatgcgactcggcgccgccgccggccgcgcatcgcgtttgggtgcggctcggcgtgatgtgccggcgatgctggccgccatcgaggggcagcgctggttcaacttggtcggcttgtgccttgcgcggcggcatgacgtcatcacggtcgatgccggcgatatcgcccgcgcgtcggccgggttgatcgaaccggacgcaggctcttccgcagggccgcaagccatgcaggatgtctcgattcgagtggcgcgtggtctggagcgctggttcgagacctactgcgacttgtggcgttctgtcagcgcggaatcggaattggcccgcatcgtctccatcgtgtggcgctgtgccgacgccctgcgttcataagcccaagcgcacatcagaggcggggtgtcgcgcggtagtggcatgagccggtcgttgttgccgtgccggcgctcgctggctgagacggcgcgaacatgcgatccatgccgggtctcatatgtgagatccggcatttcgttgtgccgcaaggcgtcgccgcctcgtgcagtggcgtttttcaggccctgacaggcgagcttgccgggtatttgcgcttcaagggggtgattttcggtctccggaacatctatctgcatttcaaggggttgcggcacagaggcatccgaggtatatgagccattcacttattggaatgacgcggttctagcagtgttcctacttggtcaccaaccccttgaaacgtagatagatgttcgggaagtcgaaatcaccccctcgaaatgcagatagccgtgtaatccacgcctttcgcgcaatattcgtgccgctcagggcaccgacatcgagttttcagctctcgtcgtcgggcagcgccatgtcgctggagccgaatcgcggcccgctggtcgattcgcgctgcactagctgcggcgggtacgcggtgtgcgccggaagccagtgtttgctgctggcactgacgctgatgagtcgcagcgcttcatgggcgatgagccggcacggcgggagaatcgacgagagcggcgggtcggcgatggccgccgcgggggagtcgcccgacccaatgaccttgacctcgtccggcacgcggattcccagttggttcagcgccatcagcgctccgatcgccacatcgtcggtggcgcagatgagcgcgttcgggcggttgcccttgtccccgaacagtctcataacgtcgtgatacccgcgcttcgcggaattgtcgccgaacgtggtccaacccggttcggtcatcaggttcatgaccctcgttgacgtctgcaacgtggcgaacagctcggcggcgctggcggagttgacgttgccgctgaggaatgcgatggagttggcgttgtactctgcaaggtgcgaaagcatcagcttcatggaggcgctttcgtcgacgccaacccagttcacgtggaaggacgtggagtggccgaacgcctgaaccagcgaggtcatgccgacgtggtcatccaggaacgctgcggtgttggcgtcttgcggcggcatgaccaccagcccgtcgacccggcgggcgagcatggcttcgatgcgttccgtctgggttcgctggtcgtcgccgaggcccagcagcagctggcgtcccgagcggttgacttcgggctccaactccgcgagcagtcgggctgccagagggtcggtcgggccgggcatgatgaggccgatggtattggtcgtgtcgctgcgcagtgcgctggcggcggagttggcctgatagttgagctgttccgccgcgtcccgcacgcgtttcgcgatgttgtcgtctttggtgcggcgccctgaaagaacgcgggagacagtggctttggatacgcgcgccaatgcggcgacgtcggtgatggaactcgttgagctcatcgttcatcacctcggattgtctgcttcgattacttctgccgggcaccgcgtcgctgcccgttgtatataggatacatgaacgcacattgcgctcattggtcgccgcgatgccgtatgggcgtgattattgccaatgtttccagtggacagacgtaatggtttctgtatagatcataccatttcattacaaaattgagaaatcggtttccgggtttactaagcggattttagggtgtatagtgacggatgaaagaaacgatttgctcgcgatggtgtcagcaaatcaccaacccatccagcggtggatggctcagcacggaggagatgctatggtcgccgatattgacgggttcctgccggacagcgcgtttctgctcgacgttcccgccaccgattggaaagatgccatccggcttgccggcaaaggactggtggcggctggtttcaccaccgacgcgtatacggatcagatgatcgagacggtcgagaaaatgggcccgtacatcgtcatcgccccgggtctcgcgctcgcgcactcccgcccgtccgaggccgtgctgaagaccggcctgagctgggtgcgcctgtccacgccggtgaagttcggcaacaaggccaacgacccggtatcgctggtcatcggtctggccggtcatgacgagaacgagcacatcaccgtgatgtccgccatcgcctcggccctgatcaatcccaagaagaccgcggcgctcgccacggcccccacgccggaagccatccgcgacatcctgcatcaatagcagggcggcgcaacccgagccgggccgccggcgagcggcacacccacacttccataactgaatccaataactgaaacccaatggctgcgcggcagtcattccaacgaaagaaacgagggaatcatgaacatcctctgcgtatgcggcaacggcatcggcacatcggtgctgttgaaggtcaatgtcgaatcggtcgcggccgaccttggcgtcgatgtcaatgtcaccacctccgatgcgggcagcgccaagggcaccgccaacatgaacgatctggtgctcacctccgccgagctcgcgcccgagctggaaggcaccaccacgcccgtcgaagtcatcacgaacttcatggacaccgacgagattaagtcggtgctggagaagtacgccgactgagacgcgccccgttacggccggcgtgagatgccggccagaaaccataacaagaaaagaaggaatccatgaacgttgtcgttcaagtgctgaatttcatcagccaggaaatactgaatgtgccggcgtatctgattggcatcatcgcggccatcggcctgatcgcactgaagcgcagcgccgggcaggtcgtgtcgggcgccctgaaggcggccatgggctacctgatcctgggtgccggcgctaccgtcgtcacctcggctttggccccgttcggcgacctggtgctcaagtccaccggcgcgcacggcgtcgtgcccaccaatgaggtcatcaccgcgcaggcgtccagccagtacggcgcctcctcggcgtacatcatcgtgctcagcttcatcgtgatgctgctgctcgcgcggttcaccccgctgaaatacatcttcctgaccggccaccacatggtgttcatgtccaccatgctggccgtggtgctgtccgtgggattcggcacggaccaccagctgctcatcgtgatcatcggcgccatcctcatgggcgtgatcatggtggtcatgccggcgttcgcgcagccgttcatgaacagggtgaccggtagcgacaagctgtcgatcggccacttcaacaccctcggctacattgtctccggtgctgtcggcgccggcgtgggcaagaagtcgaagtccactgaagacatcaacttcccgaagggcctgagcttcctgcgtgactccatggtctccaccacgctgctcatggtcgtgctgtacctggtcttctccgtgtgggccgccatcgtgctgccggccaaggaagcgttcaagatcttctccaccaaccccgacaactacggttcgttcttcatggccgcgttcgcgcaggccctgcagttcggcatcggcgtgagcatcatcctctacggtgttcgtatcatcctcggtgaactcgtccccgccttccagggcattgcgaacaaggtcgtgcccggcgcccgcccggcgctggacatcccgatcgtgttcccgtacggcgccaatgcttcgctgatcggcttcctcggctccttcgtcggtggcctggtggctctggcgatcatcgccgtgtggctcggcccggtctggggcgtcgcgctgatcctgcccggcatggtgcctcacttcttcgatggtggtggtgctggtgtgttcggcaacgccacgggtggtcgtatcggtgccattgtcggctcgttcatcaacggcctgctgattaccttcctgccggccgcgctgatgaccgtgatgggcagcttcggtctggccaactccaccttcggtgacgccgacttctgctggttcggtacgattaccggcaacatggctcacctcggtcctgtcggtggcgccatctgcctgctgatctttgccgcggtgctcttcgccgccgcgtggatctggcaggtcaaggtcgtcaacaccggctggactccgggtgccaagcacgccgagtacatcgagcaggtgaaggccgaggagaaggccgccaaggccgctgctcgcgccgccaagaaggccgctgcggaagcgtgatactgttccgccgccgctgagcgattatgcgggagcgtgagggtgcgagtgccctcgcgctcccgtttttgtgcgtgggaaggcgtgagatcgcgggtggtttcgcggagtgcgcagtattgtgctcccgctagcgggagctgttgagcgcagcgagactgagggtggttctgtgcagtggctggtcagaccacccccagtcgctgcgcggcggcccccgccagcggggcgttgtattccttgcctcatgctgactggggacagcgtctgcgacaatggctcgtatgccattgcccaatcagcatcgtcatgcccgaaaagcacccgcgtccgcctcagccgccgccgcgtcgaccgtgcttgaggtggacggcctgcaattgcatgtgacgcgcaagcgcatcaagaacctctatctgcgtatcaagccgcctctgggaaccgtcgaggtgtcggcgccgatgcgcatgagccagcgtcagatcattggtttcgctcatgaacggcactcgtggatcgtgcaacagcagcggcgtatggccgaggcccgacggatgtcattgcggcaggccgagacgttgacgcccctccccagcgctcccgccggtgatggagggaatgccggtgtcgatggccgccggggcggcgatcagccgcagctccccatgttcgaccgttcggccatgtggaccgatgagcgcaaacatgccgccgcggccgcgatcgatgccgcgcttccggggctgttgcgcaagtgggcgcccatcgtcgggcgttcgccgagccatgtcaccttgcgggtcatgacgtcgcgctgggggtcatgcacgccgaaaaccgggcgtatccggctgaatcttcagcttggtctgatggagcctcgatttttggagtacgttctcgtccatgaaatgacccatctgtgggccaatggtcacggggctgattttcagcggcggatgagcgcttatctgccgagctggcgtgagctgcgccgtgaactcaacaagcgcgtactgctgtgaaacatatcgtgaaacatgctgccgacatgtcgcggcagcaaaacaaatgatggcggcggctcagcattgccactgaaccgtcgccatcattgatgtgcatcttttgcgtcagaccatgccggtgtgcatgggagcgggcattcacccgccatgcacgctgcctgctgtctgccgcgatctatcgcgtcacgccagatgcgaacgcatgaaccactggaacttctcaagctcctgcacgtggtcctggatgatgttggagctgatcacgtccagctcgtccagctcggcgatggccttgcggtcatcggcgatgaacgcgtcgtaatactcgatcagggcctcaaggtacttctcggtgccggcgcgaccgtcgacgtcgaacggcttccaggtgcggttgcgggtgatggcatcggcgcggccgtcaggcgttccgcccagcgtggcgatgcgttcggcggtctcatcggcctgcgcgagcactgcctcgacctcagggtcgagcatctcgtgcacggcgatgaagttcggcccggtcacgttccagtgagcgtgcttcaggaccagcgcggcctcctgctcctggctcagtcggttctgcagaatggcaatggccttctcggaggcggcttcgtccagtcccggcacaacgaatgcaagtgtcatattcgttccttccttctgggatatcagtcaccctccagtttatcgatgaagcctgcgcgatgtgtcagctgccagcatagttatcgctcacagtgagcgacgtaacagaaacgtaggctgatgatcatcagcggtacaggtcgggtggaatcagtgtgccacaccaggctgatttcgggccgtttttacgctggtgtggcacggactgggctgagagatgggacatgcggcggtgcgactgggcaaggcatgtgcagcgggggggggcaacacgaaacacggcagacggcgtgactggacgtagctgcacattcagcaggtacaatacggcaggtcaattcgcgtcagtcaacgcggtcagtcgccactcgccgtcatccgcgtcggtgccggcggacacactggagtacacagccggaccccgcggcgaaaaggagcgtgcagatatggtcgattcgcgtcgcgatgtggctggccaggccggccggagccccagcccatccgtgcaggctaccatgattggtctgatggcgattctgctgtggagtctgatgaccgggctggttcgcgtggtcgccgatgcgttcggcgcgacgctgggatcggcgttgatatacacctgcggcgcggtgctgctgctggtttttcgccggccggcaccgttgcgcaagtatccgcgaacgtatctgatcgtcggcggcctgctgttcgtgttctatgagtcgtcgatttccttgtcgatcgggctggcgtcttcggcggcctcgtcggtggaggtcagtctggtgaactacctgtggcctacaatgatggtgttgctggcggcggcattcgtaccgagcggcgagaagcgttcggcgcggaacgaggggataggacgggaacccgcagcgcccagcgacgcgcaggctcaagatgactcggtccagtgcggcacaaactgcagcgcaggcaagccgccccgccattctcgtggccgcgcggtgctccgcgtattgcctggcgctgtcgtcgccaccgccggcgtgatactggcggtcggcggcaacagcggcttggactgggcgctcgccgcagggcatgtcgcggcgaatccactgccgtatctgctggcatttgcgggcgcgctcgcatggtcggtgtatgcggtgttcacgcccgcgctgtccaagggattcgacggtacgtccgtattcttcccctttgtggccgtggcgctgtggatcatccacttcgcttccggccaaggttggccgtctgccgcgccgtcggtttggggctacttggctgtggtggcggccgcggcggtcatcgctggcggatacgcctgctggggctatggaatcttgcacggcagcatgagcacgcttgcgatggcctcttacgccacgcccgtgctgtccacggcagccagcgcggtattgctggggttgtctttgacgttgccgttctggtgcggcgctctgctggtcgcagccggttcgatcatcaactggtggatttcctcgcagcgccgatgatcggcaatggccggcgacctcccgcccgcgccgcgctattcggcggaaaccggcgcgtggtcaggggcgccggccttgcgcacctcgatggtttcgatacggcggccgtcgaccttggtgacggtcatgtcgtacccgtcgtcggagtgcagcacatcgccctcggcacccatcttgccggtgtgtgcgaggaaatagccggcgacggtctcgtacgggccgtcctccagttcgatgccggtcagatcggcgaagtcctcgatggtcatgctcgcgtcgatggtggcgacgccgctcacgaatgcgggctgctccttgcgctcgccgcccggttcgctgggcaggtcgtattcgtcgcggatgtcgccgacgagctcttcggtcatgtcctccagcgtcacgatgccgtcggtgccgccgtactcgtcgatgaccacggccaagtggatcccgcgcttgcgcagtagttcgaggctcggcagcagcttggacgtgccgggcagcgaaatgccttctcgcgtcacgtcggccacggtcgttgcgttggggtcgcgcacgtccagcaggtcgcgcacatgcacgaagccgatcacgtcatcgaaatccctgccggtcaccggatagcgggagtacggcatctcgcgcacgtacgccgccgcgtccttgatgctctgcgaaccgtcgaggaacacgacatcggcgcgcggacgcatgacctcggcgacgatggtctcggacgcgtcgaacacgtcgtcgaggatcgtgcgctcgtctttgctcagcgacgtgttcgtgttgacgagcacgcgcagctcctcatcggagacctcgctttcggtctcgttcgggtcgaagccgagcaggcgcacgataccgttcgtgttcttgccgatgagccagatgatcggcttgcagaccttggcgaacacgtcgatcgcgggcactacggcgcgggcgatctgttcggtgcgctgcatggcgatgcgcttcggcaccatttcggagatgactatcgagcagtacgagatgatcagcgtcagcacgatggtggtcagcggtgcggcgatgttcgccggcacgccccagcttttcacgacgggcacgatgaacggcgaaatcgacgattcgccgaacgatgcggacaggaagccggagagcgtcacgccgatctgcacggtggacaggaacttgttggggtcgcgtgcgattgccgccacacgtgcgccacgggcgtcctcctgttccatttgatcgatctgggatccgcgcagggagaccaaggccaattcggtgccggagaagatggatccgagcactaggaatatgaagatcagaaggatgtttaaaccaagtgacatggactctactgtaggggggtggcacgtcaattgtcgcagcgaatcattctcagtaagaaaggtgcgagcctgcccacgcccgaaacgaacatcaaaatcgacaaagtcccgagatgccgccctttatggttttgtgcgcttgtgcgcaaatgtgagaaatcctcgcacctttcttattgagaaccgttcgctgcgacttgccggccggtcacttgcatccgcaggactgcctggtgacgagttcggtggcgatgagctgcacgtcgggcgtgtgcgcggggtcgagcgccgcgttgaccgcgcagcgggcgagctcggcatcggtctgcgcggaggagacgaacatcgcgtcgacgttgcgctcgacgagttcgttgatgcggcggcgctcgccttgcgggtcgcctcgcgacaggttgatgatcagcgcccgttcgcgtttggatgcagcggcttcgagctggtcggtgaattcggcgaagtatgggttcgagaagtcgggcacgatgatgccgagcgtgtgcgtggtgccggtcttgagggctcgggcgacggagttggggtggtagtcgagccactgcgccgcgtcgaacacccgctgcgcggtgtccggtgagattttcttgggactgccgttgagcacgtagctgacgacggcggtggagacgcctgcgggacgcgccacgtcgaaacgggcggcgcgttgccgttgcggatgcggcgtctcgaatgcgtcacgctgtgcggggtgcgtcactgtgtgcgcccttgcagcgtgacgcatattgtataaccattggaaaataagggttttactgatgcgtcactgtgtgcggggccgcacagcgtgacgctacccgcacacagtgacgcgaaatgcggcgataagtcacgctcccatcagaagctcagtacctcgaccttgccggtggacagctggtagcgggcgcctacgatcatcagtcgatcatgcgccagcgcgtcctgaatgatttcgctgcgcgtgaccagctcttcgatggtacgcgccacatgtacgcgttcgaagtcctcgctcgtatccaactcggcctcccgcgcctgccataccgacatgccgaccgagcgcagcacaatcgaatccgagctggcgatgcgctcatccaattcggccatcgcatcagcggactccaacgagctctccgggtcgctcgtgctgtcggcgatcagcgcgtcaagttgttcggcgcccagcgccaccgccccgcagccttcatgacccatgaccatgagcaggctgacgtgcagatgatccacggcatattccagcgatgccaataccgcgtcgtcgatgatctgcccggccgtgcggatcgtgaacaggtcaccgagccccgcgtcgaagatgatttccggcggaacgcgcgaatcggagcatgacaataccgccgcgtcggggttctgccggtcgatcagtgattcgcgggtctgcatgtcctgccacgggtgctcgctgtgcccttcggcgaaccgccggtttcccgccagcatgcggctaagcgtcgagttcgcggtggattcctgatccgggtcttcctctgccatgacatctccgttccgagtctcaggttcgcgtcgggtcggcgtgtatgtgcctgtatgtgcgagcatagcggaaacctgtttgataagtatgaaatatccaaggaacgttcatcacctctgctcatagcgaaaccacggatcgggcgcggctgtttttaccggtttgtgagcgcaaactgtgatgattgtcatgaagaaaccctcgtgcgtccgtatcggcgaaagccgcttgacgttacgatggggagacgcaatgaccggattgcgtggaaaggaacgatgatgacactgcttcagcatgaactcactgattttacggtgcaggcttttcagaacaacgaattccatgaggtgaccaaggcggacgtgctcggtcactggtcggtgttcttcttctacccggcggacttcacgttcgtgtgcccgaccgagctggaggatctcgctgccaagtacgaggacttcaagaagatcggctgcgagatctactcggtctcctgcgacacccacttcgtgcacaaggcttggcacgacgccaacgaaaagatcgcgaagatccagtacccgatgcttgccgaccccaccgcactgctcgcgaaggacctcgacacctacaacgaggccgacggcgtggccgagcgcggtgacttcatcgtgaacccggagggcaaggtcgtggcctacgaggtcatctcctccaacgtcggccgtaacgccgacgagctgctgcgccgcgtgcaggcctcgcagttcgtctacgagcacggcgaccaggtgtgcccagccaagtggacccccggcgaggagaccatcgagccgagcctcgacctcgtcggtctcctctgatttcccgcctcactgacgggctgagttgtcaagcaaacagcagagctgtttgtaggcgaaggcgagccgacaggcaagcacaacaggctgcggctggaggccgtccctgattgcaggggctggagggctgtcggtagcggtcagagttggctggggatcgccaactctctcgcccccgctggcgggtagcgatgtaaggcgagtggcctctccgcccccgctggcgggggggggggctggcggcgacagccgactgggggtggtcgcggtgataggcgaactaccccacccgcttcgcgggagccccgccggcaggggcatatgcatatgtaaggagttccatatcatgacccagatcaaccgaagcgatctgtatgacgttgttgtcatcggtggcggccctgcgggactcaccgccggcctgtatctcgctcgcgcccgctatcgcgtgctgattctcgaaaaggatgatttcggcgggcagatcaccatcaccgacgaagtcgtcaactacccgggcgtcggccatacgtccggtcgtgcgctcacgcagaccatgcgcaaccaggccaaggatttcggcgcggaattcctctcagccgaggctaccggccttgacgtgaacggtgacatcaagaccgtgcacacgtcgcgcggtgacctgaaaacgttcggcatcctgattgccaccggagccagcccacgcaagcttggtttcgccggcgagggcgagtacgctggccgcggcgtggcctactgcgccacatgcgacggcgaattcttcaccggcagggaggtgctggtcgtcggcggcggtttcgccgcggcagaggaatccgtgttcctgaccaaatacgcctccaaagtcacggtgctcgtccgcgaaccggacttcacctgcgacgcggcggtggctgccgaagccaagaacaacccgaaaatcgacgtgcgctacaacgtcgagctcaaaggcgtcaccgccggccagggcgggctgcgcgaggcgacgatcctcgaccgccgaactggtgagacggaatcgtggaagccatccgacgacggcacgtttggtgtcttcgtgttcgccggatacgtgccggccaccgagctcgtgcgcggtgtcgtcgaactggacgaccacggctacgtggtcacgcgcggatacctcgagacctcggtgccgggcgtgtacgcggccggtgacctgcgcgtcaagaacctgcgtcaggtcgtcaccgccaccgccgacggtgccatcgccgcagtggaactggagcggtacgccaagcagatgagcgagaaaaccggtcttgtgccgcctcgcccgaccgcatccgcatatgagcaggccgaagcgcagaccgcggctgccgccaacagtgctgccgctgccggcaccacgcccgccccggctcctgccaagcgcagcgccgataccgccgccgcgtcggccgccgccaaaaagcccggcgagctcttctccgccgccatcaagcagcagctcggcgtggtctttggccgtatgacccgcccggtcacgctcgtcctcgaactggacgatacgccattgtcgacggagttgcagggattcatcggcgagatggtggcgctgtcgaacggcaaactgaattcggtcgcggtcgatgcggcgggcgtgatcaccgctgaggacggttccagcgcgccaacgtcgttgacggtcggcgagccgttggccgtcaccttgccggatggcgccgaactgccggtatatggttcgctggatgattccggtcgcgcgcagttcgacgtatcaggggtgctgccgtctgcgcggccggtcgtgcgcatgtgcgtgccggccgagaattccgacgccggtacgttgctgttcaccggcttggccttccacggtgtaccgtccggtcacgagttcaattcgttcgtgctcggcctgtacaacgccgcgggtccgggccagcctctggacgatgacctcaaggctcgcgccgaggccattgacacgccgatcgacgtgatgatcctcgtctcgctcacctgcacgatgtgtccggaaaccgtactggccgcgcagcgcatcgcgtcgctgaacccgaacgtgcgtgccgaagcctacgacgtcgcgcacttccccgagctcaaggaccagtatggcgcgatgagcgttccctgcatcgtcatcaaccatcccggcggcgagcagaaggtcgaattcggcaagaagagtgtcccgcagatgttgacattgctcggcgcatagtgggcgctgtgactggcgctgtcctttcatcccctttcaataattcttacatgttagaattctccgttaacatgttagaattattgaaagccgtgaaaggaagagccgatgctgccgaccaaggaaagcctgacggtggagttcaaaagcgaacgccaacgcccgcaaaccgatgacgaaatcgtcgacaatgtggtggcgatggccaataccgaaggcggtacgctgtaccttggtgtcgaagacgatggcatggtgactggggtctgtgaccggcatcgcaatgtcaatggtctggcggcattcattttcaacaaaacggttcctcagctttccgtgcgggtgacgttgctgagcgagagcggcaaaccggtcgtcggcattgaggttgacagcagtcagcagatcgtgtccaccagtcaggggaagacgctgcagcgccggctgaaagccgatggcgcgccagaagtcgttccgatgttccctgcgcaattcatcagtcgtttgtcgcagcagcgtagttacgactacagcgcgcagcctgctccggggtcgacgctgtccgatcttgatccgtctgcgcgcgaccgtctcagggagagcatacgcacggccaatgccggcagctcattgttggcgtttgatgatgaggacttcgatcgggccctagaactggtagtcgacggccctggcggcccgcagccttccgtggccggtctgctggtcatcggtacggagcgggcactgaagcgttccgtaccgtcggcctccgccgtattccaggtcatgaaaggcacgtctcccaaggtaaacacggatccgttcttcctgccgctgatcgatatgctccctcgtatcggcgcactgatggaaccatggaatccagatcatgaggtcatgagcggtctggtccatgtcaatctgccggacttcgatcatcaggcgttccgcgaggcggcagtcaacgcgttctgccacagggattatgcgaggatgggatcggtgcggttcctcgtggacgacgatggcctgaccatatccaacccgggaggtttcatcgagggattgagcgaaaacaacctgttgaccgcgcagccgcgttcccgcaaccctcagctcgcctccatcctcaagacggcgggatatgcggaacgcaccggtcgtggtgtcgataagatatatgccggctccttggcttccggcggggcatttcccgattattcgcagtccacggcgtcggaggtggtgctgttcctgcgtcgcgtggtgccggatgaggcattcgttgtgatgattgccaatgaagaggctcgccgtggcgctccgttgtcggtgtggtctctaatcgtgctgtcgttgctgcgggagcatcgcagactcagcgtggcgcaaatgcgcgaattctcgcgagtggagtctcggcgattggtcggcgcggtcgaaagcctagtggagagcgggctggtggaagcctgcggcagcggtgtcgcacgagattatatgctgagcgcgcgtgtatataagagggatgataagttgccggcttatgcgaggcaaaagggcctcgacggtcggcgggagaacctggtgacggaattcgcgctgaacaatgggggcgcggcgaccacgtctgacgtgatgaagctgctggatttgtcttatatcagcgcgtacaggctcatgaagagacttgagggggagggcgtattccggcatgaggggagtggtccctcatcccgctacgcgttggtgtaaggtgactggcgctgtcctttcatcccctttcaataattcttacatgttagaataccccgttgacatgttagaacttcgttgaccgtggccggcggacatggtgctttcgacgcgccacacggcatcaataagggggcccgctaggcgcaggcccccgaatcagtcaactatgagagtctattgtcgcggatgtgggcagttacctcgttcttggacgaatactgtccggggcgattcaggaagtgatttactttcagtatctgaagccctccgccttgcgttacggttcaggccccgatggatctcttgccctcgccgttcctgccaccgagatacttgaccaggctgatgctgatcagagccagggcgaacaggccggtgagcaccggaatcagcgcggcgtagcgatgggcctgatcgggcgtgtgcgtgaccacgaacgaggccagctggttgccggacaggccggcgaacgcccaggcgctcagcgcgagaccgtgcgtggtggagacggtcttggtgccgaagtgctggtcgagcagcaccggcagcgtcgagaaaccgccgccgtagccagcgttgatgaggaacagcatggccagcacggcccacaacagcgcattgttgatgctgttggtgaagatctgcagcaggcataccgcgatcgacatgatgaagatcacctgataaacggtctcgcggcgcttcaggtggtcggagagcgtggagaagcccacgcggccggccgtgttgaacacggagtccacggcgagcaccaggccgatgatgccggcgatggcggcggcgaacttggcggggctcaggccggcatactgcgggaaggccttgagcacatcgtgcaggatgtccttctcctggctgataagcgccaggccgcaggtgatattgatgtagaaggcgatccagatgccccaaaacacgggcttcctgagaatctccgcgcggcttacatgcgaggtcacgggatcgtagacccagtcggccggacgcttgatgagcaggaaaccgaagaacatcatcaccgcataaatcacggcgaggatgaagaacatgttgaccagccccaccgtgccgatcaggtactccatcaacgggctggcgatggccttggccaggccgaagccggcgacggcgatgccggtggcgaggcccttgttatcggagaaccagagcatcaggttcttgaccggggtcaggtagccgacgcccaggccgatgcccatgatcgcgccgtagcagatgaacacacccggcaggaagttcagagcgatgctcacgcccgtgccggcgaagccgaccacgaagcagaccatggagacgagtgcggatttcttgatgttcttctccaccatggggccggcgaatgcggctgacatgccgaggaagaagatggcgagcgagaagccccattccacggaggccgggctggcgttgagcctgtcggcgatgagctgcttgaacacgctccaacagtagacggtaccgattgggatatgaatcagcaatgcggggatgattgcgctggtccaacgattctcggtaaaccttgccattcggtaggatcctttcgtaactggctgtacgatgacctgccggcctgaacaagagccgcatcgctcactcaaggcacatcatgcaggactgttcgtgaacatgcgaacaattcactgaacatcgttggtgtgcattctatcagcgttccagctcttgtcgacgccgacagcgctactataacgccacttcgctggtgggattgccgatgatcgcggtcttgatccgtgaacttattcacatcggaaatgattatgaaatcgtatcaatgtgattgatagggggggcgcgaaagccccacccgtgtagggcagggctttcgcgatatgtgctgatataaaacggagcctccgctcgtcgcggaggctccgtgctgcggtgaactttgcgtgcgcaaagctattgcgcaaagcccaccgctacgttttggccttggaaagcccggtgggctttccaagcggtgttggccgcgcatgcggcccaacaccggccaaaacgtcagcccgtgttctgcaggccggcggcgacaccggagacggtgcacaggatcagatagatgaatcccgcctgctggctcttgctgagctcttccttgtccaccttcttgcgcagcgaacgcaacgcaagcacctgagtgacggacagcgcgtccacgtaaggggagcggatgcggatggcctgaccgagcacgtgacggtgctgcagcggccattcgtcgttgacgatcttgagcacccacttggtggtgagcttcatctcgtcgagcaccttcttcgacaggttctcgtcatcgccgagcgccaagtacatcttggcgatgcgctcatcggtcttggccagcgacatctcgatgttgtcgatgaacgtggagaacagcggccactcctcgtacgcctcgcgcagcgtgtcaaggtcgccgaacttctcgcaggccgaaccaaggccataccatgcggcgaggttgatgcgcgcctgagcccaggagaacacccacggaatcgtgcgcaggtcgtcgagcgacttcgcgcccaaaccacgcttggccgggcgggagccgattggcagcaggccgacctcggtaagcggcgtgacgatcgagaaccacggggcgaagtccggcgtgttcagcaggtcgaggaagcgctcatgcgaggcgttgtccagaacctcggtcatctgggcgtacttctcggtcatctccgtgttcgtcttctcgacgctcggagcggactgcagcagcgtcgcggcggcgacggattccagatggcggatggccagcaccgggttgccgtagcgggcgaaaatgacctcgccctgctcggtgagtttgaagcggcagttgacggagcccttcggctgggcgagcaccgcgcggttggcggggccaccgcctcgaccgacggcgccaccacggccgtggaacagcgtcaggtcgatgtcatgcttcgcggcccaagcgacgatgcgcgattcggcggaatgcagcgccagcgtagcggtggtcgggccggcgtccttggacgaatccgagtagccgagcatgacctccatcttgttgccggtggccttcagacgagcctgcacctcgggaatcttgacgatctcttccagcacgttcacgcagttctgcaagtcctcaagctgctcgaacagcgggatgacgtcgatgaccggcacatcctccgggtgcgaaaacgccagacggttcagctcgtacacgtcgcgcacgttctgggcgctcttcgtgaacgagatgatgtagcggcgggcggccttgatgccgttgcgcttctggatggcaccgagggcgcggaaggtgtcgagcacctcgtgcgtcatcggctgcagttcgccacgctcgccgtgcaggccgtgctcgcggatgtcctccagcgcgcgggcgtgcaccacggagtgctgacggaactccatctcgaccatgtggaagccgaaggtctgcgcctgccagatcagatcctgcagcgggccatacgccgaacgcttggcgccggcttcggccagggaacgctgcacgacctgcaggtcggcgatgaaatcgtcgcagctgtggtacatgaggtcggcgtcgcgctcgatggtgtagcgcaggcgatcggccatcaccagcatgacggcgcggtgcagctccttggtggagatcagtgcggccttgtcggtcaggcgctcgctcatctccttctggtggctccacaggctcttcagctcggcgctggccggggtcgtctcggactccatggtcaggttgcggccgaccgtgcgggtggcctcctcaagggcgccgatcacatggtcgctgaacttgcgggcgacctgacggctgaccttggcggtgacgttcgggttgccgtcgcggtcggagccgatccagcttcccggatggaagaacgccgggcactgcggctgttcgagaccggccttgtcgcccagcagccagtcgttgaaacggtggtagaccttgggaatcgtggtgaacagcgtgttgtcgaagatgtcgaggatggtatcggcctcctcgaccggcgtcggcttcttcagcgcgatcggggacgtgcggaacagcgcgtcgatctcgttgtagaggcggcggacgttctccttcttgtcggagccgccgaggcgcttgttctcttccagcagctccgcgatgcggcggatcttgccttcgactgccttgcggcgcgcttcggtcggatgcgccgtgaacaccgggtggaattcgagcttctccagcaacgccttggctttggccggccccatttcggtcagcagctgatggtaggcggtggtcagttcgttcaccgggtcaacggcttcgtcgtcttccacctggttctcgcgctggtgcagcacggaaacgcggtagttctcctcactcaggttggcgaggtggaaatatgtggcgaatgcgcgggcgagcagctgggcgtcgtgcagattcatcgcatcgatggtggcgacggcctttgccagaccatcctcatcggggtgcggatccgccgtcgctccggcgaaatgctcggcgcttgccttcaccgcgtagttgcgcacggtgtcgaacgtcgccagcagctgcgggtcatattcgcccagtacgtcgcgcagaatgcgcaggcacaggctcatgtcgttgctgagcgactcaggcagctcccgctcttcggggcccttggtcccggtgccggtcgacacgatggtcgcgtcggcgggcgtgatctgttgatcggtatcggtcattcataacctcctttgtcttttgggtccggttgctcggtcagtcggtcctccgcggctcctccgcggttgtgttggccgtcagttgcgagcccacagccggttgcgccaaaagctgtgtgcccattctattgccctgaaatcgcaagttgtattacgaagtccaatttttctctgaaggattactggtaaatatgtaatcttcaccatatcttcacgctgtcggatggcccgagaatgtcgtcctgaatatcctcgtcgacgtatcgtccataatcttgtcgaaggtagtccatcatgcgaacgccggtttcggtcataccccatgagttcacggcgcggagtaagaatgactactgtaaccatcttgaaaacacgcccgagcacacccatagggcggcaaaaacaacggcatgatacggatagagaagaacatgcagcagcacatgaacggcgacgcgccccatcaggacgcggcgacggcggtgagtcatttccacacccactccgttccccttgacatggaagacattcgacgcgactgggacaagccgatctccgaggccggcctcgccgccaagaccagcgtcgtcgtgcgcgtcggcgcactggacctgggtgctggaaccggaagcttccgcgtgcgcgagatgatgcaccgcatcgcgtaccccctgggcgtgcacgtgcgcgccgacgtgaacctgacggacatcgaggccacctgcaccgatgacgccaaccgcatcaccgaggtcatcgacctgcccaccaccggcgtcaacaccgagcgcatctggctgctggagcattacaccgactggttcagcgtgaacctcgggctcgattccatgtaccatcgcgcgggcgacgtgtccgaaggtgtggtgcagaaccttgagcaaagcgacatgtccgaggtctccgcgcagctggccaagaaactgcgcgccgagaagaaggcacagaaggagctcagcggcgaggcctccgacgacccggtgctcgacgccatggaggcggccgaggtcaccgtgcccgtctccatggtccgcgcggccgcggccgacatcaccgcggaaggttcgacggacgacgagctgcgctccgaatccgaggccgccctggaagaggatcgcgaggccaagctgctgcatgaccggttgatgcagcagcgctccggaaagcatgatttcgtggagacgccggatctcgacgcggccgccgcggcggcgggtggtgcaggcgcgggcgcgggcgcaagcgccagcagtgcggaagaccagaacctgaacgaattcgggacatcgatgtcggcggaggcgctgctgggcgcgaaacgccggaaaacccgcgctcacaagccgctgaccggcgagtacgccgagcatttcgaccacgtgggccgttccgcgggcgaagggcgcaagcccatcaccgtgcggcaggcgcatgagcggctcgacctgatcgagagccgtaagccgctctattccccggcgttcgccggcttcgcctccgcagtcgcctgcgcatccttcgtgttcctgctcggcggcggcccctacgacatgatcggcgcgttcgtcggcgccggactgggccactggctgcgccgcaaactgttcgcccgccatctcaaccagttcttcgtgacgttcgtgtgcgtggccctggctgcgctcgcctgcacgggcactctgcgcctgatcggcctgctcgacccgatcgcgctgacgcatgacaccgcgtacatcggcgcgatgctgttcgtcatccctggcttcccgctgataacgggcggcctcgatatggcgaagatcgacttcccatccggcatccaacgagtggcatacgtgctgtgcatcatcctaatggccacgctggcaggctggggagtggccatgatcgtgcatctgaacccgaccgggttcgagccgctggggctcaatccgtgggtgaacacggggctgcgggccgtcaccgccttcctcggcgtgtggggcttctcgatcatgttcaattcgccgcagcgcatgtgcctggtcgccgccaccatcggcatgatcaccgacacgctgcgactgacgctggtcgatttcggggtgccggccgaggccggggcgttcatcggcgcgctgctggccggtctgctcgctgccggatggcgcaccgccgtgcacaacggcctgctgccgccgcatctgggctatccgcgcatatgcctgactgtgccgtccatcgtcatcatggtgcccggtctgtatatgtaccgggcgatgttctacctcggacagttcgatacgctgcacgcgctggactgggcgttccgagcgttcatggtgattatctgcctgccgataggtttggcgatggcccgcgtgatcaccgataagtcatggcggtatgacgtctgacgccttgcctgcgcggcggacggttcccgatgggattcgtgtgaggaatcctcatgcgttccttgtcgggaatcattcgccgtgcaaagaggagtacgtccaacggcctgcgagcatggtcgccgccaccggcatcgcccgcatctcctccggcgtggagacagcatacgggtcgcggtccaagagcaccaggtcggctggatctccgggctcagggcggtcgcggccgacggctgtggaagccgccagcgcggtgcgcgcatccaggcattgctccggctggaacggttcgcggtctgagctttccgtgccgaacacagcggccgatatcgccatccacgggtcgagcggcgcaaccggcgcatccgaccccatgcgcagcctgacgccggcatcgtgcagtgccttgaatgcgtaaggggttccacccggattcgcccagaaccgcgtgatgacatcgcgatcgtccatggcgtgctgtggctggatgctggcggtcagcccgagcttcgcgaatcggggaatatccgccggcttcagcatctgggcgtgctcgatggaaccgtgggcgtgtgtgctcgccgccgcgttgagcacgatggtgttcgcctcatcgccgatggcatggcacgcgatggcgaacctatggcatgtcgccccgtggaaatacgtctcgatctggtcgggtgcgtaactgagcgtgccgtaaaagtcggggaatatatcggaatacggcatcgagcagaacgccgaacgggtgttcagcgagccgtccgagatcatcttcatcgcgccgacatggcccagtccatcgctgccgggcagctcgacgcccgtcttccagccggcttcaatcgcatcctccagccgttcgggatacacgcccgcctccacgcgcaatcctcggatgccgtgggtgaatgagccatcccaatcgatgcctgtccaagcggaatcgttagcgtcgcgcgggcggggagacgccgcggagaaccggcgggtccacgtgtcgacgttttccgccatctcatagtcgcggatgccgaccacgcctttgcgggtggcatccgcctcggccttgcgaatcagttcgagcgtctcctccgccgctccgggcgcattgtcgagcttgcagtaggcgtcgaaccattcgagctcgcccacaagactggactccctcacggtcaggcccagtcgccgcgccgccggttgccgtcgccgagatccgggagccggcgggcgtgattgccgcaatcgcgccgcccttgatcgcgatgtctacgcggcgggcgctgcccgggaaccgcgcgttggtgattatcgtcataattgcctgtacctgccatcctgcatcagatcagaaggtcatgggcgcatgtggcagaaacatcgtacatatccgttcgcgcctcggttgcttggccagttacaccaatccccttcaccgtacccccctaattgtgtggcgtcaccttcggcgtcacgttcaaatcgtctttccagtgtacatgcaagtcttctgtgaacagaacccgccggtgtgtacagtcgtgcgaaagaaggcggccggcgatttcctcatgcgcggtctccgccgagccgaggtgagttatccaccgcgttgcgcacatttatccacatttgtccacattttttgaggcgcggtagacggggaactgcccggttccctacactcggctccacggcaatattcgagtcacaaaggagcggccgaccatgggcggatcaatcgcactggtgcaattgacggagttgaagcaccagcgtatgaagcagtgcgctgaattccagcagcgcagcaggtggcagccgccatacgccttgaccacggccctggagcttcaggcgattgaaataccgcgcctgccaaaaggacgcgccatgttgaacggtattacagttgtcgtcccgagtgccaatgaaaggcgcaatctcgtcggcataaacgaagtgacatggtccttccctgttgatgtcgtcatggtcgagcaatgcttgtgcgtgtctccggcctgcacatgggcgatgttcgccggatggctgaatcttgaagagctgatcgtactggcggagtcaatgatgcgccgggatgggcgtctgcgcaggacgaccattgaggagctgacggcatatctggattcggcgcgggaattcacggaagcggtctttgaagagacgggccgccggccgaatatgtttcgcggatatgccaattgccggcgtgcgttgcgtgtgattcaggaggggacggattcgtcgatggaaacgcgcacccgactcgttcccctcaaatacgggatagacgcgccctgcgtcaattacaagattggagtgaagcgtctgaaccgggccgtatatcttgacctcgcttacccggaatacaagatctgcattgagttcgacggagggcatcacgccggtcaatggctggaagatgcacgccggcggcaggcaatcgaagacgagaagtggcggtatatccaagtcaccaagcttgacctcggtgatgaatggagtgaggaagctttagccagacggatcgcggataagatccaggaggtcactggaattcccgtgcccgtcactgcgcggaagaccatccaacaggtgtgcgatgccagagcgatgagacgcaagccactgtacgagcggatagggtttgaaccattgctgccgcgagtcccgaacgccaatgccgattttcctgacgcggatgaccttgacggtatcgcgtgatcgaaggcaggggtgcggaatcgcacgattgcgctgatgcgattgcgttggagagagaagcggagggctgtagctggctgcgccttgaccggatggcgtcttctgtgacgctatctgtgtctcaaggggttgattgggcgtcctctgggcatctatctgcgtttcagggggttgccgaaacgcgatacccggagtattgccggtgaaatgccattggggtcatgcggtttgaggtgcgtttatactttggcaccaacccctcgaaacgtagatagatattcggcgcggtccaaatcaacccctcgaaacgcagatagccttatctcggcgagttcgacgggtcggggcaggggcgtgcagacggctttctgtcccgaagggcgacaccgttatgggaaggccccttcgtcgcgtgcctcggggcggagtgacgaagggggcctgatgcaatcgttgcgttcgactgccggaaaatcagtacttcatgcccatggcctcgcgcacctggtcaagggtctcctcggcgatggcgttggcgcgggcgttgccatcgtgcaggatgtcgcggatggagtccatgtccttggcgagctctgcgcggcgctcgcgatgcggggcgaggaactcgttcacggactcaatcacgtacgccttgagcgcgccggcgcccgcatcgccgatttcggcggcaatgtccttcgggtcgcggccggtcaccagtccggcggtggtcagcagcgcggacacctgcgggcgggcgatggggtcgaaggtgatcttgcgctcggaatcggtcgggctcttcttgatgagcttggcggtctccgcggcggtggcgcccagcatgatggagttgccgtacgacttgctcatcttgcgaccgtcgaggcccggtatctccggtgcgtcggaaaggatcgcggcgggctcggggaacaccgggttcttcttggcgtagcgctcgttgaagcggcgggcgatggtgcgggtgatctccacgtgcggcaggttgtccttgccgatcggcacgacattggccttgcagaagaggatgtcgcacgcctgatgcacggggtaggtgagcagcaagccggtcagcgcgtggccggaggcctccatctcggacttcacggtggggttgcggtgcagctcggcctcggtgacgagggagaggaacggcagcagcagctggttctcggccggcacggcggagtgggtgaacatcatggtcttggtcgggtcgatgccggcggccatgtagtcgagcacgaggttcagcacgttgtcctggatgtgctcagtggtgtcgcggtcggtgatgacctggtagtcggcgatgatgatgttggtgttcacgccgcggttctgcatggccacgcgctccttgatggagccgaagtagtggccgaggtgcaggcggccggtcgggcggtcaccggtgagcatcgtgaacttgcccggctcggcctcaagtttggcgagcgtggcgtccgaacgcttcttcgcggccaggaagctggcgctcatttcgttgcccgctgcggtcagttgctgctgttcttggtccgtcataagtcgccctttgcttgcttcaaaacgccgaaaatatcgcttttatcgtaaaagtccaagcagacaaccatttctctcataacaagtggtactctcttatgtgatgaattgatagttacatttacatgccagggggtcacatgggccgcggacgtcagaaagcaaaacagcagaaaatagcccggaagctcaagtacctgaccaccgataccgattacgatgagctcgccaaggagctgagcacgcaggagccgggcgaggggtcgcccgatccgtttgccgatatcgaggcttcgtattctcatgatgcgaacgccgccgtggacaatacgcagggatccgtcgctgaggatgaccttgacgagtacgccaagtgggctgccgaggctgcggcgaaggcgaccagtggcgaaatgccggtcgtgaaggcacctgaatctcaggctccgaagcccaagccgatgccgcgcaaaccgattcccatgcccatgccggccgcgctcaagcccaagaaggcatgattttcggatttcgtcgctgctggcccggtggtagggccgcattgacgcgatttcgtatgtcatgatgacgattccgttgcgatatgcgatgacagcgatgtcgacgcccagtacgtgcgctcgctgaccgcatcatgggcggccgctcggcagctggagccagatagacgtattcccgtcggcagagcggtttctgacgcgctatgggcggcggcgtgacgtcgatattctgctgctggacgtcgaaatgggctcgatggacggcgtggcgttggcgaaggccgtgcgcaaggcgggcggcacgatgcagatcgtgttcgtcactgggtattcggattacatcgccgaaggatacgacgttgaagcgctcaattacctgatgaaaccggtggatgcggccaagctgttcgacgtgctcgacaaggcggtcgcgcgcatgcgccgcgattccaggtgccttgatctgcaatgcgcggaagggctgatgcgtattccgctggccgacatccgctatcttgacgtgcgccgtaattatgtgacggtgcacgccgaccgggattatacggagaaacgcccgctgggcgagttcgaggccgagctcggcgacggattctgccgggtgggacgcgcgatgatcgtgaacctgcggcgaatccgctgcgtagacaggtcgtccgtgcaattgaaccgacgggacgacgctgccactgcctcgtggggcgtacgagccgttgaatcgggcaatcatagaccagatatgattacgcatggccgtctcacggccggcagggtgctggaaagcagtccccggctggacggggcagaatgcagaggaggggcgatgtggtttcgtgggcgaggcaaggccgacagggctatcgcggcatatcagcgcgagctggtcgacacgcattaccgcgaggtcgagaacatgtaccgtcagatgcgcatgtggcggcatgactaccgtaatcaccttcagacgatgaaggcgttggataccccgatcaagtccggcaatgcgatggctgacgcgattctgagcagcaagatgtcgcttgcgcaggcgcctggcatcgacgtgcgcgtggacgcccatacccatattccgatcaagcagcgcatttcggaactcgatttgtgctgcgtcctcggcaacctgttcgacaacgcgatcgaggccaacgacgggttacctgaagccgatcgcatgattcgcgtgtatatggacatgaaggacacgcagctgtacatctcgttcaccaacgcttcctcgggcggcaagcagcgcaaggtcggtgggcgcttccgcaccatcaaatccgacgaggggcacggtttcgggttggtccacatcgaccagatcatcgaggctgcgggcggctacctgagtcgcaactccgaggacggcgcctccaccacggagattctgctgccgcagtcctgatgacggcggtgcgggctcatgagagcggattgtcgatgtgcgtgctgcccgccggcgagggaggaagctggggccaaagccctctccttggactcattaccggtgaatccgtgcaagatagcgtccgcgcccggacccgaacgccgcagccgttggcatgcgacggtatgctggaatggtgaacagcatggcgtgcagcggcgtattcgagccgcgtaatattctagtgaccggcggatgcggcttcattggcgcgaacttcgtgcgatacgtggcgcggaaccatccacacgcgcacatcaccgtgctcgacaagctgacgtacgccggcaatccggagaacatcgccggcctgccgccgtcgcaggtcgatcttgtcgtaggggacatctgcgacgtcgcgctattggagcgtatcgtgcccggtcacgacgccatcgtccacttcgccgcggaatcgcacaacgacaattccatcgccaatcccgaaccgttcatccgcacgaacgtggaaggcacgatgcggctgttggaggccgcccggcaacacgacgtgcgcttccaccacatcagcactgacgaggtatacggcgatctggcgctggacgatccggcgcgtttcacggaagacacgccgtactgtccctcaagcccgtacagcgcctcgaaggcgtcgtccgaccatctggtgcgcgcatgggtgcgcacatacggtctgcgcgccaccatctccaactgctccaacaactacggcccgtaccagcatgtggaaaagttcattccacggcagatcacctccatcatggagggcgcgcggccgaaactgtacggcaccggcgagaacgtgcgcgactggatacatacggaagaccactcccgcgcagtgtgggcgatcctcacccgcgggcgcatcggcgaaacgtatctgatcggagcggacggcgagatgagcaacatcgccgtgctgcgcatgatcctgcagctgatgggccagccggaagatgcgttcgactgggtgcacgacaggcccgggcacgacagacgatacgcgatcgacgcatccaaactgcgcgccgaactgggctggtcgccgatgcacaccgacttcgctagcggattgcgcaacgtcatcgactggtatgcggaacaccgcgactggtgggcgccggccaaggaagccaccgaggcccgctaccgcgcgcaggggcagtgaagcgaccgcctctacaggcggcctttccgcggcaggtcaacgttgcgcagcagccgttgcaagggcttgagcaccacggtgtcggcgaccaccgcgaacgccaacgccgcgagcagcgtggcggcgaacatcagcacgctgatgcccgcgtacgaccatccgtccgtgggcgcgggaatccgcggaccgatcagcaccttggacagcggcgaatgcaccagatacatcgtgtaggagtatcccgccagccaggtgggtagcagggtgcggttagagttggcgattagggcgttcgcgccgaattatttgggtttgatgactttattcgagagaggctgacgaatggtttcgccacatcatcttttgaagattgcgactgcgctgtctgcggttgcgttgacggcttccgttgcggttacgccggcttacgcattgcaggatatcgcgattgaggatgctgtcgcgcagagcggtcccgttactgcagataatggcgttgttgtgcagtctgacgatcagtctgacgatcagacgggcgaccagcaatcgcaagacagtatgcccgacaatccgaacgcgaaacttccaggcaccgtcagtgacgagatttccgacgatgccaccgtggtttcggaagacctggccgttacccccgaaggtgaggtcaagaatattgaaaccggcgaaaccgtgaccgatgcgacactggtcggcacgcaggatcagcagccggatccactcgccaaaaccaatggcgaatccttcattccggtgagtgcggaagatgtcaaaaatgctgtagccgacgcgaacgtacagctctccaaattcgaaagcaatgaatacggcgcgcactggggcacttacaacaatacgaaagccttcttcgactaccagaacaacctgttcgtgcagcaagccaaaggcgtgatcgacgtttccgaatggcaaggcgacatcgactgggccaaagcgaaagccgacggcgtggaaggcgtgatcatccgcctcggctacggttggggcaacaatgccgacaagaaagcacaacgtaacatttccgaatgcaaacgatttggcatcccgttcggcatctactggtattcctacgcggacactccgtcgattgccaaagaagaaggtgccggcgtggtcgccaaactcaagcgattcggtgtgcgcgcgagcgacttggcgtaccccgtgtactacgacctggaaaagtggacgtggaaggggcatcagccgcccaccgatccgaacgtgtacaacgatatcgtcaacaattggtacggcgcgctgcagtccgccggatacaagaacctaggcgtctactcgtacaccagctacctgcaaggcccgctgaaacatgccgacatttacgccaaaaccacgtgggtggcgcagtacggcgctcgcatgggattcgactcgttcccgaccaacagtcgcggatggcaatacaccagctccggcaaagtgggcggcatcaggggcaatgtggatatgaatgcgtttgggaacaaggagtatgtagataagaacaatagtaacaacgcaacttcctatgaggttaagggagacatgggagttgagtggcgctctattggcgcagagaaaagcgttattggtaaaccaattgcgaatgaagtttgcgattggactcagggcagggtgaactgctatcagaattttgagaatggtgcgatttcctggactccgtcaacaggcgcgcactatacgactggaacaatacgcaaggaatgggctcgtcgcaattatgagcacggcgtcttgggatatccgatcgaagatgagaaaaagttgtcgaatgattggaaatatcaacgcttccaaaatggcgatatctggtctcatggaatgaaagaaagccgtattgttctgtacaacctgcgtgattctttctataagaatggcgggtattcgtcgttgggcggtcccgtggccgatgaggagaacatgggccgtggctggtggcgccagcgtttccagtatggcgatgtgtggagcaaggacggcacggattatcgtttcgtgatcaagttcgatctgcgtgattcatggaaccggcatcgtggtttctcctggttgggcgcgcctgtggcgaacgaggagaacatgggtaacggttattggcgtcagcgttgcgagaacggtgatgtgtggacccgtaacggggcttccgagaagtacatcgtgatgctgaatctgcgtgattctttctataagaatggcgggtattcgtcgttgggcggtcccgtggccgatgaggagaacatgggccgtggctggtggcgccagcgtttccagtatggcgatgtgtggagcaaggacggcacggattatcgtttcgtgatcaagttcgatctgcgtgattcatggaaccggcatcgtggtttctcctggttgggcgcgcctgtggcgaacgaggagaacatgggtaacggttattggcgtcagcgttgcgagaacggtgatgtgtggacccgtaacggggcttccgagaagtacatcgtgatgctgaatctgcgaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtgtggacccgtaacggggcttccgagaagtacatcgtgatgctgaatctgcgaaaagagtactacgctaagggtggtttctcaaagcttggaggcccggtttcggaggagcgtaatctgggctcgatctggaggcaggatttccagaaagggtcgatttacgcacgttagaaatggtgttttgactctgtagtagagtttgtttccgtaaagagttgataccagctttatgcaggtaaggattatttcataatggctaaaaaatccattgtaattatcggcggcggtcccgctggcttgactgcggcttacgaacttcttaaggataatggctctgagcagtatgatgtcaccgtccttgaagcttccggcgagtttggcggtatttcccgtactgtgcgccacaacgggaatcgtatggatatcggtggccatcgcttcttctcgaaggatgaccgtgtgatgaattggtggaagaccattcttcctctgcagggtgctccgtcttatgacgataagaagttgaaccgtgctcatgacatggagcctggcggccctgatccggagaaaacagacgaagtaatgctgaagcgtcaccgtgtttcccgtatttactggcatggcaagttcttcgattaccctgtgagcctgaaaccgcagaccctgaagaatatgggctttattcagaccatgaaagtgggtttctcctacctgaagtcccttattcataagcttccggaagataatctggaaaacttctatatcaatcgttttggtaaagccctctacggaatgttcttcgaaggatatacggagaagctttgggggcgtcacccgtctgttatttccgctgattggggctcgcagcgtgtgaagggcatcagcattatggcggtgcttaaggatgcttggggcaagcttgttggcaaggagaagaaggccggtgagggtgagacctcattgattgaagagttctggtatccgaagttcggtccaggccaactgtgggaaaccgtcgctaagcatgatgaagagtttggcgcgcatattgttaagcatgctgaagttgtgaagattaacgaaacggacgaaggaaagatcgcttctgttgtttatcgcgatagcgaagggcatgagcagatccttgccggtgatgagtttatttcctccatgcctgtgaaggacctggttaattctatcgcggaaggaaaccaagccacgaagccggttccgtcggatatgaagaagattgccgatggtcttccgtatcgtgatttcgtgacggttggtttccttgtcgatcacctgaacctcaagaacgaaacgaatattccgaccttgggcaacccgcaaatcgttccggactgctggatttatgtgcaggataccagcgtgaaggttggacgtattcaggtattcaacaactggagcccgtacttggttcaggatgtcgacaataaggtctggattggtctggagtatttctgcaatgaaggcgatgctttctgggaaatgacagatcaggagtgcattgatttcgcagctgatgagcttgtgaagatgggaattatcgcatcaaagaacgatattcaggattctcatcgcgaacgcgtaaaaaaggcatatcctgcttatttcgatacctggtatcagatcgatgatctggtgaagtggctggattccttcggaaacctgtattgcgttggacgtaatggccaacaccgctacaacaatatggatcattccatggctactgcttttgaaacggtcggtaacatcaagagcggtcgtgaagataagaagaacatctggaatgtgaacactgacaaagagtatcacgaagagaagtaagcaatagagtggcgcatagtgggtgatgtacctctatgcgccactctattctaagagagaatggaatgagagaattttggaaaaacatgttgtgagtttccgaaggaaaatgatcttttcaggtcttttttctttactattctcctttttaatggtattaggatactctttttctaaaacgtatagttttcaattttttgatacctacaaggcgtttatctcattctgcgttatctcgttaatagcatttgggattatgtacgcggttctttctcgtataaatgtgcctaaagaatcggaactgtcgaagagctgcaggaaagtacgtcatccatttttttctgcttgggtgctgattattgttgcttggattccatattatgcgatatttgcgccgggactagggttttatgatagcctctggcagctgtcgcagttttatggctacacttcatataattctcagcatcctgtcttggcaactcttgttattggtgttttattttcaattgggaaaccgttgggaacaaatttccagttccttatctacacgagtattcaagtactgcttgtttccgctgttctagcgtttatagcatggtttgcatataaacgcctgcttgttgcagaaggtgaagaggggagcaatcgagtcttttgcttgtggtgtgcgcttgttggtttttccgcgctgaatccacttttcccgctgtactcattgtctgttttaaaagatgtaccttatgctgccgcgattgcggtgatgacggttttactcgtggaagtgatcggtgacaagaaagtgataaatgagaggacatttgtcgtcctcttttcttgtgcctttatggtgatgagtgtcttccgcaatgagggtttaattattgcgattgcatgtgccgctctcgtttcttttgctcaggtgaaagataaaaagaaattttacacttttctttccgtgggcttggttggtgtcgttgctgttgcgtcattgatgagctcggcattgattaatccgcagaaggggagtcgtattgaaatgttaacgattcctgttcagcagatttcgagggaggttcgggataatccatcttcgtttacggctgatgaaaagaaaaagttaaacgagatgcttgtagatgatacgctatggagtgatcttggcgttaaatattcgcccgaactcgttgatcctgtgaaagttcttttcagaaaagatttttcgttgagagcatttctgaaggtgtggggtcgtcatcttgttctgcatccagatacctatctgtcggcgacattttctggaacgtttggtttcttctacccatgtagggcaagcattgggcagggatctgtgtatgacagtttccagtggatgaatcctcagacagttagtgggtggaaacagtatatgggtgttccaaacggagaattgtatccgacatatctaggaaaagcagaaaatttgcgtgaggaattcttacagtcatttgagaatctgtataaaattccagttgtaagtctgattgtaaaaccaggaacatatttttggattggatgtcttgctgcatgtttggcttgctttaagcgtaattatatgctattaattgcaatggttccttgtgttctgattttctgcgtatgcctgttgtctcccgtgaatgagagtgcaagatatgctcttcctctagttttttcggcaccagtacttttgattatttccgtgtgtatgccttttaataggttggaaaaaggtaatagaaagtaagacctatatttgatcgcgttgagcagaacgacatgacaaccgttcagaaatcaaataacagatgaaggcagaaaaaacagagaatccgggctggagctttggtaggggggtgcggatgaaaagttggacgctttggtgtccggattggagttcgcatgttcgaaggagaaggccgacgcggaggcgaaggccagggccgaacaggaggccgcggcggcggccgcggctgccgcgcggcaggcgcaggcgcggcagtcatggccctcgtccggttcaggccacaccggctacaccggcaacggttattccggcgacacgtccacaccgagtggcggctcgcccggggcatcttcctcgggctccaccggaagcacccactacgactgggaagaccgagtcactacaaacgaatcatgcgcttccggaggcttctgccccatcggctgattccctcccatcccctctcctctttcagggccccgcggcatccgtcgcggggcccttcccccccccgccggcggatgtccaaaccgacgccccccggacggtggttccatggtgtgcgtgcaccggacgcgcccgattccctttctccctgattctcatttcgtggcccagggccttcggactaatgacccatatggtgcctaggacctttgtaatcaatcccggcgctcttgccatccccgtcttgccgggcaaggttcttccgcagcgtgtcgccgaatctgtccagcagatccgctctgttgcggatcggaccggacgcgcgaagggccttgccctccctgatcctgcgaatcgttccgatgcgcttcgcgagctggtcccggatggcgtcgaggcgttcgggagcgaacatgcgcatgcgtgacagttcgtgcgccgcctcgtcgggccagtccgacagggcgtccaggtcgaaccggttccagtcctccaccagtctgagctgccgcaaagccgagggcttgccggtcgcggtgtagaacggcttggcgaaccagtctcggccgtccacatcgagctcgccgctccacaggctcgcgccagtgtcgtagatcggggccggacggaccgcaagggtctcgatgtcacggatcagaccgaagttgctgtaatgcctatctgtattgcgcatgaggtaatcggccacgagccaatcgtccgtggcgtcacgaaccgcccgttcgtctgcgccgaagccgacggcggcgcggatccactggtcatgcgagttgagtccattgatggttctggcggattggagcacctgccaggcggagaccagctcctcatgattggagagcatgtcctcgcacgtgcagaccaagcggttgccgctgcgcgccggcgaatacgggacggcgggaacgcccagccgcacgcagagcttcgaggcgatgacctcgttcatcggctcctggcccgtacgtcccgacttgacgagcagcctcctgccggtggttttgtcgatcgtccagcgtttgggaagatcgccgcccgtggagacgtcgggagcgttgaggctgatgtcatgggatgacgagtacgaggtgagcaggatctcgcccagcgcctcgtcgaagggattgtcgaagaaattgatgcccttccattcgaccggatcgtcctcacgtttgacccagtactggtccgacaggctcagcccgtaggtcctgtcgagcagttcgtcggtcgatgccgcgccaagcgattcgagcacacggcgaattccgtcacgggtggaggggattgcgcgggacctccaccattcgtcgatcctcttggcgtacagcgcgctcttgccgtgcgtggtgaactccaggggcagacgatcatggtcaaggacctcgcccgaggagcacgcgcggccggactcgggatcgtattcgaacgcaaggaccggatggtccccgcacatgatcagcttgcgtggcatgctccccttcctttctgactcggcgtttcagaaaataaattctacaggcgcgaatcgaacgtggatgcggcggcccgtttcatggcgcggcgctcggccctggttggccgctcgagaatccactcggcgagcatacggatgaggatggatgcgacgatcacgccgatggatccccagaagcacgggacgaagtccggcttcgcatggtcggtacagaaccagacgaccaacgcgaggatcaatgccaggccggcggccagggcggcgagcttgtggaacacgagggcgagcgtgcggatgggatgcgtgaccagtcccaccgccagcgcgacgacgacgagcagtgcgacgatgcccgcaccgatgatggcgatgcccaggtatactgcgagcatatagagtccgaacatgatcggtccttccttctctcttttctagtccgtttcttcgggcaggtaggtgtagtcgacggcgacgccctccgcctcgagcagcacggcggcctcacgcacggcggcggcgcgccgtttcgcggacgcctcggccttgatccagtcgggcaggtcgtcgggcaggttggagacgcgcgagaacgagagcgtggcccgctcctctcccctgtggcgttccacgatggccacgacggcacgcctgtgttcggcgagatagtgctcgagcatgtccttcatcctatccgagggttggatccggtatttctccgactcgtatttcttgaccatgtccacggtgaggttcgcgagcacggccacgtcgtgctgggtcatgccgatgcgttcgcgcgtcgcgcgcatccacgccttggactcgctccaatccccttccgccatgatccctcctggatattagaaagccgggttcgcccgcgcgaacctcgattatacttttagtataatcgaggttttcggcagggcggacccggcgtttcccggtttcgtcactcggtcggggtcggcgggttgtcgccggcgttggccttacgctgctggtcgagcatttgctgctggatcagaacgctgttggtctgggccgcgtactgcttctgggccatgtccatgctctcctggtggcgttgcccttcgacgtcagcgaagacgagctgctggatcgccagcgcgagctgcatgagcttggccttcttcaggatggacaccttgacggtgttgcggccgccggcctggttgacgaagtcaagctgcgcgctcatcgtgttcgccaggttcgcggcggcgagcacgaggaacaggatccccacaagcgcgctgtccttcatgcaggcgagacccgcgatgaggaagatgttggtgtccacggacgcgatgttgcgcaacgggatcgtctgtgtggacgagccgagcgggattacgcccaggagggtgttcgggctcttgcactgcactcgcatgctgctcgcggcgatgctggtcttgaaccagaacaggatcaccgacggactgaaccggtcgccggtgatgttggtctctttagtctcctttctctagtgtttattgccgaagtcgaagatgacgccgcgatccttgtcgacgacgagcgaggcgtcgaatttgctgcccttcttcgaggtgaagcccttcaggctgaccttccgtccggcgagcagccggcgtatggcggagtcggtgacggttttgccggctacggtcgtccaggcgcgccagccgcatccttccgtggtcctccatgtgccgtcggattgtttctcgcgccggttggtggagcattggaacaccttgcccgttttgatgacgggcttgccacagcgtgggcatgggccgaacgactccgtgttccgcgtcttcgtctgcaaatggtcctgccggacggtggaccgcgcgtcggccgggatgcgcacggcgaggtcgcggaactccgtttcgacctgcgcggggtcagcgtggttgtgctcgacctccgagagtcgtcgttccatgccggcggtcaatgccacgtccttgagcttcgtggcgaccacgtcgatcagggatcgtccctgatcggtggagcgaagctgcttgcccttgcggtccacgtatccggagtggacgagctgttcgataatgttcgccctggtggcgggcgtgccgatgcctcccgagtgggattcgtcgtcatccagggcggccttgagttccttgtcctccacccagcggctggcgtgctccatcgcggcgagcagcgtcgcctcggtgaacggcttcggcggcttcgtctttccctcggacagtgtcgcaccgccctgcgggaccggcgcgatgaagaccccgtcggtgaggttgacagggatgatgttgcccgcggtctcgtcggtgtcatcctggtcttcctgcggggcggcatgctcgatggcgtgccatccgggcgagacgggctggtcggaacggctggtgaagcgacattcgccttcgggcagaaggcggccttcgtccggatgcttttcgcaccaatgcgggtcgatgttcgcgacgacgttcgtcacgtcgtgcacgtagtcgtcgcccacggcctcccacatgcggcgtgccacgcgcgtcagcacgaggcgttcgtcatcgccgagttcgtcgagcgccgccctgtcggcctgcatggtgggaaggatggcggtgtgtccggcgaccttcgcgtcgttcacggtcagttcgagtcgcggccgttccggtttcgcggacggttcgatgaagccggtgacgagccggtcgccttcggcgaggccgcgcagcgtgtccaggtcgtcgtgggtgatgtaccgcgagtcggtgcggggatacgtggtcagacgcttctcgtagagcgactggagcgccgtgagggtgcgggcggcggtcaggccgtgcagtctgctcatgtccttctgcaatccggtcaggtcgtacaggctcggtggggcgtcgtgctgctgcttgcgttcggccttgaggatctggaaggtgaaatcgtccgagttgacgatccgcagcagcgtctcggcgtcctcccccttgtccaaacgttcgccggtcagcttccatccgcccatcggggcgacgaccttccagtacggtcgggccacgtggccggcgatttgccggtcgcggtccacgatcatggcgagcgtgggcgtctgcacgcggccgacggtgaatctcgcgttgtagacgagcgaataggcgcgcgacgcgttcatcccgatcagccagtcggccttcgcgcggatcatcgccgaatcggcgagtccctggtattccatctcgtccttcatggacgcgagggcgccgcggatggcgtcctcctccaggctcgcgacccacaggcgtcgcatcggcttggagactcctacatgcgccacgatcctgcggaagatggcctcgccctcgcggtcgggatcgcacgcgtcgacaagcatgtcgatatcgccgcggcgcatcagtcccgcgacgaccttgtactggcggtccgcgcccttgtcccggctgaccttccattgccagccgggtgtcgggtcgatgggcagcgtgtcgaggctccactttccccaatcgtgattcttgtattcgtcgggcgcggccaggtcgacgaggtggccctgcgcccaggtgaccaggtcgccgccgacctggatgtagccgtcgtgtttttccgcgtgcccgccgaccgcctgggcgatcgcctggccgaccgaatgcttctcggcgatgatcagtcgcatctcgcatcacgtccgatcatcagtagttgccggacgcccatgcgggccgtccgtcgtccgaggtgtcgggttcggctgcggcctcctgcggggcggtctcgtcgtccgccgcatggacgtcggatccggtcgtctccggatccgattcggcgacggtttcccgttcgggttcggcgggcggggttttccttccggccggcgcggcgacgagctcgcccttagcatcgaacgcgacgttcttctccgttccggtcatcgccagcttgtccgcgatcatcgtccggctcatgccggggaacgcctcctcgaattgcttcgccgcgtcgcgcagcacctgcgcgcttttgcggaaattgtcgagacggctgtcgaacttcttcgccgccgcctccttgcgcttgaacgactcgcgttcgtcgcgcaggaagtcgtccacgtaatcggatgccatggtcgtgttcctttccgttatcgagatccggcccatgccggctatgaaccatgctcccgccatgtggacggctccggtttggacaatcggctccgccaggatcacgcggacgtgatcctggcggagccgaggaaacggagcggcggcatggatgccgcgctctgccactgccaacccttcctgtatttccaggcgtcgcctggaagggaatggttggccggccatggttcatcatcgcgacaccgcgcccgcgtcttcgggcctgcgtgttccatgcttcgtctcgggaagggcttcgcccgattctccctcgacgggcacggcccacgcgtcctccgccgcgcggcggcgccgcaaggctgccccatgtccggcgaaaggaaacgccggcggaaccaaggaggaaccatggaaaagaaatcaaccgaccttcagcacgtcgtgttcgagaccgaggaggcggggcgcgtcgaggcgatgtggagcagtctgcgcctcaacggccaagatgttccggacgggtggcaccgctacgccgtcaggggcggggacgacggatgggagccgtgcagcatcgaaccgttcgtgtgggtgaaccacaccgccgacatcatcacgcccgtcgacctcgagctcgacaagcacgaccggatgctcaccatcagggactggtggtttgacgacgagccgttcccggccgagtgacgggccgggaacgatgccgcccgcacgacgcgggcggcgcctccagcggccagaggacagctaccgtcctctggactccaatatcctagaatggaatacaacgagagccaggaggcgacggacatgaccatcgactattcaatcaaagtgacccaatgcgaacccatgcccggctacaagctcaaggtcacctgttccgacggggcgaccggaatcttcgacatgtcccgatacgtcgaacgcggcatgttcaaaccgctcaaggacacgcagacgttcggccgcgtgcgactcacgttcggcgtgccctcatggcccggggacatcgacatcgccgcggaacgcgtccgctccggcatgcaaatcatctaggagcccgcgcgcccctgccccgaccgtcaccaagacggccggggcttttttcatgtctgcatgcatgacggacatgacgcgccgccgaccccgcgttttttcgcgaggccttttcatttcccgcgctccaagtgtccaaacccatcgccgttcccacgacggacgattggcgtaagacaccggccttcccctcaaggccatgagcgaaaggagcgaggagtgaacgcgatcatccttcacggcattgcgcaatcatgccgtgcgaaatcgctcccaatccatgaaatggatatgggagcagcaagcgacgtgattggatatccaatcactcgattcgcgatgcgaatcggcttgccgggaagacccgtgccccatggtcggcggagcctccagaccgctcgcgcggcatcacagaaaacccgtccccacacctcacacggaggcgtggaatgagccgggccgagaacaggacgcactgcgtcgagaagatcatcaggttcacgccggacgagtgggagcgggtgcggaagctgtatgaggagctgaccaggtacgcgccggagcaccggtcgttcagctcctacgcgcgcaggatgctgtccgaacggcgcatccacgtcaccgagatcaggccgctgacggacccggagccgatcgcgcgcgagatcgaccgcatcggcgtgaacgtcaaccagatagcccactgggccaacgcgaacgagcacatcaccgccgggcaggtggccgagctccgcgcgtcgttcgaccgcatcgagcgtctactcggcgacctgttcgccgacaggcgcgaagcccggaaggacgtgtgagcatggcggtggtcaagctcggcaggcccgtgaaatcgaatctcggcggcgacaacggggcgatggcgtacatcatcaaccccgccaagaccgacggaggaagactggtcagctccaactacgagcggaccaggacggactacgacgcgctggccgaaggcatgctcgacgacaaccgcaggtcgccgaaaggcatccggaaggacagccggctggcctaccacatcaagctcagcttcagtcccaaggaccccgtgacgcccgagcaggtgcacgagctcggcgtggaattcgcgcgccggatcaccggcggcgaatacaagttcgtggtcgccacgcacaccgaccggcaccacctgcacgaccacatcatggtgtgcgccgcctcccggtacgggaagcatctgaaggccgagctgcccaaggacatcatcgaccagtggcgcgcggtcagcgacgagatatgccgccgcgaggggctgagcgtcgtgttcaaccccgtcgtggaggaacagacgcgcaagatgcgtggcggtacgacagccgccggcgacgccggaacgtcgccggcgcgcgaccccaaatacgtcgatgaagcacccgtacggagcgcgaacgaaccggagacgaaggcgcggaaggcctcgggcggggagccgttggaacgccggtacggcatgtcgatggaggagatctacgcgtccgcgaaaggcctgggcgtcaaggacaggctccgcatgctgatcgacctgacctcgtccacggcggagaacttcgaggactggaaggacatactcgacatccgaggcgtggacgtgacggtccgcggccagcacctcacatacacgctcaaggacaccggcttcaagatccgcgacgcgaaactcggccaggcatacgacatgacgaacatcatggccgggctgcaaagcacgcccgtcatccccatcacgttcaaccgcagactcgtcgccaaacagaccaagaagacgatcaccgtgtggctgccaggcacccaccggaagaagaagatcacgttcgacgcgaaacgtctcgtggacgacggcggctccacactgcgcgcgttcctcccccgcgaccgcgaccagatcatcctcgacccgtccaaccggtacgccggcaagaccccgacgcccggcctctaccagtggttcggcgagcccacaagccggctcgaaccactgacctcgcccgaacggctgcccctcagatacggggtcagccccgcccagcagcgctactaccaggcacaggcgcgccgcctcgaccgcctcgccggcgaggcgaaggcgctgaacgcggcgatccgctggaccaggctcgcgggcggcgacagcgccaagggactcggtctgctgcgtgcgaaggtccgcgaatcgcacgacgaactccagtccgccgtcatcgcgttgcacgacgcgatccaacgcggcgaccccgacctcgtggccgagacacgcggcgagatggaacgccgcgaggccctgtgcgaccggtatgagggcgagctggcagccatcgaacgggaaatccacacgacccgcgaccgcgagcaaacggagaccgagcagcgcgaacagcagcagcacaagcgtggacggtccatctgaaccgtcccaggaaacaccaaccgacaacagaaagggaaccgcaatgccaatcgaggaacaggctgaggagaagatccagaacgccgtccagaccatcatcaccggaggcgcgaagctcatgctcagaatccccaagggcgtggccatggcgatgctccgcggcggcatgaaactcgcgaagaccggtgtgcacgccgccggcgaggccgtcaagaacaagatcgacagcggcgagatgtccgagaaacgattgcagcaaaagaaggacggcgacctgcacgagctgcaactcgacgactcgaccatgcgcgaagtacagcacagcctcaagaccgccggcatcgactaccacctcgaacgcgccgaccaaggccagttcatcctgcacttcgccggcaaggacgaagaccatgtccgccacgccgtgcaacgcgcgttcaaaggcatgggcctggacgtcaccgacgacgacttcaccgtcgagcagacggaacagacccgaaacgagccagaacccccggcgcgggagaccccggccgaaccagccacgaagcccatgccgacgcagcgcatcgcctgggacttcgtggacccggaggtcatggagatggccgcgaacagcctcaccgcccgccaccccgaactctcatgggacaagctcatgggcgacacaacatgcgacgagcagtccggccgcaacttcgcggaccggatcatcggcaaggccgccgccgacccgagcctgcgcgacgagctcgacgacatcctgcgcgacgactacgggcagggcgcgcaaacccaggagcggacacgcaagcagacgaccgagccgaaccggaagacgccgacatcgaagccggaaagcgaaccggaacccgcaccggacgaagcccggacaccggccacgcgacagcagacacaggccagagcagacaatcccaggccggccggcaaagagcaaaaaccgaagccgatccgatcaaagaaggcactgcttgaacgcttcaagacccgactcaacgagaacctcgccgaacagaagaaccacatgccacccacccagaacagggaccgcacgccccgcaagggccgctgaaaggaaaaaccacaatgaaccagcaggaacaggcgacgaaacgcgccgcgatcttccaggacaccatcaacgggaccaacgacccgaccccatggccggtgaccatgtgggcctcgtccggcgacacgatatggacggccggcacggcaaggactgccggcgaggactcggtgggcatgatctacgctcccggcgaaaccatcgcccaccggaacacaatcgccggcgacaccacccgcgccaccgaatccttcgccatcagaccggagagcggacagagcccgatggacgcgatgctcgcgggcatcgaacagtgggaccaccgccaccccgaccagtgggacaccgtgaccacaccgggcgagtaccgcatgacggatccgacgaccggccgaccgctcccgatgggatggagcgacagcctcgccgtggccgcgtccgcggcaggccggctcgaccccgacctgctccaggccagcctcatgcagaacgcggtcgagcacgagccgcgcccctgcgtgttcttcctggaggacaacggctacgacctcatggtcttctcctggcatcaaaaccagcagggactgttcgacgcgatgacattcaaacacctgcaatacgacgacctgagcatgcaggtcacgaccatcagccacagcgaggacatgagggaatccttccccgccaagaccatgagcgacggcgaactgctcacccaaagccgcgtctaccgggacgaataccagttctggcgcgaacacgacggcggacccgtcgcccacggcatgaccggccgcgtcatgcgcagcggactgctcaaaccgggactggagcagaaaccgctgctgaacctgaacgacggccggcgcgccccggactgggacgagttcaccgaccaggccgccatctcgatcctccagggccgccccgtctcaccgacgccagcactcccccagcaggagcggcccggacggtccgccgatcccgcggacgagacgccggaacggcaggaaccggcgcacgcgaccacggccacgagacaggtctggccgaacgcgtgggtggcgaacaggctcgcgcacatctatatattgcatgcgaaggacggacgcgactggccgaagatgatcgtcggactcccccgcggcaccgtcatcgacggacaggacctgaccggctgggccaccgacatgttcatgagcggcaagaaccagagtcagaagaacgagggacgggccgtcaacctcagattcagacccggcaccccggtcgaactgttcaccgggcgcggcgcggaacgccgcaccgtgcaggtcgacccgcagacgctcgtccaggcaatcatcgacgcgcagaagcgcagccgagacgccgaggagacgctcgacacggcatcggtggaactcgcctcgaagaccgtggaggaatcctggccgcaaatcagccgcatgcagggccggttcacggaataccggcgcgctggcacgtacaagccggccgtcgcattgaaatgggcgcgccgactcgtcgaccggaccgccggaggggacgagggacggtggaccaaccgccaacgccgtcaggccgccaggctcctcatccaggaactcgccggcgcacaggaaccgatgcaggacagagacaaaacgccgacccggccaaccatcgaacaggacgcggaggcgacggacacgccacggaaaacggaaccgaccaaggagacggaacagggacgggaccacgacgaagccggctcgccggccgccgacccgggagcgaaagccgaaccgccggagacgacgcgccgcgacgatccggagcgacggcacacggacctgaagtcaacgctcgaccggttccataccaagctcagggagaacctcgacggactcaacacagccacgccggcacccggcatcgaccggaaccacggccaacggaaaacactataagaaaggggcgaaccatggcgagaaaacgcctatacgcgaagcagacggccccggccgaatacgagcagatcgacctgttcagccttctcgaagaggaacaaagacaggccgacaggatagcggagcaggtgcgcggatacgagataacggtgggccacgtcgcggtgcaacggctccgcgtgcgcggagcggacgacgagacgatagccgccgtggcggccgaataccgggagaaccggctccgcggactcggccggcgggacgcgcggatcgccgccgagaacaagctcggggtcggcgccgccactcccggcgaaaccacgccgcaacctgtggtaaaacgttttacacaattctccggcacggaaaacaacactgaagaaaggaacaacaatggacgagatgacatggaccgacccgcagctcaaggcacgctacgaggagaacagcaggaagctggaacacctgaaggagacgctgccgaacctgtattccgaggacgcgctgccgtacaaggtgttcacgatgaacagcgtccacggcatccagcggatgcgtctcatctggctcaaggagcaccatccccagtggttcagggagatgatgatggccaacgtgctcgaggagcatctgcgggacatcgagacgcgcacgagggaacgccaggcgcagatcatggaccagctgatggagtccaggcacctgctcaaccggacggactgcctgaaggcggcaccacagctgaccgacctggaccggctcaacgggatgaacgaggcccagtcggagtcgatgagcatggcgatccacgaggtcgtggagagcttctagcatccctcgacgcgcagcgcgcgcgttcgccccgcgaacgcgccgaagcgaacatcgccgccatccagaccctcaagaaactcggcggagacaacggcggccggccctcagcgaagcaaatggatacgctgcgcggatattccggctggggcggatgcgcggacgcgttctcggacaagcctgaatggcggacgatccgcgacgcgatagaacaggccctcaccccggaagagtatgcgcaggcgcgcgcctccacactgaccgcctactacacgcccggcccggtggtcaaggccatgtgggacgcgctcgacatcggccccgcacccatccaggtgctggagcccggatgcggcaccggcaacttcatggccggcatccccgacgacgtcgcggcgcacgtgtcgggcgtggaactcgacccgatcagcgcgcgcatcgccgccgcgctgaacccgtacgccacgatcctcaacgcggacctcgcggactgcaccatccaacagggatcgttcgacctcgccatcggcaacgtgccctactcgggcgacatcagcctcgactaccggaccacgggaggcggcacgtcccgcctccccctgcacgactacttcatcgaacgctcggtggacgcgctgcgccccggcggcgtcgcgatgctgctgaccagcaggtacacgctcgacaaacgctccgagaccatgcgcgccgacctcgcgaggaaagccgagctcatcggcgtggtgcgtctgccgtcctcgacgttcgcccgccaggccggcaccgaggccgtcaccgacgtgcttgtgctgcgcagacgcgaacggacgctcgaccgcacgcccgacgaggcatggatccactccacaccgatcgccgtgcccggataccgggacgtgaccgtcaacgtcaaccaggcggtcgccaacgacatgcccacgcacgcggtgggcgacatcagaccagtgatcggccggttcggcggcgacttcgacgtcgtcttccagggcgacacggaacagatcggcgaacggctccggacgatgctctccatgcagatcgcccacggcaggccgccgttgcagctgggcgagatggaaccggccgaacgcgcggaggtcatcgtccgcccggaccatgtgaccccgttcgaatactcggtcgaccctcgcggcgtggtctggtacggcgacggcgccaccgtcaccgaggccgcccacggtcagggagacgaggcgcgccgactgcgcggcatgatccgcctgcgcgacctggcgcgcgaactccaacgcctcgaactcgaccccgcccgcgtggacgaccccgccgtggaggccaaacgcaaggaactcgaccaggcatacgaccggttcaccggcgagttcggacgcctgaacgaccgcgccaacctccgcgcctacgacagtgaggaatccggccgccacctcgtcatggcgttggaggagaccgacgaaaaaggaaggttcgtcggcaaggcgaaatgcctctcgcagcggaccatcagccccgtaccgcccatgcccgaccatgcggacagcctggacgacgcgctgaacatcagcctcgaccgcgccggcagggtcgacctggaactcatcgcgcgcctcgccgacaccaccgtcgaggaggccgaggccggcctgggcgaccgaatcatacgcgaccccgacaccggcacggtcatgcccgccgaggactacctcaccggcgacgtgggaacgagactcgaccacgtcacggccatggccgaacatctgagacgccgcgccggcaccgaggccatgaccgagttcacggcatccacctacgcgacgccggaggacatgcccgccacggagcgggcaagcgaatggatcagcgaggcgggcgcggacgtgtggcgcagcctcaaggacccgtactccgccgaatcctacagggatccggcaccggtcatcgaacgcatcaacggccgggacgcatggaccatgggctggagccgcaacccggaactcgtcctcgccctcgcctggcgggcggtggaggagcttcccgaacagcacgcgcgcgtcaccctcgaacggtccgacaccggagagaggaagccgtggcaagcgccggcatggcaccaatcgcacggcaccagcccgctgtgggacgcattgtgctggacatggcgcgacggcgacgccccgcagaactacgcgccgatcctcgccgaccgggacatgcccgtcagggacctcgccctcttcgtccacaagatcgcccacaccgaccggctcgacaccgccgacaagacagcgatcctctccaacctgttcgaaagctggcgcgccgacgacgcgaacggccggcccgtctggacggacacgaccatcggcggaatggcacgcactctcatgcccgacaccgacgatcacacgcggctcgccgaacggctcgccaccgacatgtccctcagcgaatggatctggggcatcgcccgcgacatgcccgaagacctgcgccaagggcagaagcacaacgcctacggcgtcccgccacgcgtcgtcgacgcacgccccgacgactaccaggcgttccacacacgccgcgaggaacaaatcaagcaatggcgggaactgccggagcacgccgaggccgcgcgcgccgaccaggcggacgcggaacggctcgaacacgtggccggcctgctggaacgcgtacagcccaccccattggaggccgagcagatcaaggcgccgttgggagccccgtggatccccgccagggacgtccacgacttcatgatggagacgttcaacgtgcgcggccacgggctcacacccggcaagctcgcccaatactcggtcgactggattccccagctcggacaatggcgcgtcggctactcgggcggcggcgacatcgactacaaggccgcgaagacgtacggcaccgaggaccgcaacccgttccaactgctggaggcatgcctgaacaacgcgcagatcaccgtcaccaaggactcccccacggagaccacggcatccggcaaacccaaacgcgtcaaggaccagaaggccacgatggccgccatcgagaaggccaacgcgatccgcgacgcatggaaccaatgggtgttcagggaccccgaccgcgcgcgaaggctcaccgccctgtacaaccgcagattcaacagcatgcgcccccgccacgtcggcggatcctacctgaccacgcccggcatcgcccacggcgtcgccctgcgtccgcatcagaaggacgcggtggcccgcgccctgcgcagcgacgagggaaccctcatcgcccacgtcgtcggagccggcaagacgttcgagggcgtcgccctctcccacgaggcgaaacgcctcggcaaagcgtccaagccgatgctcgtggtccccaaccacctcgtggaccagtgggccggcgacgtgctcaggctctacccggccggccggatcctcgtcatggacaaggatgcgcaacgcaaccccgaatcggtgcgccggttctggggacgggtcgccaccggcgactgggacgcggtgatcgtgccggaaagccggttcagccaactgcacgtcagcaaggaacgccggctgaggaacatgcgcgcccgcgtcgacgagttcaccaaggccgtcgaggccgccaccaaggccaggggcggcaaggacccgaccgtcaaacggctggaggcagcgcgcaaaagcgccgagaccgccatgcagctcctgcgcgacggcaaggagtcccgcgacgacaaggcgctggcgggcatcgagttcgaatcgctgggcgtggacatgctcatcgtcgacgaggcccaccacttcaagaacctcggcgtgcccgtcgcctccgcggacctgggcatgcaactgtcgtcagccgcgaaatgcgaggacctgctcgacaaatgcgaatggctgcgcgaggccggacacggcggcaacatcgcgttcatgaccggcacgccggtctccaacagcatgagcgagctgtacaacatgcagcgctacctcgcgcccggaaccctcaaggcgcaggggctggacacgttcgccgcatgggcgggcgcctacggccaggtcgtgcccaccgtggaactgaaacccgaaggcaacggcttccaggtcaagcaaaggttcgcgcggttccagaacctgcccgaactgatgaacgcggtgaagcagttcaccgacatgatcaccaacgacgacatccagctgcccctgcccgaactggaacaggtgcccgtgccggtacccatcaccgaccggcagaaggaggagatggaggaactgtccgacagggcggaccgcgtgcgcgacggcgacgtgccaccggaggacgacaacctcctcaagatcacgggcgacggacgcaagatcgccctcgaccccaaactcctcaaaggccacgaaaacgaccggccgttggagaacggcaagatccaggcatgcgccgagaacgtcgcccggatctggcaagaggagatgccacacctaggaacgcaactcgtcttctgcgactcgagcacgcccgcatcgggcggatggaacgcctaccaggacctcaaggaccggctcgtccaattgggcgtgccggccgagcagatagcgttcgtgcacgacgcgggcgacaaccccgccaaacgcgagcagctgttcgccaaggtcaggtccggcgagatccgcgtgctgatgggaagcacccagaagctcggcaccggcaccaacgtgcaggaacgcctcgccgcgatccacgacctcgactgcccctggcgtcccgccgacctggaacagcgcctcggccgcatccaacgccagggcaacacgtacggccacgtgcgcgactaccggtacgtgaccgaaggcacgttcgacgcgtacagctaccagaccgtggaacgcaagcaaaggttcatcagccagctcatgagctcgaagagccccgcacgcgaggccgcggacctcgacgccgacgtggtgactctcgccaacatcaaggcgctggccaccggagaccccgacatccaacgccgcatgacattggagaacgagatcaaccagctgaagctcctgcgcgcctcatgggcgcagcagaaggccgacacccgcagggacatcggccagcagctccagccacgcgtcgaactcctgcgccagtcgatccgcgagaaggccgacgacaagccgctcgcctccaaggccctgggcatccaccagaccgcccgcatgaacggccgatgggagggcatgaccatcaacggacagccggtcggcgaccggcagaccgcatgcaggctcctccaccaggccgcccaccaggcgcacgacggggacacgatagccgaatacgacggcctgcccgtcatcgcacgccgcgccgacaccaccggacggatcaccctggccgtcaaggcggtccacgaacacgaatccggcaccgagatgcccggtccatacctgaccggaccatccagcatcgtcagccagctcgaccgactcgtcaggaacatggccaccgaccccggcaagctcgcggaacggctggccgacgccgaaagggagctcgccgccgcacaggagacactggccgaaccattcgcccacgaggacgaataccggcaaaaacaagccgaactcgaacggctgacgtccaaacccgacgaaccccgggagacggaaagtagagaccaggaaaccacaaaaacggaaaggagcgcacgcatgccattgacacgggaagacatcggacgactgctcgaacaggaccccaatatcgacggcatcacccagggcggcaacgccatgggacactacctcgaagcccggctcacggacggccgcgccgtgcagatcgacctccacgacaaccccgcatggaaggacacggaccgtctggccggccggatcgaggtattctacgccaaccggccacaggcggaatggcaatacgacgacaacgatctggccgaccgcgaacacaccgtcatcgaccccgccgaacccgacgcgctacaggagctcggcaaggcggtggccgaatgggaacgcgcgggcggcctccacaaggcccgcgcatccgagccgagccacctggccgcgcaccagccgccggaggaatacgcctaccggtggcggaaacccggggaccccgacaggcacatcgcatacctgagcaccgccttcgaccgcgaccaggcgatgaaggcgagggaggacgccggatatctcgtgacgaaggtcgaggaggatccggccatactctacgagcagcaccgcaaggcatcctgcatgcgcgcgagccacatcctggaacgatacgaatcccccgacccggccgccgtcagaatcctgcacagcatcgtaagcgaggtcaacgcgcacgaccccgagaacgacatcgccgcctacccgtcagacaaggcgatccagctcgccggcgacggtctcaccgaagcggacatcgcggagaaacgcgagatgggcggatgggatccacggacggacccgctcatgcgcatcaacgagcagggcgactggacgggcgtcacccaacagcaggccgaccagctcgtctgggagaaccgcgacgagatcctcgcccgcgcgtcatacgacggcgaactgtccacttggacgctgcaccagctcgaccagctgaaggagcacgagccggaacgaggccgcgacctcgaccggccggagccggaacgcccggcgcccgcgcgggagcagcacacacccaaacgccacggactgggactgtaggcccacacacccaccgggggcggcgcgcggcttcgcacgccgcccctcaccttataggaggaacatatggcaacggaagaacagcgcgccacggagcccgtcatctggttcgagggcacgctcatcagggacccgcaaccacacggaggacacgacgactggctgctcgaggcactggtcgatccggacggaaacgggcgaaagatcaccatccatgccagcggcggggatcactcggagaacatcggccgcaacgcgcacaagggagcccgcctcatggtcaagggcaccgccggagacgaggaatccggcatcgacatcgaggccacaagcctcgcattcgaccccagccacgacgagccggacggagagcgatgacacggaccaccgtcagcgccaccaggccggacaagaccggtgccggcgaatggatcgacatccacagccgcaccggccggctcatgtccacgctcatggccgacggccaaccattcagcattgacgtcacgccggacggcatgaccaccgtcacgcccctcacgtccccgaaggacgcggcgcaggccgacggcgacaacgccaagaccgggaccagcccggacggcgcgaggatcaccagcaggaagacgctgtacgagcggttcaaaaccaaactcaaagcgaacctcgacgaaagaaaacaatagaaaggaaccatcatggaacgaataaggggaatcgtcgtcaggacgctgaccatcctcgcgggattctggatcgccgacctcgcggccgcacgcgtccaggccggcatcgcggccggcgaaagcatcgaacggatcatggatggcatgacgaccatgttccagcatccgaccgccctgggattcgaccggaccagcctcctatgcggactgggcggcgcgggcgcggtcggcctgttccacctctaccggtggagtatgagccaacgcaactggcgcgaaggcgaggaatacgggtccgcacgctggtccaccagccgggagatggccccatacaccgacagcgacaccaggcagaacctccagatgacggccaccgagggcctgagcctcgacgcccaggccacgcgacgcaacctcaacaccgccgtcatcggcggctccggctccggcaagaccgccacccacgtcatccccaacatcctcaaaggcagcatgaactacgcgtgcaccgaccccaagggcgaactctacgcgaagaccggtggaaaactggagaaaatgggatacacggtccaacagctcgacctggtggacctgaccagctggacgaaattcaaccccatgcgctacatcgaccccgacaagcccgacgtggcgataatgcgcctggtcaccaacatcatggacaacaccaatggctccacacccaaggagcaccagaccaacgacttctggaccaaatccgaacgcagcctgctgaccgcgctcaccgcgttcgtctactacctgcccgacgatatcctcaaggactgcctgaacatcgaagccggccagaccctcaacgcggtggccgacatgcgcgacctgctcgaggccagcgaacaggacgagaccaaggaaagccaggtcgacgccgtcgcccggaccgccactgaaatatacgaggagacccgcgccgaatgggaacgcgagggcgcggaccacgacgacccggacctgcgggaggcatggcgtctcgcccagggcctgaagttcgccgcccgccagtaccggcccttcacccagggcgccggagataccaagaagggcatcatcatcagcctcggcgtgcgcctcgccccactgaccgtcggcccggtcagggagatcctctccgacgacaacctcggcatcgaccggatcggcggataccaggacgagcacgagggcggctacagacgtcccaacgggaagacggctatattcctcgcgctgcccgacgaggacccgaccttcaatttcctggccgcgatcctctaccaatgcctcttcgacagcatcatccgccgctgccgcatctaccccggcgaatgcctcgccacgccactgcactgcttcctcgacgagttcgccaacgtggggcgcatcccgaacttcgacaagctcgtcgccacgatccgctcgcgcaaggtcagcgtcagcatcatcctccagaccatcgcccaattgaagaccatgtacaaggactcgtgggagaccatcgtcggcaactgcgacagtgtgctcttcctcggtggcaacgagcagtccaccaccgaatggctcagcaaactgctcggcaaggagaccatcgacatccgcaccaccagcgattcgaagggcgtgtccggcagccacaccaccaactaccagcgcaccggacgcgaactcctcacgcccgacgagctcgcccaattggacaacgacaaatgcatctacaacctgcgtggactccacccgttcctcagcctcaaggcatggcccggaaccaccatcgccagaccgaaatccacgctcaagcactccaaagaatggaaggcagcggcatgaagcccaacagctacaagttcattgtctccacgaatttggatcgcatggaccgtacatcattcgtctccatcgccccgggaatcgctgtcagagccgactattgcatccgtgcgatggaggaccgcatcggaaaatacgacatccgcctgcacatggggtacagcgaggaagagcggcgcatcgtgttgcggaactgcgagatcggcaccacgcgcgaacttaaaatcagagacatcgcacggctgcccatcgagcagatcatccgttcttatcatcccccactgtggtcttatgagatcacggacagcgggaccaatatcttcggcccactgccggattgggaacatgatgtgctgagcagcgttgattttcccgcgctccgcaagcaaggccctacacccgacaccttgaaatgggcctcacgagtctattcggtcgctcagctcaacaaaggtcccgcaacaaaacgtttgacggaagtcttcggtatccctctgcggacagcctcacattggctgacgctcatgaaagagcgcgttcccgaatcagtttcgacgaggctcccatcacccatcaccgttcacgacgaaaccgaactcgacacagctcctggcatctctctaaagaagcttctggaataaaactgtctccttcggcaacgtcgaaggagacagccaaatcatgcccatatattcttacaacaccaagtccggcgacaaactgtatcgagttagctaccgcgacccgaatcacattcagctcactaagcgtggcttccggcggcggcagccgcggctgcttcctgttcggccttggccttcgcctccgcgtcggccttctccttcgccgtcttcgattcgttgacctctttcacggctttcgcgatggcgtccgcgtcacgggccttgaccgccttcagcagggtctcccgggtcttgtcgtccgccatcttgccgtcggtctccttgtacagcgcgatatcatgcgacggatacgagttagatgccgacaatggacaaacccgaagcatccacataattatgacaaggtgttgttaccctcgtcacttatttgactaagagtcacgttggcatatgattgcatggtcatctttctcgatgcgaacatatattcagaatagtatcctcttttattcgctgaataagctatctgatattcatattgtttaacgttcttatcggaatacaacctgcatatttgaggcgctttgtcataagtgagtatccagttccaatccggctcagcgacgaggcgcttcgcaaccagagagtggatggttgcggttgcatatgaattataaagattccgtccctgcacatagtaaggaggatccgcaaatatgaaactgttcttcatatcgcagaatttgccatcagaaagcaatttgaagaaatggctggcctctaggttgctaacagtgattctctctctttccgctgctattcgctctatcctcttcttgagtgtgcttttgttaaatcgagaagaaatgttgtatttcccgtcttgggcggcacctcctatcggcccacctttgatgacgccacttacgttcatgcgattaagcatgaagaagtcgaatcctttccgtcgaatatccgaataatggttgaaatcgtatcttttcctgatagccttccagtattccgagtatttcgaagattgagccgtgggcttttcatccgaatagtcaaaggggacgcggtcgatttcacgtagtagatattcgggttcgttgacaagagaataccaaaacgaatatacgccgtcatcaaggtcgttgataataactgcctctacacgacccgacaacaaaagattgatagcgacgcctgctccgcctgcaaaaggctcgatataggttccggttatatggttagtctccaacacgtttgccacgaaacgtgtgattttgcctttcccgccggggtatcgcaacggggtattggaaccgtttgtcagcttgctttgcgccataaacatgaatgatattagaagattcccattttggccagttcgttcgagtcatacgccctgttttttgaactgcacatattgctgacagagcatagcaaacaataccgcatcattcgacagcctcatgatggtatctatgtcgtaatccttcatagacttgtgcgacccaagcgatgagtattcaacggactcgccgaaatcggtattttcgattacactatgagcctcttggtaggtgtcgaatacaatcctcccggcctgcagatagtcttggaatttgttgtttttaaacagtctatggacatatgagacgttctctttatgctttgcgctgacccctatgttgggaagatgaatctcatcgcaggatttgtccaatgcaagaagtgacagttcgaagatcacacgtatcgccggcgcaatcaagaatgctttcgcccatcttttggtgctgtcgtcctccagtactccatatgcgttcaaagcggaaagcataaagttcgtgtcttcgaattccggcgcgtcggtcatccattccggattgttgtacatcgcaccgaggtgccggtctcgatttgtggcgaacttgctggcgaaatcatgattgagacgtttcgcggcaagtcttggcgacctgaccgttccttggcctttttcctgaagaggaatgattatgtcctgcttgatgacatcgttcttgaggcgcgaaataagggtgccgttctcttgacaataccccttaacctcatcagcaagttctttgactttgtccagttgctcgggggttattatatccggattcttgatatcaagatattccttgaccggagccgagttgaaaacccttctcgtgctggtcgtagcgttcgaacctccgagatagcttgtcaaggaatctccaaactgattctggaacggcgtttcaagcttgtccgaaaacgtctgctttcctgaaaagcgggctttggcctcagtgctccatggaatcgtgccggcaccgtcctgagggccgttgtgctttcgattgaggatttccctcagctcatcctgttcatcgtcgccgaaaacaacgatgtccagactgctcggaatgttctgcggatattccgcaacaaggttcttcaatctcttgtaatcccggtcatcaagaagttcacggtaacaatctgggttttgcagcaatttgattgcagacaatctcctattcgcatcgtgaatcacatacttgtcgccggcccttgtcgcaaggatcggctcaacatcgttctgatagccattctccgctattgacgatgcaagattcatcaattgccgctttgatgtcgattgagactgtgcgctgaagttatagattttattgagttcatccatctggtcgattgatggttcaactctcgggttcgtctcccagagacataaatccgatacatcgacatttatacgttccataaatagttcctccgctccaccaaaacaaactcaattcattaccttatcctatgtccaatgatatccccagacctcagtgttatcctctccccgttatctaattgaaagtacaacacacccgttagattcagcttgatgatcccgaacaccgcgcacacttggaggagctgtgccagcggttgagagcacccatacatgagtcagtgcagccaacatacgaggaggtcgccgactgggtgcataacctcgcgttgtccgtctgccggagagagcatgaagtcttcggctttcccctgcgaacggcctcgcattggctgacactcatgaaagagcgcgttcccgaatcagtttcgacgaggctcccatcacccatcaccgttcacgacgaaaccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcccgaatcagtttcgacgaggctcccatcacccatcaccgttcacgacgaaaccgtataaccgcgatcaaaaacggaaaacggctaaacgcagccacgatacgagccgactgcgtttagccgcataaatgtcgccaacgcgacgattaagcgatctacaatggccaagcacaacaatacgccggagattgcattaaccaaaacctgagactctggcgcggcgggtgctctaccggtcagagccccggatcgttgccgggcaagccggtgccctcgtctgatggcgcgggcacggaccatcccggcgaggctccgaccgtattggcggaggacgacgagcctcccgaagacgggcgtcgtccggttccggaaccggatccggaacttccttgggattgcgattggcttcctcccgaatatgagggcgtttgccgctgtggagccgattgggattgcgatgcctgcgcctgctgctgcgcggcggcagccgcggctgcttcctgttcggccttggctttcgcctccgcgtcggccttctccttcgccgccttcgattcgttgacctctttcacggccttcgcgatggcgtccgcgtcgcgttttctgatggcgtccatcaggcttgcgcgggtcttgtcgtccgccaccctgccgtccgtctccttgtacagcgcgttcgcgtcgtcgacggtcttgtcgagtttgctgtcggtgacggccttggttgcggtcttgaggtcggtgagacggttcttgagctctttggtcgttctgcgcagcgcctcagtggtcctgtccacgtctgatgcggcggcgtcgggcgcgcaggaacccttgattgtggtcgtctttgcgtccaggagccgattcaacgcgtcaagcgtcttgggatccgcgacctggccgcgactggtgtccttcagtagtttggaggctttggccgtggtcctgtccaggtcggactggatggtcttgcgtgtcgcttcggccgagtcgcatgcgctgattgcggtctcatgcgcctcttgccgcacggcggcggcgtggcgggttttgatttgcggtcctatccaggacacggcgatgaggctcgcggccatgacgatcgcgacgagcgctttcccgaccgggaagacgcggcgaaccttcagatcgtcgaggtcggccgagtaggtgacggccgccgacagccctcctggtctctcggtcttcccggtttccgtcggttccggttccgatatgggcgggaggctcattgcggttggctccgggtcggcgacctgttcgagtgccgcgaaatcgccgtcggcgtccttcggggccttctccgcggaatcgtcgggatgggactgttccgtttccggttcgtgggaagaaccggaaacggaggattgcgaccgggatggctcctcgtccatagatgccggctcgggttcctgttctggtttgtcttccggcggcagtggcgcggatggtatggcgacgcggcggcgacggcgcatggattcgggaggcttcggcgccgctccagccgcgtcgaagccctgtgtctgcgcgttgtgccaccagtcgatgagtgccggccatgcgtgcgggtgttcggctatgaggcgcatccacgggcgccagccggggtcgttggccatggcgtgcagctggtcggcagtgagtttggggctgaggatcggctcgcccgtcttcctgtcggtcctgatcatttctcgtcgtccttgtcttcctccggcgtcttgtcgccgaggacggtgtacgcgccttcgaacggcccgctgatgccggtgcatttccagcccttgtcggcggcccatcgccatgtgagggtccatggcgattcaaggccggtccagacgctgcacgtcgcggtcgtggaggtgccggcgttcatgccgccggatgcctgtacgtcgggctggtcggcgattcggtcgatggggatgttcaggccctgcgcgtcggatgcgaagtatcgtttgatgagccggtcgcggtcggcggccttggaggtgtatgtggcggcggccttcggggcgagcttctcgcatacctccaatggtttctggtgtcttgcggccggcgtggacgttgatgtctccgccttgacgtcggatgccgcgagcttgttccgattttccgtgccggacggatgcatgaggatgaaggcgatgttcgcgacgaccatgagaacgacggccgcggtcgtggccgcgatgatgaggatgttccttttgcgctcgtccatttccctttccttcctagtgaatgaagctgacgccgccgcccatggccttgaggtcggacgcgctgatcgtctcggtgacgaccgccatccagcctttgccggattggctgatgaggatcgagccgtcggagttgacctgttcgacgaccgcgacatggccgtagtatccgctggagccgtgcacgccgggctcgaagcagatcacgtcgccgggcttcgggctccggccaaccttgtatccgaggcgggctgcggtgtcgttccattggcctccgttgcccatgtgcgcgtcgacgggtttgccgatctggttgcgtcgcatcgcggcccaccaggtgcactggtaggtgtcgtagtcggggaagcgcgtgtagtgcaggcccatggcctcaatgttcacgtgccagctgtcgctcatgacgagtttcgggctcagcgcgccgacggtcggacccgaatcgccggtaccgcccgaggaggtgtacttggtccgggccaggtcgacgatccgtttcacgtagttggtggtctccgtgaagggcggtatgccgccgtatttcaggacgctgccaaggccggcgttgtaggcggcgagggtcagctggagcgtgtcgccggtcagtttcccggacttcttggccgtctcgacctgcgaggcgaggctgcacatgtagttgccctggctccagatcgcgtcgtgcgggttccagatgtcggccttgccgtcgccgtcgccgtccttgcccgcggacgcccatgtggacggcatgaactgtgcgatgccctgtgctccggcggagctgccggcattcggattccaattggactcctggtcgatctgggcggcgatgatgctcggcgtgacgacctggcagatggatccggcgcggatcacgtcggcctcgtattccgcgggcatgcccgcgaccgtggattcgctggcgctggatcccaggaacgcgcccatgacggccaggagcacgccgagcaccgcgagcatggccgcgatgacgggcatgatgggaaggctgatggaggcggctcctgcgatgacgcgggacgcggccatgcgcacgaagttcgcggcggcgcgggcggcgcgcacggcggcctgtccggtggctttcgctccgcgtaccgccttggccggcgcgcggcggtgccgccagatgaatttggccgacgagttgacgcctttcacgcccgcgcgtgccgctttgaaggacaggtcgcgtgtggtgcttcccagcttcgacgcgaagtcgtcgtcggcagtggtgagccttgcgccggcttcgtccatccagcccatgccggtggatcccatccgtttgacgctccggccggcttttccaaggcccgcgcctatgtgcttgccgatccgcttgctcgccttgcctttcgcggcgaacctgccgatcttatcgctgggcttcgcctcggacagcgccttgggtttgccggccgtcttgcgcattcccttgcccgaccgcagggcgcgtttgccgcggttcatgatgcgccgcgccttgccggccgtccagcccacgccgtgcatggtggaggacatgccgtacatgccggcgcgtcccgccatctcggcggcggtgtgacccatggaatcggtgatgtcggtccggtccgcgccgaactgcgcggcgctggacaccacgccggtggccgcgcgtccgatgcgggcgcgtgtgcctccggcgtggtgggcttgggttccgctcatgcgtttactttccttcctggaaggtcgtggagtacagacggtagaggtcgccgcccgcggggatgcgaccgtcgaacggcacgtaggcgctgccgatcttcatgagtccctggccgggcagcacgccggtgaagtactggcgctgctcctcgctcagggtcagcagctcgcacagggcgtccgcgtcggtgctgttctggctcaggagcatgaggaaatcgctgttggacagcatctcgcgcgcgtcctggaggtcgaggatctcctcgacgttctgcgtgatgccggtgacgccgagcccgtatttgcgggcacgcttgtagatgtccttgaactgggcggcggcgtactggttggagaagaagcggtggaactcgtcgacgtacagccaggtgcgccgcccgttggccttgttgcggatgacgcggttccacacctggtcgatgacgaccatcatgccgaacgtgcgcagctcgccggacaggccggacacgtcgaacacggtgaaccggttggacaggtccacgttggtctgcccgttgaagccgctcatggagccggtgatgtacgggttgagcgcgtcggcaaggtaccggctcacctggtcgccgcccgcctgcaattcgtcgtgcaggtcctgcaatgtgggctggaccactcccccgccctggttgcggtaacgcgtgtacaggttgctgacgcactggtcgacgagtcccttctggagcgggtcgaggccgtcgatgccgcctatgagcgcgccgatcatggagaccacgttgttggtcttgtccttgacggggtcggaggccgaatcatcctccaggacgatgtccatcgggttgacacgcgtgccggtgccggcgctgatctggatgatctgtccgccgaacgcggccgcgagggcgaggtattcgcgttccgggtcgatgacgatgacctcgtcgtcacggttgaggaacatgccggcgatctcctgtttgacggtgaaggatttgccgccgccggacgtgccgagcacgaatccgttggagttcatgtggctgcgccggtccgcgaggatcgggttgccgctcctcgcgttgcttccgtagaacaggccgtgcggctcgaacacctcctgcgtggtgaacgggatgaggatggccgcgctgttcgtggtcagggtgcgtttcatgggcagagggttgttgcccagcggcagttcggccgtcagcccctccatctgcatgaacttgaggctctcggccgtgcaggactgcgcgttgaccttggccttcacgttcctgcacgcgacctccagctcctcctggcttgccgcggacactccgatcacgatgatcgagtccacgagcctctggttggtggagcgcagctcgtcgcgcagttggccgagctgttcctgctggtcggcgaggtcgtcgggaaggtcgtcggggtcgaggccctgcttgcggttcgtgcgccgctgatccatgatctgcatcttgacctcggcgttcttgcggcgcacgagcgtcatgctttcgccgcggtccatgggcgcgaggtggatgctcacgtcgacgcgggcgcgcagtccggtcaggtcgttgaccagctggtcggacagttccggcggcaggccggacacccacatggtgcggtgcaggtatttcgagtccagggattcgatgtcgagcatggtcgggtttcgcgcgtcgatgctccacgggcacacgaggtccttggtgtcgggtttgccgggctgatgctcgaaacggcgttcgtcgaaccggaactcctcgccgggccggagcacctcggccatgaggcgcagccggtgctcgcggtcgagccgggtggccttgcatgcgtcgatggagcgcatctggctgacgaggttgttgcacagggcgttcaggctcgcgacggcggcctgctcgtcgctttcgcggacggtgacggtcagggtcttgacggtgctggtgttgcggctgacggattcgagtttgccttgggcgaggcggttgtagtcgagcctgtagtggtcgaggctgtcgccggtctcgtccatcatcacgtcggcgaggatctcccgcacgccgcgtgagcgcgtgtaggaggcgatctgcacgctttgcccggcctcgaagctgttgatgagcttggcccaccggtcgatgatctccatctgatgggattccgggctcagctggtagttgatgtcctggaagaggatggtggcgctccaccgcccgtcgcccaggctggcggtcccgttgcgcagcatcgcgtcgtagccgatgagctgcttgacgcccttcggcagacgcgtcgccttctttctccgcgccttcgccctggcttcggcaccgccttcggccggcgcggccaccggggctttcttctttccgaacattcctcacctttccttgatcgttggtttcgcgccggtgcggtatggtctgcccggaccgtcgagcaggtagacctcgcgctgcgtgtagtggcgcaggatgtatttcaggtatttctcgggcatgaggccctttggcctcacccatccccatatggccacgggcaggccgggcgggaagatcaggtacatggcgaggttggggtccatgcccaacccgagccacaggccgatgtaccctcccccgcacacgacggcgaggatgacggcggcgaggcactgccgccagctcattcccatgaacaccttcgattcgatggtggtcaattccctgtagacgggcatctgcaacgccatgatgattgcttcctttcgtggattgcgttgtgtttcattcgccgccgaagagcttcttggcgacggagttggccgccatgacgacgccgatgagcatgacgctcgccaggagcaggccggtgaagttgcccatcacccagccggagaggctgtcgccgtccttgaacttgctcgggttgagcgtgccgcccacgagcgtgcggtacatgaggatcgccagatacagggtcgcgcactggaacaccagcgacgcgtactgcttgaagtagttgatgccccactggcgggtctcctcctgggcgatgaacgcgatcggcagcgggttgaacgcggtgagcatgtatatctgcacgaaacgcaggaggatgacgacggtgacgacgatggtcgcgcccttggagacgaggaacgggatgagcagcaggatcaggcacggtatctggcccatccagccggcggagtcgatggcgtcgcgcatgctgtcgccaaggccgaggcccgacgacgcgccgctggtgtccaccgacgactggatgccgccgagcacgctgtcgccaatctcgtcgatggcctggagcatgagctcgctgtgctgggccgcggtgaacacgagcgtgagcttgaacatcgccatggcgacgagcttgacgcccagctctcggtcgccgtccgcccgggtgctgaccctggcgagttccaggacgcacatgatcgccagtatcgtgctggctataggtttgaccgccgagagggcgacggtcaggctcagctggtacatgtccgcgttgtattcggcgggggtcttcagcaggtcggccacgaggtcgtcgccgacgccggaccctatcgagttgaggatgccgacgatgaaatcgaccatgcgtggcctcccgtctacagggcgatgttggagaacagggccgcggccgcgatgatcaggccgccgccgacgacctgccagacgcccgactgggtggcggggccgttctggtccttcaggccgcccgccagggtgaccacgccccacacggcccacaggcctccgccgatgatggcgaactggctgaagagctgcaacgcgctggtgacgacgctgccgctgtctgccgcgatggtgattccgtacatgatgttttcctttcgacttgttttgaatgacatgaccacggtatggccgtcgaaaaggctccggtttggacgttcccgacgaacccgaagaggctcggacgatggtatggaaaaggccccgccgaccgttcgccggtggggccttggacgcgtccgggaagggaagggatccgggcgcgcccgtgggcccgtgcggcggatcatggcgaacggtccgccgcgggcccggggtcaggttcgtcggatcactcctccgagccctcggtgtcggccggggccttcgccgcgcgtcggcgggacgcgatcagcaggcccgcgccgccgccgaccgcgacgagcacggccaggacgatcgggacgatgcccgcgccggtgatggcgagcggcttgggacggtagccgttccagtcgtccgggttggagtccaccgtggtgtcctcgcacagggtgcggccggagacggtgacctgcttgaggccttccgccttgccggcgtcgccgtcgacggcctggtcgccctcggtcctgccggactggtcgccgagctggtcggtgacggggcattcgacgagcggggtgccggtgaccttggcgcggtcggtgtggtggccgccctcggtcacgcccttgagggtgccggtcacggtcacggattcgccgggcttgaggaccagggtgtcccagttggccggggtcctgatgtcctcgaccttgcccagtccggcgatggtgccgtcggtgagcttcaggtccttggcctggaaccacgctccctcgccggtcgtcggatcgaccttgctggtgttggtgatcttgaacgcgatctccaacgagtcgccgtccatcttgagcgcctgcttgacgtcgtcgcggtcgccgagcttctcgccggactccgcgtcgtacttctccaggtgcaggctcggggtcatgtcgggcgtgcgggtccacacgacgttggattcgaggtccttgccgttgaagtgctcggtgaaccggttctcgacgcggtcggcggtcttgatgcgcttgcactggatgtacgcgcgccagccgttctcgtgggcggtgtcggccgagacgagcttgcggtaggcctcggtggcctcgacggtcacgacgccctggtcgtccgcggacgcggtgaacaggtcgccgccgaacttcgagccgtcgaagccgctgccggcgagcttcgcgcccttggcggcgatgatctcgccgtcgcggtgcaggtcgcgggtcgcgtacacggcccactggccggtgtactggtcgtgctcgacgtcgagttggtcggtgatggaccaccggtcgacctgcgggtaggcgcggtcggcggggatcacgctggaatcgagcctgtagaggaacgtgcggccctcgtacacgctcttgccgttgacggaatcgccgccgaccttgacggtcacgtccttggccgggttgaccggcttgagcgggttggacacctcgttggtctcggccttcgtgtcgttggtgacctggacggccttgttcctgacggtgtagccgtccgtgaccttgacgaccttgtacggcatgacgacctggtattcctggccgagcagcgtctggtcgatggccggctcgttgagcgggtcgtgcccgctcgcggaggcgtaggcggcgaggtcctcgggctgcgggtcgcccgggatggtcctgccggtcttcggcacgaacgtgtccacggtcttcgcgtacacgtaggcgacgccgtcgcggacctggacgttgaacctgccggtcacgtcctcgccggactggtcgagcacctcgatgtcggacgggaggatgctcacgtactgctcgtcgtagtcgtcggtgatgccggcgcgccacacgcggtacgcgttgtccttctgcttcaggtcgagcgtgaccgtgtagttgccggtgtcgccgagcagcatggtcttgccgtcgatggtgacggtcgggtcgccctgcgcggaggactgggtgtccttcttgctcgggtcgtgcttgggcgggttgttctccacgatgttggacggggtgacgctgccgttcagggtcagcgcccactggttgccgaccttcacggtcgtgggcgcgtcctcgctcacggtgccctcgaagcggacctggacctgcgggtgcgagcccttcgtccagtgttcctgcacgtacttgtcggagtaggcgatggtgagctcgtggctcgcgtcgtcccatacggccgtgtagtcgccctcgacgcccatctgggggtcggcggtgacgagcggggtgccggtggcgaggtcggtgatctcgagggtctgcttgtccgggatcaggtactggtcgtacgtgtcggtgtcacgaacgtgcacgacgtcgtaggccaggtcggccggcagctgcggcttcgtggtcaggcggtattcgaccctttggcccgggtacacgaccttgtcgttcgcgtcctggttcgcgccgccctggctgccttcggctatgaccttcttcttgaccggcggcacgtagccgcagatgtacggctcgttggtcggctgggtctcgtcgttgaccttctcgctgcccgagttggccagcttggagccgtcggggttctcgcagaacgtgagctcgtcgcccgcggccttgttgaagtccttgcggacctgggccgcgcccttgccgtccgcgaagtccacggtgccgggcaggaacagggtgatctgcttcgggttcttcaggccgacctgctccgcgaggtagtcggcgtgcgccttggcggtgaccctggtgccgttgacggtgatgtcgaagcggtcggtcacgtcgcggccggtgttgatgatgtccgcgacgctggacttcgcgtcggtggccgcgtcggcctcgtacacgcggatccggctcctgtcgccggtcaggtcgaacaggtagtcggccttggcgtaatcgtcggtcagggtgatgtcgttgaccttggcgaggtcgttggcgatggtgccgttgacgacgctgccgacctggtcgccgtcgaggaacttcatggtgtccgcgccggtcttgttggattcggacgggtcgatgacggcctcccatttgccgttctcgaggcggatccagctcttgtccgggttcgggctccattccttgacgggcggctcgttggacgggatctcctggtcgttccacttctcccagccgccgttggtcatggtgaccttctcgccggccttgagcacgcccttgaggtacgcgccctcgacggtcatgcgcacggcgcggtcggcggcggtgttgtaggtcgtgtcgagcagggacttcttggcgctggcccacaccttcgtgccttccttgtggatgtcgaaccggtcggtggagtccttgccgtcgatggtgacctcgacgctggccttgtccaggtcgatgtacttggccgccttggcgaagtcgtcgccgatctcgtaggaggtcatcttcctggcgagattccccgggagcttgccgttgacggtcacggcgaacgtgtcgcgctgcacgaacgtcttcgtgtcgtcggacgccttgttggtccatgcggggtcggacgactgcgcggccttggcggcgtcgacgctccacaccttgtcgggcttggggttgcgcacccagacgggcggttcgttcgtgccggtggtctcgttgttccacgtctcggacgccttgttggtcagtttcctctggtcggccgcccagtcggcgttcggggccttcctgacgatgccgccgatgtacagcttgaccttgcggccggcggtgcccagcgcggtcctggtgaggaagacgctcttcgcggtcgcggtggtcgtgtgcttcgcggtgtcgatggcgatgtcgaagttcgcggtctcgtcctcgccgtccacgtacacgcgcacctggtccttgtggccccagtcgatccactggctgctggcggtccagtcgtcctggatgctgtagctggtgaacgggttcaggagatgggcggggatgcgtccgttgacgacggcgccgatcgcgtcgccggtcacgaacgtgcggttgtcgctgcccttgtcgttggtgtgctgcgggtcgtcggccttcagcgccccgtcggggtcgagcacccacaccttgtcgggcttcggggtgaccttgccgacctgttcgctgttgccggtctggcagtccttgccgtcgccctgccagcatgccctcgaatcgtcggggatgtcgtagtcgacgccggtgggcttggccgcctggggcacgttgagcgtgtaccagccggacgcgggcctgacgacgtgcgccttgacgatgcgcttgcccgtctggccgtcatcgatcgagatctcggcctggacggtcttgccgtcctcgtcggtcacggtgatcttggacgggtcgtccgtttcggtgccgccgatcacgacctgctgcgagctcacgtcgatggtgtcgtacagccagaaatgctcggaggcggagctgtgcgccttgacgtgcgcggtgtagaggctgccggacgcgatctgaccgttcggggccgtgacctgcccgccggccgcgtcggtcagcgtcttggagggcggcgggagctgcggcgcggaccactgctcgttcgcgtccttgtcgccgttcagggccacggcgttcttcatcctgccctgcttggcgaagctcacgtcgaacgcgaacctgccggccggccagctcttccaggaggcgtccatgtccttgtaggagaaggacacgtcctggctcgcctggttgcctatggtgaactgcttgctggccttgcggatggtgccgtcgacgcctgtccagcgcagggtgctggtgccggtcaggttctcgctgatcgggctgccgttgcggctggtggtgatcgtgtcggccacattgcgcgtgtcgccggccttggtggtggtgccgttcgccttggtggacacgcccaggtcgtagttcacgggcggttcggcctggttgagcacgatcgcgatgaccgcgaccggcgccttgttcatctcacgggacgccaatgcattaatggtcgtcgtaccgtcagcgaacgggctggaggtcttgtatccgacgccctggtaggtgtaggtgttgttcgggatgccggacgcgacgtaggcgttgcgccatacgtcggcgttgaaggtgccgttggcgccggtgtagtagtcgccagcgctgccgggcgtgtggacgaagccgaggccgacgagacggcactgggcgttggacaggccgtcggccttggagcggtccgcgcattccgtgttcgcctggttcagcgcctggtcgatcgcctggttggactgcgcgacgccgaggttcctcacgccgatgctggccatcgcggcgacggcgttctcgcgggtgggcgcgccccaggagtccttgtagacccagctgaccttgccggtgccgatgccggtgccgccgccggagccggacccggatcccgcgccgccctcgccggcgtacgccacgcacggggagagcagcgtcgccgcggcgacgatgccggcgaccaggggcctgagcccgcggcgcttcttgtcgttcttttcggaaaccaatgttccctctcctttcagggattcctgtcttgcgggtcgccccggcggtgccgccggggcgggacgtggggaacgcgtgttcccccggtccgccgtggggcgggcccgtccggatgttccacgcgggcgggcgccgataacatgcgatatcgggcgcgtccggtgcacgcacaccatggaaccaccgtccggggggcgtcggtttggacatccgccggggatgggaagggccccgcgacggatgccgcggggccctgaaagaggagaggggatgggagggaatctaggcgagagggcagaatttgccgggctcacacacggagggtccgacataatcccagtcgaatccgtccgctgctccggcgttggggtcggtccatgccgatccgcccgatgacgaggagccgggcgagccgccactcggtgtggacgtgttgccggaataaccgttgccggtgtagccggtgtggcctgaaccggacgagggccatataaaatcaaccaaaaaagtagtacaaacacactcttgagttctcaaaccaccaccactcggccagctcagcaaccccagtgaagaagtccatcgctaaccggcagcgagtagataacttacacgagttggccgaccaacgcaaatcgacatgccccaagacacccaaaaacgttgaaacaacaacattccatcggcgtgtcgaaaatcgtcaaaatacgccttcaatagcaacttcagaccgtctttcgtttccaaatcgttaggaaaaccgtccttgtacggcgtgttgtgcaatgttccccacacggacggcggccattcacccaccgttcaacgccggaaggcagacacattcctgtggtaagcctgtaaccatgaaacacatcgcagtattgacgggcgccggcatctccacgtcggcgggcatccccgacttccgcggcccggatggcgtctggaccaaacaccccgagcagatgagcgtctatgacatcgactccttcctgtccgataaggagaagcgcgaatactcctggcgctggcagaaggaatcaccggtatggaacgcgcagcccggagccgcgcacaaagcactggtcaaactggagaaagccggcatgctcacgctgctcgccacgcagaacttcgacgcgctgcacgagaaggcgggcaacagcccggacgtcatcgtcaacctgcacggcaccatcggcacctcacactgtatgaaatgccatgcgaaatacgacaccgccgacatcatggcccgcctggacgaagagcccgacccgcattgccaccgcacgcttccctatagtggcggtatgccctgcaacggcctgatcaaaaccgatgtcgtctatttcggagaggccctgccggacggcgcaatggagaaatcctataagctggcctcgcgcgcggacgagctgtgggtcatcggctcgacgctggaagtatatccggcggcgagcatcgtgcccgtggccgcacaggcgggagtgccgatcaccatcatgaacatggggcgcacgcaatgcgaccgtctcgcgtcgcgtctgattcgcgacgacatcgcagttgcgctgccgaagctggtggacgagaccatctctgcggcacagtaacggcgcagtagcggcacggctatgcaacggccagccatgacggccggcttatacgcagcgggggtgcccggacgagatggtccgggcacccccgcatgtcatcggcgtcaaagccgcaccgcttcatttcgcatctgcgaaagccggcggaaacccacggcgtcagtaaatgcgcttgggctggaagcctgcctccttcagcgccatgagaatatggtcgatatgatccggaccattggtctcgacggtcacaccgagtgaaaccgcattcgtatagtggccggacgccttgaactggtcgtgatccagagcgataacgttcgcacgttcacgagcaagcagctgtgccaccttgaccagctgtccaggggtgtcaggcagctccacctcgaagttcatgatgcggccgcgggcgatcatacccttctgaatcaccgcacccatcgtcaccgtatcgatgttgccgcccgacatgatcggcacgaccacgtgcgggccggtcgcggaggcgaacttgcgcgaacgcaggttcaggtgttccaaagccgccagagataccgcgcccgcagcctcgatgaccagcttgtgcttctccagcatcagcaggatcatctcgttgatatcgcgttcggtgacggtgaccagatcgtccatgaactcgttgagcagggcgaacggcaggtcgccggggtgcttgaccgcaacgccctcggcggacgtgacgacctgatcggcctcggtcacccgtccggcggcgaacgagttcttccatgccgggctgccttcggggatcgcgccaatcacgcgaacctcgggcttgaacgtcttgatggcgagcgccacgccggcgcccaggccaccgccgcccaacggcaccaccacgtcggtgacgttcggcacatcctccagaatctccaggccaatggtgccctgaccgcagatgacctcgtaatcgtcaaagggcggcacatagatcatgccttgcgtggaggccagttcggcggcatgggcggccgcctcgtcgaacacgtcgccgtacagcaccacatcggcgccgtacgccttggtggcgtccactttcagcgggggcgtaatctgcggcatgcagatcgtcgccttggtatgacgctcgcgcgccgcatacgcgacgccctgcgcatggttgccggcggacgcggtgacgatgccgcgggcgatctgctcctcggaaagcgacgcgatcttgttgtacgcgccacgaatcttgaacgaaccggtcacctgcaggttctccggcttgagcagaatctcatgcccggtcagctcagacagggtgcgagagggaatgatctcagtgtgacgcgcggtgcctttcaaacgcttggcggcgagcttcagctcggccgcgtggtcacgctgcaatgccttaaggacgtctttctgttccatactgcgtattgtatgcgtcgccctgccgaacggacgcggccgtctcacctgcgattgccgcagtcgcggcggcccgtcggaggactggccggaaaacagttgcacgtattcataagtcggcttcgttgcgaggctcccttcgtcgccgggcgtctgatgtatgacggtctcgatggtagacgaaacgtaatttattgccacggtatcgcgtgtttcttgcgcaaggaaagaaataacccgcataccggtccggcaattatcgtcgtgaggcgaagaagccggtgagcagacgggcgcatgccgcttcgcgaacgccgccgacgacctgcggcacatgcccgacatgcggatcgcgggggatgtcccaaatcgaaccgcacgcccccagcttcgcgtcccaggccccaaagacgatgcgtccgatgtgcgtctggatgcacgccccggcgcacatcgggcatggctccaatgtcaccaccagcgtgcagtcggccagattccagtcgccgcgggcctgcgcggcctcacgcatcgcctcgatctcggcatgcgccaacggatcgtgccccgcctcgcgacggttgcgcccccggccgatcaccgtgcctcgctcgtcgagcaccacggcaccgaccggcacgtcaccctgcttcccggcgcgctctcccagcgcaatcgcctcgcacatcgcctcgtcaagttcgcccatgcgcccagtttatcgaaatcgcgctctcaaaacttgcagatacaaaatcagaaccgccattttccaatacatcgacttttgtatctgcgagttttgagagcgcgattcatgaacaaccaccaatcaggcaccatgccgatgccgtatattgaggcttatgggcgaagaagcagcacacgatacgacacgacgtctttccgacgtgattcccggacgattcggcgatccggtctcggtgcagtatgcctggatgtcacccgaaaacgccgaagcgatgccgacacggccgttgttcctcgcgctgcatggatggggatccaatgaacgcgacatcgccggaatcatgcagtacatcgcccctacaacgatgtggtgtcgctgcgagcgcctctggtcctgcacgcgccggaaggcgtatcggccggcgcatacagctggttccatgacgctgtgccttccggagacgacctggatcacgacatcgcggccgccgcacgcgcggtcgaccagtgggtcgacggccacatccccgcgacgcgcgacgtcgtgccgatcgggttttcgcaaggcggggccgtcgcggtccatctgctgcgcatgcacccggaacgctatcgcgccgtcatcaacctgtcgggattcctcgcgcccgcaggcgtgcccggcaccgcgccggcggatgaccggctgaccgacttcgagataccggtatatttcggatacggcaagaacgatgcggtcattcccaaatatgagctgttcgccgcggccgcgtggctggaagagcacacgtggctgacgacgaaaagctaccgcgggctggaccatgcggtgagcctggacgagttttcggatatccggcaatggcttgtattgcacgacatcgcgtccggcgtgctgtgacccgcgcgaccccatcggccgcgcccaccccgttcagatgctgctgtcggcgtccacactcatgacgaacacgttgcggcgcagggccttcgcctgggcgcgtgtgatgtcgcccgcctcgagcatgtcctggatgatgcccagctcgatgccatagctctcgcgcttgatctcttccgcctgagcgatcgccttcgcgctgccgcccatgttcggccgtgacttcaacgcgccctcggcccggcgataatcgaggatcagcgccgagcagtgctccgtacggtaggtgccgcgtcccatctcctcatacagccgatccaccacgtgctccatcacgtcgagctgcagcagccgggagtgcgcgaacatctcgtcctcgctgatcagtggcgtggtacgccggatcttgctgctgatgcgccgtccgagattctccgcacgacgttcgaacgcgcgcatgcgcccgcgaatctgagacaccgcatggcccgaggaggagaccgtggacgtgtgccgcaacgtgttcatgatgtcatccatcatgcgttcgcatgcctccacgcgcatgtcctgctccgccgcatcatccagcgggtgcattttcaattcggcgagcagactcttgagatagtccttctcccagtgcagcgcctcgatctgcagccgctccaatccctgggggtcggattccccgacgcgctgcttcaatctcgtgatgcgcttcgtatacgactcgatgaccatgagcaccgcgcggcggttctcatcgtcgactcgccccgtcagctcctcgacggtcttgcgtaggatctctatggtgatctccgtcatttcgggtgccatgcggtcacggttcggagcgagcagaggcagcatgaaattcgccaatagtagcgtgacgacgatgacgccggatgcgatgaaaatcaactcgtcgcgcatggggaacggcacgccccaagtgacggtgaacgggatggtgaacatcagcgacagggtgatcgtgcccttggcgcctccgaaggtcatcaccgcggcgctgcgccaacgggctggcgtcatcttgcgccgtttgccagtgttgacgtcgcgcgccaaacgcagcatcccggccacccacaggaaccgcatcgtcaccacgaccagcgacaccagcagaatcacgatgctcaggcgcacgttgctcacgccgggatcgtcccaactggcgctcatcgccttcggcagctgcatgccgagcaggatgaacacggcaccgttgaggctgaacgacagcacaccccacacgctggacgacacgatgttggtgcgggcgacgttcggcccgatgccggtccggtcgaaccgcacgaacaggccggacgcgaccaccgcgagaatgccggacacgtgcagttcctctgcggtcaggtacagcatgaacggcaggaacagctccatcaatatgcgggtggtggtggtctcccaacccagcgagcgcacggtttcgaacagccagttcgcgagcaggccaatcgtcagaccgtatacggcaccgccgatgaacgagagcgcgaactcgccggcagcccggccgatcgcgaactcgccggtgatggcggcggcgatggcgaactgaaagccgacgatgccggacgcgtcattgaacaacgactcgcctttgagcacgcccaactggcgcaggctcagcgacgcctccttgcccagcgagctgaccgccaccgcgtcggtcggccccagcgccgcgccaagcgccagtgcggcggcgagcgtcacggacggccagacggcatggacgacgacgccgaccgccaccatggtggcgatggccagtccgattgccaatgacaatgacagtttcagcgatttcagcaattcggatttgtcgatctcgtgcgcttccagatacagcagcggcgcgatgaacagcaccatgaacagttcgggattcagggaggcgttggggaatcccggcacctgcgtgatgatcgcgcccatcgcgatctgaaccagcggagtcgacaccttggggatgaaccggctgacgaacgacgagaatacgacgacgccgataatgcacagtatcagctgaaagacttccaaggctcgctccggctctccgtcggttgtgtgggattacttcacaatataaaccgactccgcaaccgacacgttaacttcgacgtccggcttaacggctgcgcgcgggcaaaaagaaaccccggcggtgttgcccgccggggagagaaaggagagagaagaagaaaggggttcagttattgagaatcgtgctgccgattcccggtcggcttgtgctgacaattaatagtaaaacacccgtttcttggtgcaatgctgagattgtctgaaagcttcctgtgagttgatgtcgcgggctgaatcccatcacatggtaatggctgtagactgtagtgtggcgccgtgcgccatacacgtgagcgcgaaaaggagaatcctcatgctgctgtccgaccgcgacattctcgccgcccagaaggacggtcatatttctcttgacccatggactccggaaatggtgcagcccgcgtcgattgacgtgcgcctcgaccgtttcttccgcctgttcaacaatcatgcctacacatacgtggatccggccgagaaccagggggcgctgaccgagcagttcgacgtcgctccggacgagccgtggatcctacatccgggcgagttcgcgctcggctcgacgtgggagtacgtcaagctcgacgcgacggtggcggcacgcttggagggcaaaagctcgctgggccgtctgggcatcctcacacattcgacggccggcttcatcgaccccggtttcgaggggcatatcacgctggagctgagcaacgtgtcgacgcttccggtcaagctctggcccggcatgaagatcgggcagatgtgcttcttccagctcagctctccggccgagcacccttacggctccaagggcaccggctcccattatcagggccagcgcggcccgacccccagccgttcctacgtgaacttctacaaggccgacgtcaacgactagagccgatacccaagttctttgacgcaatgtgccggcgactccatgactgggccgccggcacattgttatgctccgttcgatgccgtctggcttattggcgaatggcggtgaacagcaccgactgggccggatgcagcgatggagggcgcaacccgtaggtcatcagcgcccggcccgtcatcagcacgccgtctttggtccaccagcccaacggcgactggccgctgccaagaccaagcccgtcgagatcgagatccagccacagcggctgtatgcggtacgtgccatcggggtcaagaccgggcacgcgaatcggcgccgcagggagagtctgggatgttgccagttgcgtgaaccggtagaacgccgcggaacgatccggcttgaccatgccgtcgacccggacggccggatcggcgatatcggcgtgcacgcacgtgtcgatcgcaaaccatgcgcggtgcctcttgtattcggcgacccattcgccgagcttgttcaacgcctcgtccggctccttgagcagattccattcgacgcccatgtgcccgaagaacgccatcgccatgcgcatctcctggctcgtggcgcgatgcgtggaatgtgcaggactcgcccccacatgctcgcccatcatgcagggcggcacgagcagcgacgtgtaccgctgaatatcggcccgctcgaccgggtccacgcagtcggacgtccacacgcggctggcgaattcgagtatgcccaggtcgatacggccgccgcccgatgcgcaactctcaatctccagtcccggatgtgcgacttcgaggtcacggaacatccggtacacggcgagcgtctgcccgtgcaccgccggcctgccggtacgtggcgagaccgcctcggtgacgaatttgttgtggtcccatttgatgtagtcgatgcccaactcgccgaccagcgcatcgatggaatcatggatgtatcggtaggcgtcgggattggtcaggtcgagcacttgctgcgagcgtccctgcatcggcagacggttcgcagtcgggcgcagcacccagtcagggtgggcgcgggccacgtcggaatccgggttgaccatctccggttcgaaccacaggccgaactccatgccttttccgtgcacgtaatcggcgagcgccttgaggctcttcggcccgtccggccacacatcctgcgctatttgccagtcgccgagcccggatgtggagtctcggcgggagccgaaccagccgtcatccaccacgaaccgttcgacaccggaatccccggccttatcggccagagccttcaacgtgtcgtagtcatggtcgaaatacacggcctcccacgtgttgagaatcaccggacgcggcttgacggcgagatccgggtgacaggagcgcacgtaatcatggaatctcgcagccacctcgttgagcccgtcaccgtacgacccgtacagccacggggtggtgtacgtttcgccgcgggcgagcgtggcctcgccgccgagcagcacctcgccgccgccaatcagaccggtcgtatacggctgacgctctgccgacagcacggaattgccgctccagcccacatgcaccgaatagacctcgccatgctcgaacccgaagccgggctcgcccgcggaaagcaacagagaggcgtcaaaacctgggcgccccgccatcgagaccttctcgaagcgtccttcggtcagcggctgccgctgcgggctgcgttcgcgcagatgatggccggtggtggtgagtatctccgtggcaagtgccgggagcgggaagccgagttcgactttaccgacttccaagtcaccggtcggaagattaccagctggaagattacgcagcgtggcgcgctgtctgatcagtccgccgggcaacagttcggccgtccatgacagttccacgccctgctcggtatccgacgcggtcacggtgacgaccggcacctgttgcgtgacggtatgcgcagcaccgtccacgccgtcggacacgtcaacgccttggcgttcgtcctgacggattgcgatgccggtcaccgtgaatgcacagaacggcgttacgccggcgcgccggatatccagtcgcggtgcccctatccacgactcgctttgcgtgggcatgatgcttggccaggcggtctcgtccagcgcgccggacacgcgctgcggccgcagggcgtcgtatgcggcgagtacggttcccggcgccgcgagcgggcggccccagtgcacgaagcgcggaagaccgtgaccggcgaagaccagcgcgaacgccacatcagcagccggctgctcagcataaatagcggtgagttccgttccatcggcggcggcgccatggaattgttcgatgagtgacattgcgaatcccttcggaacgtgccattgatatatggttcgcctccgatgctacgacatcgttccgtcatgtcaccgcatattcagcgattcaggggtatgagaagggctcccgttttccgatgtggagagcgggagccctgactgctggtggaggcttatggcattgttatgccataatgccgcgcttgcggtcgatggcgcgcatgatcgccttgtagatttccgaggcgatcagcacgaccgcggcgaggcagatgcactcgacccatgcccacggtccgagcggcgtggtgccgaacgcggagttgaggaacggcacgtagatcaccacgagctgcagcacgacagacaggccgatcgccccccacagccacttgttggagaacaggccgacgaacgcggactgacgtgcggaacgcgatgcgatcgcgttgaacagctgcgcgaacacgagaatcgtgaagcccatcgtacgggcctcgatcatctggaattcgtgggtgccgccgatggagcggtcggtgaacaggccaccttcaaggtgcatgtccatgccgatcaaggtgacggccgccatgatgatgccgatgaacgcgatatcgatccacatgtccctgtcgatcacgcggtcggtgagcttgcgcgggctgcgtgccatcacgtcatcggtctgcgggtcgacacccatcgcgagcgccggggcggcgtcggtcagcaggttgatccacagcagctgcgtggcgagcagcggcacggcgacaccggtggttcccggctgcgtgatgccaagcacgccggcgagcatgacgccgccgaacacggtgaacacctcgcccacgttggagctcagcaggtagcgcaggaacttgcggatgttgtcgaagatcacacggccttcgcgcacggcggcgacgatggtggagaagttgtcgtccgcgagaatcatcttcgcggattccttggtcacctcggtgccggtgatgcccatcgccacgccgatgtcggcggacttgacggccggggcgtcgttgacaccgtcgccggtcatggcggcgatgttgccctggcgctgcagcgactccacgatcttgagcttgtgctcgggggccacgcgggcgtacacggagacctcagaagtcgccttgtcgaacgccgcctcgtcgggcatcgcgtcgagctgatcgccggtgagggccttgccgcccttttcgatgatgcccagatcggaagcgatgcgggccgcggtgagcgggtggtcgccggtgatcatcaccgtgcggatgccggcgcgatgcgcttcggccacggaatcacgcacttcggtgcgcggcgggtcgatgatgccgaccatgccggcccagatcaggtcacgctcgatgacgtcgctctgctcggagatgtcggtcacctggccggctgcattggtcttgatgccggggatatcggccagggatgtggtgccgagcgggcggtacgcctcacccagcgtgcggtatgcctcgccggacagacgctcgacggtcgcgagaatctcctggcggtcgccttcggtcatcgggcggacggcgtcgccaaccgcgatgcgcgtgcagtagccgagcagcacatcgggcgcgccctttgcatagacgctcaggttgccgttgtcgctgctgtccttgccgatcacggccatacgcttgcgctcggacgtgaacggaacctcggccacacggtcgagcttgccgagggcgcgttcggccttgatcttgcgggaagcgacgacgagcgacacctcggtcgggtcgccgacgatctcccactggccggcatcgttctgacgcaagtcaccgtcgttggcaaacgctccgacggcgatggtgcgcagggcttcggcgttgaccggagcgctctcctcgatggcgtcgccacccatgcccagcatcttgcccttgggctcgtaaccggtgccggtgagctgcacttcaccgctcggggtgacgatgcgctcgacggtcatctcgttacgcgtgagcgtaccggtcttgtcggagcagatcactgaagcggatcccagcgtttccacggagctcagcttcttgacgatggcgttgtgcttggccatgcgctgcacgccgagcgcgagaacaaccgtcagaatcgtcgcaagaccttccggcactgcggcgacggccagcgaaacggccagcagcagcgagtcgatgagatcgtcgggcatcttgtggaagccctgcgtgatgaacagcgcgacgagcacgacggccgcgatgatgcacacggcaatgcccaggatcttggagacgtgggtcatctccttctgcagcggggtatcctcgtcatcggtctgcgacagcatgtcggcgatcttgccgacctgcgtgttcatgccggttccggtcacgatcgcgcggccggtgccctgagtgacggacgtgccgttgaaaatcatattggtgcggtcgcccagcgccttggcggagtcgagcgtgtcgggcttcttgcccaccggcacggattcgccggtcaggctcgcctcggcgatgcgcagcgacgcggcggcgaacagacgcccgtcggcggagacggtatcgccttcgccaagcaccacgatgtcgccgggaaccacgtcggcggtgttgatgtgcacgattttgccgtcacgcagcacggaggtctgcggtgccgtcatttgggcgagcgcctccaccgcctgctcggcacgggcctcctgaatatagcccagcactgcgttgacgatcaggatcaggatgatgacgatggcgtcaaacggcagcacttcgccggccgttccgtgcgagcgctcgatgaaccatgcgatcagtgagatgacagtggcggcaagcagcaggtacaccagcggatcctggaactgcgccaggaacttcttccacttgggtacgggtggcgcgctggccaactggttcgggccgaatttctccaaccggcgctgcgcctcggcggagctcaggccggtattggtatccacatccagcgccttggcgacttcgttcgtctcggtcaagctgggatcgacgtcgtgaagcaggccttcctgcgactgcacgcctgtggattgatcatttgtgtgatcaaccataatggtctccttgatatagccgcggagtagtcagccctcacgatcaccgggatcgtcccctcccccggtcatctcgataaagctgcgcggttatgggcaccggcgcaactgctgccgatgcatactgttgccattattccacaaacccgtcatcgcttggcgaaacagccctttacgtgttgtccaaatatccgcattccgcgaacgatttcaggcgacacgctcacacagcgcgagcagccagcggagcgccgccatggtgtaatcgaacagtttgtcgtccatgccgaaataccgctcgcagcgctccctgctcacatcgaccatcgcaagaccttctggctctccgggtatgaatgacgccgcccgatcctgcattcatcatacgtgccaaggcaaggaactccggcggcttcggaaccggacgagctgcgttccgttcctaagtgcgcgccgaaacgacaactcgggggtgcggatgtttttttggacggttagacggccagtccaaggtgtttgcggtgtggtggtttgagaactcaagagtgtgtttgtactacttttttggttgattttatgccagtccggttcccgcctgcgggtgtttgcccgtgggtgcgcgagggcgcttgatgggggccggggtttttcgtgcggacttcttttccttattaagaagtcgcgtcaatttttggggtcatcaatggttccctttcgtttttttgtggagggttcgattctggctcaggatgaacgctggcggcgtgcttaacacatgcaagtcgaacgggatccatcaagcttgcttggtggtgagagtggcgaacgggtgagtaatgcgtgaccgacctgccccatgctccggaatagctcctggaaacgggtggtaatgccggatgttccacatgatcgcatgtgattgtgggaaagattctatcggcgtgggatggggtcgcgtcctatcagcttgttggtgaggtaacggctcaccaaggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttgtttgggagcaagccttcgggtgagtgtacctttcgaataagcgccggctaactacgtgccagcagccgcggtaatacgtagggcgcaagcgttatccggatttattgggcgtaaagggctcgtaggcggctcgtcgcgtccggtgtgaaagtccatcgcttaacggtggatctgcgccgggtacgggcgggctggagtgcggtaggggagactggaattcccggtgtaacggtggaatgtgtagatatcgggaagaacaccgatggcgaaggcaggtctctgggccgtcactgacgctgaggagcgaaagcgtggggagcgaacaggattagataccctggtagtccacgccgtaaacggtggacgctggatgtggggcacgttccacgtgttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgttcccgacgacgccagagatggcgtttcccttcggggcgggttcacaggtggtgcatggtcgtcgtcagctcgtgtcgtgagatgttgggttaagtcccgcaacgagcgcaaccctcgccccgtgttgccagcacgttatggtgggaactcacgggggaccgccggggttaactcggaggaaggtggggatgacgtcagatcatcatgccccttacgtccagggcttcacgcatgctacaatggccggtacagcgggatgcgacatggcgacatggagcggatccctgaaaaccggtctcagttcggatcggagcctgcaacccggctccgtgaaggcggagtcgctagtaatcgcggatcagcaacgccgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacctcctttctacggagatttcaggccactgtctggtggccggtgtgtgcccccttgccccggatgtgccgggtgcgcgggggttgctggtgtggaagagtggagtcggccttcgggcgtgccggtcgtgcggtgcgtccaggagtggtgcgggcatgcttttgggttcccggaccgccaccccgcgccgtttggcgtggctggtgttccgtgccccgtgccggtcgcccgtcccctggtggggtgggtgggctcgcgtgcgggtgcgtggtggtttgagaactggatagtggacgcgagcaggggacgcccttttcgggggtgtcttctgctgttgatttcgccggactcttcggagtctggtgtttgatcgttttgtgtgtgatcatttgtgtgatgatttgtgttgccagcggagtttttgccgtgggcttgcggtttcccgccgttcccggatgggtcgtgcgggttgcttgcaagggcgtatggtggatgccttggcagacagtaccgatgaaggacgtttgaggctgcgatatgcctcggggagccgccagcagggctttgatccgaggatttccgaatgggggaacccgccggccgtcatgggccggcaccgcgttcgcgcggggggtacgcagggaagtgaaacatctcagtacctgcaggaaaggatgttccgtgagtagtggcgagcgaaagcggatcaggccaaaccgcgcgcgtgtgacaggcgccagccgttgcgcgcgtggtgttgagggagcgtgtgtccgggtcctggcgggcccggccggagtgataaaacggcgtgtgaggcgaaccggattgaatgccgggccgcagagggtgatggccccgtagccgaacgcgcgtcgtctccggatcgtgtctcccaagtagcgcgggactcgtggaatcccgtgtgaatccgccccgaccgtggggtaagcctagatatacctgtctgaccgatagcgaactagtaccgtgagggaaaggtgaaaagcaccccgggaggggagtgaaacagtctctgaaaccgtgcgcttacaaaccgtcggagcctttcggggtgacggcgtgcctatcgaaaaatgagtctgcgagtcagtggcacgtggcgagcgtaacccgtgtggggtacgcgtagcgaaggcgagtctcaaaaggcgtttgagtcgcgtgtcctggacccgaagcgggatgatctagccctgagcaggttgaagcgcgggtaagaccgcgtggaggaccgaacccacctgggttgaaaaccggggggatgacttggggttaggggtgaaaggccaatcaaattccgtgatagctggttctctccgaaatgcatttaggtgcagcgtcggggattacgtccggggggtagagctactggatgcttgagggcccgtatcgggtaccgacagcagccaaactccgaatacccgtgacgcgtatcccggcagtgagtcggcgggggataagctccgtcgtcgaaagggagacagcccagatcgtcgtctaaggtccccaagcgcgtgctaagtgggaaaggatgtggagtcgcatagacagccaggaggttggctcagaagcagccacccttgaaagagtgcgtaacagctcactggtctagtggttccgcgccgacaatgtagcggggctcaagcacgccaccgaagacgcggcagcgtccgtttggatgctgggtaggagagcgtccccatcggggcgaagcggcggcgcaagcctgccgtggaccgttggggagtgagaatgcagacatgagtagcgagaggcgggtgcgaatcccgcccgctggatgaccaagggttccggggccacgttcgtcgtccccgggtgagtcgggtcctaaggcgaggccgacaggcgtagtcgaatggatgaacgggctgatattcccgtaccggcagcgaaccgaaacaaccgaggcctggggcgctaacctccgggtccgtgccgtctcccctttcggggggtcgcggcgcgggcgcgttgggatcccccctcgtagtaggtcagcgcaggagtgacgcatcagggcagccggccgcggaggtggttttccgtggtcaagcgttcgagcccgtcccgcaggcaaatccgcggggcgtcggggcgaggcgtgatgatgggggccttacggcccgaatccggtgatccgtggtgccgagaaaagcttcggcgtcaggcgcgttgccgcccgtaccccaaaccgacactggtggtcaggtagagaataccaaagcgatcgagcgaatcctggtcaaggaactcggcaaattgctcccgtgccttcggcataagggagaccccctgcggtgatgagcggcggggggtggcacaggccagggggtagcgactgtttaccaaaaacacaggagcgtgcgaaggcgcaagccgctgtatacgctctgacgcctgcccggtgccggaaggttaagaggatccgtcagcttctgcgaagcggtgaattcaagccccggtaaacggcggtggtaactataaccatcctaaggtagcgaaattccttgtcgggtaagttccgacctgcacgaatggcgtaacgacttccccactgtctcgaccaggagctcggcgaaattgcagtacgagtaaagatgctcgttaagcgcagaaggacgaaaagaccccgggacctttactataccttggtattggcattaggcgcggattgtgtagcataggcgggaggcttcgaggcgggtgcgccagcatccgcggagccgcaaggtgaaataccgctctgttctcgtttgatgtctaacctcgaacagtcatcctgttcagggacagtgcctggcgggtagttcaactggggcggttgcctcccaaagagtaacggaggcgctcaaaggtccgctcggcccggttggcaatcgggtgtcgagtgtaatcgcacaagcgggcttgactgcgagatcgacggatcgagcagggacgaaagtcggagatagtgatccggtgccggcgcacgggcgcggcatcgctcaacggataaaaggtaccccggggataacaggctgatcattcccaagagtccatatcgacgggatggtttggcacctcgatgtcggctcgtcgcatcctggggctggagcaggtcccaagggttcggctgttcgccgatcaaagcggcacgcgagctgggttcagaacgtcgtgagacagtttggtctctatcctctgcgctcgttggaatcttgaggaggcctgcccatagtacgagaggacctgggtggacgaacctctggtatgccggtcgtcacgccagtggcgcggccggttggctacgttcggaagggataaccgctgaaagcatctaagcgggaagccttctccaagataaggattccatgcggccccgagccgctgaagaccccatgcagaacacgtggttgataggccggacgtggaagccccgcgaggggtggagccgaccggtactaatggtcgagaggcaacccacatccacacgcccgcgagggtgtgtggcgcaggacccggcagggccccgcgaaggcgcacagggagcacgtcctcacacgcgcacgatcagtcaacagcaacgaatcgcgtccattgtccggtccccgaaccgccacacgccggcgggaaaccctgtttcccggccgataacccaagatttgcggcggccatggcccaggagagacgcccggtcccattccgaacccggaagctaagacctggcacggcgatggtactgcacccgacagggtgtgggagagtagcacgccgccgcaccacacgacaaggacccccggacgaggggtggcaggcatagtaaaatgatggtgtggaagacatagatggtatttgttttgcatttacggcaccggatgcgggcgataatgacgggaagagatttagtatgtgggacagaatttcggcggcagtattgagaccatgagagtagcaaacgtaagtctaaaggttgttttatagtagttaggatgtaggaaatgtattccgataggccattttacatttggagggacggttgaaagtggacagaggaaaaggtgcggaaatggctgattttgattgtttatgttttgtgtgataattttacatttttgcatagtattaggtagttagatgaaagatgaatagacataggagtaagaaaacatagaatagttaccattattggtaggagtgtggtggggtggtatagtccgcattgggatgttactttcctgttatggcatggatttccctttagggtctctgaagcgtatttccgtcaccgaaaaaggcagaaaaagggaaactgaagggaggatagtagtaaagtttgaatggtggtagtgtaatgtatgatatccgttggttttggtttcggttgtgaaaagttttttggtatgatattttgcaagtagcatatatttcttgtgtgagaaaggtatattttgtatgttcccgcgcgtttccgtattttccgcttccgtattttccgcttccgtattttccgcttccgcttccgctcccgtattnnnnnnnnnnnnnnnnnnnnnnnnnnnnnnnnnnnnnnnttttccgcttccgcttccgcagtaaaaaaaagtgaggaactgggttacccggggcacctgtcactttggaaaaaaaaaaagaaaaaaatatacgctaagatttttggagaatagcttaaattgaagtttttctcggcaagaaatacgtagttaaggcagagcgacagagagggcaaaagaaaataaaagtaagattttagtttgtaatgggagggggggtttagtcatggagtacaagtgtgaggaaaagtagttgggaggtacttcatgcgaaagcagttgaagacaagttcgaaaagagtttggaaacgaattcgagtaggcttgtcgttcgttatgtttttgtaaatggcctcgtcaaacggtggagagagtcgctaggtgatcgtcagatctgcctagtctctatacagcgtgtttaattgacatgggttgatgcgtattgagagatacaatttgggaagaaattcccagagtgtgtttcttttgcgtttaacctgaacagtctcatcgtgggcatcttgcgattccattggtgagcagcgaaggatttggtggattactagctaatagcaatctatttcaaagaattcaaacttgggggaatgccttgttgaatagccggtcgcaagactgtgattcttcaagtgtaacctcctctcaaatcagcgatatcaaacgtaccattccgtgaaacaccggggtatctgtttggtggaacctgattagaggaaactcaaagagtgctatggtatggtgacggagtgcgctggtcaagagtgtaaaagctttttgaacagagagcatttccggcagcagagagacctgaaaaagcaatttttctggaatttcagctgtttccaaactcaataagtatcttctagcaagagggaataggtgggaaaaaaaaaaagagatttcggtttctttcttttttactgcttgttgcttcttcttttaagatagttatctggttgatcctgccagtagtcatatgcttgtctcaaagattaagccatgcatgtctaagtataagcaatttatacagtgaaactgcgaatggctcattaaatcagttatcgtttatttgatagttcctttactacatggtataactgtggtaattctagagctaatacatgcttaaaatctcgaccctttggaagagatgtatttattagataaaaaatcaatgtcttcggactctttgatgattcataataacttttcgaatcgcatggccttgtgctggcgatggttcattcaaatttctgccctatcaactttcgatggtaggatagtggcctaccatggtttcaacgggtaacggggaataagggttcgattccggagagggagcctgagaaacggctaccacatccaaggaaggcagcaggcgcgcaaattacccaatcctaattcagggaggtagtgacaataaataacgatacagggcccattcgggtcttgtaattggaatgagtacaatgtaaataccttaacgaggaacaattggagggcaagtctggtgccagcagccgcggtaattccagctccaatagcgtatattaaagttgttgcagttaaaaagctcgtagttgaactttgggcccggttggccggtccgattttttcgtgtactggatttccaacggggcctttccttctggctaaccttgagtccttgtggctcttggcgaaccaggacttttactttgaaaaaattagagtgttcaaagcaggcgtattgctcgaatatattagcatggaataatagaataggacgtttggttctattttgttggtttctaggaccatcgtaatgattaatagggacggtcgggggcatcagtattcaattgtcagaggtgaaattcttggatttattgaagactaactactgcgaaagcatttgccaaggacgttttcattaatcaagaacgaaagttaggggatcgaagatgatcagataccgtcgtagtcttaaccataaactatgccgactagggatcgggtggtgtttttttaatgacccactcggcaccttacgagaaatcaaagtctttgggttctggggggagtatggtcgcaaggctgaaacttaaaggaattgacggaagggcaccaccaggagtggagcctgcggcttaatttgactcaacacggggaaactcaccaggtccagacacaataaggattgacagattgagagctctttcttgattttgtgggtggtggtgcatggccgttcttagttggtggagtgatttgtctgcttaattgcgataacgaacgagaccttaacctactaaatagtggtgctagcatttgctggttatccacttcttagagggactatcggtttcaagccgatggaagtttgaggcaataacaggtctgtgatgcccttagacgttctgggccgcacgcgcgctacactgacggagccagcgagtctaaccttggccgagaggtcttggtaatcttgtgaaactccgtcgtgctggggatagagcattgtaattattgctcttcaacgaggaattcctagtaagcgcaagtcatcagcttgcgttgattacgtccctgccctttgtacacaccgcccgtcgctagtaccgattgaatggcttagtgaggcctcaggatctgcttagagaagggggcaactccatctcagagcggagaatttggacaaacttggtcatttagaggaactaaaagtcgtaacaaggtttccgtaggtgaacctgtggaaggatcattaaagaaatttaataattttgaaaatggatttttttttttgttttggcaagagcatgagaacttacacgagttggccgaccaacgcaaatcgacatgccccaagacacccaaaaccgttgaaacaacaacattccatcggcgtgtcgaaaatggccttcaaacacaccctatgaccagaacacccctcctggcagggcggaaaaaactcatatttcattgttctcgggcgtgtcgcaaactattcagaccatgttcaccgaggtccggcagcgattcacggcacctatcgaagccatccacgacaaatcggaagacgtaacgccttcccggcgaccgcaggataccgggaagggcatgcggcggctcaccagttcgacacgatgatgcgataccgtcgagataacgacatgacgcggcaccgcgccgcgacgacactatgtgcaatggcactgaggttgcaatgacaccgggaggatgaaatgcagcacattccgtgggacggcgacatggcggaatttcccgaaccgctgcgcaggtatctacgccctgggcatgtattcgacagcagctcgtccgccgaagcaaccgtatattattccgacatcggccaggggtgctatatcaagaaggcccgtcacggcgcactgcggaacgaggcggcaatgacacggtattttcatgacaaaggactgtccgccgcggtgctgcattatggtcaggaccatgacggcaatgactggttggcgacggcatgtctgccaggtgacgactgcaccgcgtctctttacgtgagggagcccgaacgtttgtccgccgtcctgggacgacggttgcgtatgctgcatgagcaggatccaaccggatgccctgtgtcgaaccgtacgaaagactatctggcgacagtgaagcggaatcatgcacagggatgtgcggaccgttccttcttcacgcaggtctacgggaacgccgacaccgaatcgatatatcgcctggtgcggcagcatggcgacgaattgcgtcacgatacgttgctgcatggtgattattgcctgccgaatgtcatacttgacgattggcggttcagtggtttcgttgatttggattgcgccggagtcggcgacagacatgtggatgtgtactgggctttgtggacgctatggttcaatttgcataccgatgcatatggcgaccgccttctggatgcctacggacgtgatctcatcgacatggaaacactgcggctggtcgccgcctgtgaggtattcggataatccgttccgtgcatgagagcatccgatccggtcgcgcctggatacaggcgacagcgattggacgacgatacgcgcagtgacgatacgcgcagtgaaatacatggacgatgatgcataatgccgataacggacattatgttctctttggcttatgcgttgcagccattacattgagtacagtacgactccatcggcttccgtcctcgctgacggtagcccctgtgaagcggatgaggtgcattgacctcatgcctgttggttgttgtgtttgggtatgggtggacccccgggggttgtttgcctcgtccgggggtccttgtcgtgtggtgcggcggcgtgctactctcccacacccaccgcaaacaccttggactggccgtctaaccgtccaaaaaaacatccgcaccccccggtcgtcgtttcggcgcgcacttaaagacgttttggggcgccagcattaccgacgtgttccccgtcagcgcaaatgggtggctcttggggcgtctctttgcgacaatgacagcatggttaccaacagcactatcgagacgctgctcaatcgcaggtccatccgcaaattcgttgccgagcccttcgacgatgataccgtcgccacactggagaccgtggcccagcacgccgcttccagccagtatctgaacgactggtcggctgtccgtgtcaaggatccggcgcttaagaagcgcatgtccgagatcggcaggcagccgtatatcgccgaagcaccgctgctgtatgtgttcgtcgcggacgagcaccgcaatgcgattatcgccgagtcgaagggcgtgtccacggattcggacacctacggtctcgccggtagctaccggttctctcaggcccagaacgatgcggttctggctttgcatgcgatggagaccgccgcctattcgctcggcctgggatgcgtcatcctcggttccctgctcaatgatgttcccggtctgatcgaagcgctgcacctgccccagtacacgtatcctgtgctgggattggcgatcggcaagcccgatcaggctcccgcgctcaagcctcgcatgcctcgcgagctgcagttcttcgatgacgtgtatccgtcggatgatgacgccattgaatccatcaaggagcgtatcggcgcctttgacgtttcagtgcatgagtactacgatctgcgcaacaccgatcgtcccgttgacgcattcagcgatcagatcgcctcgattgcagcccagcgcatggacgccgcgcatcaggtgataccgaacgccacatcgcagggattccgtctcgaccggtaaatgacccccaaacgataatgggcggtggtcggaacctgatatcgggttccggccaccgcccattgtgttatctgactcgtgttgttcggccctcgcggattcgcctattcagcgaatgacgggagaagagcatcaacgccaccgcggcttgtagcccttcttgcggctgtgcggttttatctgctggttcagggggacatacgtgtgctcatgagcgggatcacgatgcgtcagatgccaggtgccgcagtattcgcaccgatacacccacagctccgctccgcgttcgataaggctctggtcggcggcatgctgcgcctgggccttgtcatggtacatgatcttgttcgaggtggaacagcgtttcggagtgaaataatgcatagcaacaccacagtctaggacaggaattcttctgttgcaacggctgttggttgttgtgtttgggtatgggtggacccccgggggttgtttgcctcgtccgggggtccttgtcgtgtggtgcggcggcgtgctactctcccacacccaacatgcgaactccaatccggacaccaaagcgtccaacttttcatccgcaccccctaacgcccgaattcttgcgcactttcggattccggccctgacgtaagagggcatggcccgcgtcctgtgtacgattttcattcgccaaaacaaaaaaccgcgattggaagccaggagacggaaccatgcccgagaacatcatacagatcgaccagaacctgctcgagaccaggctcgaccggctgatcaccgagaagatgacgcagatcctcaacgcgatgctcgacgccgaggccgacgagatcaccggggccgccagatacgagcgcagcggggggcggaaggcgtacagggccggccactacgaacgcaagctcaccgccaaggccggcaggctcgagctgaaggtgccgaaactcaagggcgccctgttcgagtccgcggtgatcgaacgctaccggcggcgcgagcagagcgtcgaggaatccctgatcgacatgtacctggcgggcgtgagcacccgccaggtcgacgacatcagccaattgctgtggggagaccgcatgccctcgcagacattgagcgacaagctcaaaaggatctacggggagatcgaccagtggcgcacgaggccgttggaatccgaatacccgtacgtgttcgtggacggcgtgtggcacaagcgctcatggggcgggcacgtggagaacgtgagcgtcctggtcgccatcggaatcaacgcggaggggcatcgcgaggtcatcggcgtcacggagggcatgagggaggactcggccagctgggagcagttcttcagaggcatgatcgaacgcggcctgaagggcgtcaggctcgtggtcggcgaccggtgcgccggactggtggccacggtcggctcgatgctgcccaaggcgaagtaccaacgctgcatggtgcatttcatgcgcaacgtgctctccaaggtcccgccgatccacagagaatgggcgtccgccgccctgaaggcggtattcgccatggaaagccgggaatccgcgctggacaaagccgaacaagtcgccgcggagatgaggtctaggaggctgagggccgccgccaactgcctgcgggagggcgtcggcgagacgacgacctacctgctggacgagttcccggacgggcaccgcaggcgcatccgcacgaacaacatgatcgagcggttgaacagggagatccgccggcgcacgcgcgtcgtgggcggcttccccgacgggaacagcgcgctcatgctcgtctgcgcgcgcatccggtacgtcaccgcgaacgaatggtcgacccgccgctacctcgacatgtcccggttcgatgacaacctcgtggaagcgaactgatcatcgctccatggacggccatgatccaaagtgcgcaacttttcgggcactagggggtgcggatgaaaagttggacgctttggtgtccggattggagttcgcatgttgggggtgcggatgtttttttggacggttagacggccagtccaaggtgtttgcggtattgcacggggctcagccagcccagtgactttttgattctggtctcattgtagtgggtcaggtaggcggacaatcgctcgcggaactcctcgtagcccacgcccttccagtcccgcccgtaatagaactcgttcttgagcctgccgaagaccccctcggcggcggcattgtccgggctgcagcccttggcgctcatcgagcgggtcaggccgtgctcctcgcagatgcgaatccattcgtcccaccggtagtggcagccgcggtcggaatggatgatcggatgctcgtcgtccttgagcgtggcgaccgcgtcgaggagcatccggttcgccatgccggcgttcggggagagcgacagggtccaggagacgaccatcccgtcgaagcagtcgaccaccggggagagccagcacttgtacccgtccatcgtgaactgggtgacgtccgtgacccacaacaggttcggcgcgtcggcgtggaagtcccggtccacgaggttcgcgggcgcctgcgtgatctccccctcataggagctccaccgcttcggccttttcaggtacacgggccgcagaccctcctcgcgcatgatccggcgcacgaccttctccgagacgaggaccggctcgtccccgtccaggcgcagcatgcggtggatggtccggtagccccacacgcgcccgcccttctcgaacaggtccgcgacgcgggcccgcaatgcggcgtatttgtcgcccgcggcaatcgcgccgcgctcgtaataataggtgctgcgcttcagccccacggcatccagacaagctgtcaggccgaactcacccctgaccgcgtcgacgacccgcgtcctctccctgttcgtcatcatggacgggtcgaggcgcgggtcgtcggcttttaaaacattgatcgtctcccgcatcaccgcgttctccagccgcagggcctccacctgccggcgcaacccgtccacgtcatcgccggccgcgggcgtcggcccggcgggcgtcggcgcgtttcttgcgttcatcagtcccagtatcccctcgctgtggtagcggcgcatccactggtacacgctcgtcggcgtgcagcccgcgtcgcgcgccacgctggcgagggactcgccgccgagcgcgcgtctggccgcgttcgtcttgcattccagcgtatacgaacgcctgcacgcgcccgtgtagcgcgggtcctcgcggacccatttcaccagcgcgccctcggatggatagccgagctcggcgacgaccttcctgatggtcatgccctccgtgaaatacaggtcaacggccctgcgccgatcctccatcgaaaacatgcgaactccaatccggacaccaaagcgtccaacttttcatccgcacccccaacgccagctgctcaccatcgcccgcgtcttccttgcggacccgccgatcctgatgtcttcggatggatttgagtaagagcatagctgttgggacccgaaagatggtgaactatgcctgaatagggtgaagccagaggaaactctggtggaggctcgtagcggttctgacgtgcaaatcgatcgtcgaatttgggtataggggcgaaagactaatcgaaccatctagtagctggttcctgccgaagtttccctcaggatagcagaagctcgtatcagttttatgaggtaaagcgaatgattagaggttccggggtcgaaatgaccttgacctattctcaaactttaaatatgtaagaagtccttgttacttaattgaacgtggacatttgaatgaagagcttttagtgggccatttttggtaagcagaactggcgatgcgggatgaaccgaacgtagagttaaggtgccggaatacacgctcatcagacaccacaaaaggtgttagttcatctagacagccggacggtggccatggaagtcggaatccgctaaggagtgtgtaacaactcaccggccgaatgaactagccctgaaaatggatggcgctcaagcgtgttacctatactctaccgtcagggttgatatgatgccctgacgagtaggcaggcgtggaggtcagtgacgaagcctagaccgtaaggtcgggtcgaacggcctctagtgcagatcttggtggtagtagcaaatattcaaatgagaactttgaagactgaagtggggaaaggttccacgtcaacagcagttggacgtgggttagtcgatcctaagagatggggaagctccgtttcaaaggcctgattttatgcaggccaccatcgaaagggaatccggttaagattccggaacctggatatggattcttcacggtaacgtaactgaatgtggagacgtcggcgcgagccctgggaggagttatcttttcttcttaacagcttatcaccccggcattggtttatccggagatggggtcttatggctggaagaggccagcacctttgctggctccggtgcgcttgtgacggcccgtgaaaatccacaggaaggaatagttttcatgccaggtcgtactgataaccgcagcaggtctccaaggtgaacagcctctagttgatagaataatgtagataagggaagtcggcaaaatagatccgtaacttcgggataaggattggctctaagggtcgggtagtgagggccttggtcagacgcagcgggcgtgcttgtggactgcttggtggggcttgctctgctaggcggactacttgcgtgccttgttgtagacggccttggctaggcgagcgcgcttcatctgcacgatctgagcttcggcgcccaacaaatcagacaacaaaggcttaatctcagcagatcgtaacaacaaggctactctactgcttacaataccccgttgtacatctaagtcgtatacaaatgatttatccccacgcaaaatgacattgcaattcgccagcaagcacccaaggcctttccgccaagtgcaccgttgctagcctgctatggttcagcgacgccacaaggacgccttattcgtatccatctatattgtgtggagcaaagaaatcaccgcgttctagcatggattctgacttnnnnnnnnnnnnnnnnnnnnnnnnnnnnnnnnnnnnnnnnnnnnnnnnnnnnnnnnnnnnnnnnnnnnctgacttagaggcgttcagccataatccagcggatggtagcttcgcggcaatgcctgatcagacagccgcaaaaaccaattatccgaatgaactgttcctctcgtactaagttcaattactattgcggtaacattcatcagtagggtaaaactaacctgtctcacgacggtctaaacccagctcacgttccctattagtgggtgaacaatccaacgcttaccgaattctgcttcggtatgataggaagagccgacatcgaagaatcaaaaagcaatgtcgctatgaacgcttgactgccacaagccagttatccctgtggtaacttttctggcacctctagcctcaaattccgagggactaaaggatcgataggccacactttcatggtttgtattcacactgaaaatcaaaatcaagggggcttttacccttttgttctactggagatttctgttctccatgagccccccttaggacatctgcgttatcgtttaacagatgtgccgccccagccaaactccccacctgacaatgtcttcaacccggatcagccccgaatgggaccttgaatgctagaacgtggaaaatgaattccagctccgcttcattgaataagtaaagaaactataaaggtagtggtatttcactggcgccgaagctcccacttattctacaccctctatgtctcttcacaatgtcaaactagagtcaagctcaacagggtcttctttccccgctgattctgccaagcccgttcccttggctgtggtttcgctagatagtagatagggacagtgggaatctcgttaatccattcatgcgcgtcactaattagatgacgaggcatttggctaccttaagagagtcatagttactcccgccgtttacccgcgcttggttgaatttcttcactttgacattcagagcactgggcagaaatcacattgcgtcaacatcactttctgaccatcgcaatgctatgttttaattagacagtcagattccccttgtccgtaccagtttctgcagggaccctgcgatcggagtctgaaatcagaggtaccctgcggttcctgcctcaactggagatgaggccctcttccaatgcaccaagcccagtggagtcccgagaggcccctcccacctccagtttccctggcttctcagagccaccatgagaagccccctgaggtcacctgcacaagtcgagggaacccagggtttcctgcctcaacccgggaaagacctcgagagaccttcttcaacacgtctcgaggccagattcccctaccatggctcgggagcaatgacgcgctccccctcgccactcgcatggagacccgacttccctggcgccccacgagaggctcactgacctcgccgtcgtacctcgtgagaaaccgcacactggggccgccgctcgagaacaaccccgagattcccccgtcatcgcgagatgagggccttcgtctcctgcatggcctagagaccaatctcgcgacctctctccaaacgcctcaggaggcttgactcccttgagtccacccagtgagctccaagagatacccgtcgcgatgcgagagcagggcggggttctttgcttccactcgagatgaatgcctgtctccccgggtgcgtctggaatgcaaccccgagatccctgtcgcccctggagaggaacattggcttctggacacaagcctagatgaggtctattggccctgcagtcactcgagagcaatccccagctttccttcgcaactcgaatggaagattggacttgcctgggccaacacaagaggcagcctgaattccccgtcgtaactcgagaatcccgccgtaactcgagaaaaaccacgtggctcccccgtcatcgcaagatgaagccctttcccgctacagcgcctcaggagaagtcccactttaggaattggagttcgaaagggcacttgtcacccttgatgcgacccacaaagtgccccgacatcccggtctccctcgagaggaacaccgaggttttccggcaccccctcctctgagccctttctcccctcctgatctggacaggagggtcgactcccctgctttgtctggaaggggttcccgaccttccggtcgcacctcaggatgaggccggtctcacgacgacattccagacgtggcctcgtgggtggttccacattccgaaggaccccgatttcccggtcccctcttgataagaacccgatgcccggacacctctccgaactccagcctgtgaatgaagtcaacacgaaggggcagtggcctgcccgtgcctcgtccggaaaagacccccaggttgtcagtatggcgtgactttctcgtacaaggtccagccgaacccggacgggcttgctaggcttgtaagtttctttcttgctattccaaacggtgagagatttctgtgcttttgttataggacaattaaaaccgtttcaatacaacacactgtggagttttcatatctttgcaactttttctttgggcattcgagcaatcggggcccagaggttaacaaacacaaacaattttatttattcattaaatttttgtcaaaaacaagaattttcgtaactggaaattttaaaatattaaaaactttcaacaacggatctcttggttctcgcatcgatgaagaacgcagcgaaatgcgatacgtaatgtgaattgcagaattccgtgaatcatcgaatctttgaacgcacattgcgccccttggtattccagggggcatgcctgtttgagcgtcatttccttctcaaacattctgtttggtagtgagtgatactctttggagttaacttgaaattgctggccttttcattggatgttttttttttccaaagagaggtttctctgcgtgcttgaggtataatgcaagtacggtcgttttaggttttaccaactgcggctaatcttttttatactgagcgtattggaacgttatcgataagaagagagcgtctaggcgaacaatgttcttaaagtttgacctcaaatcaggtaggagtacccgctgaacttaagcatatcaataagcggaggaaaagaaaccaaccgggattgccttagtaacggcgagtgaagcggcaaaagctcaaatttgaaatctggtaccttcggtgcccgagttgtaatttggagagggcaactttggggccgttccttgtctatgttccttggaacaggacgtcatagagggtgagaatcccgtgtggcgaggagtgcggttctttgtaaagtgccttcgaagagtcgagttgtttgggaatgcagctctaagtgggtggtaaattccatctaaagctaaatattggcgagagaccgatagcgaacaagtacagtgatggaaagatgaaaagaactttgaaaagagagtgaaaaagtacgtgaaattgttgaaagggaagggcatttgatcagacatggtgttttgtgccctctgctccttgtgggtaggggaatctcgcatttcactgggccagcatcagttttggtggcaggataaatccataggaatgtagcttgcctcggtaagtattatagcctgtgggaatactgccagctggg
